United States Patent 8,101,349 (GENE PRODUCTS DIFFERENTIALLY EXPRESSED IN CANCEROUS CELLS AND THEIR METHODS OF USE II) - sequence listing, part 2

SEQ ID NO: 2976 - DNA, 300 bp, Homo sapiens
agaaatttttctgcatttttatatgctgaaactagtttatatcttgattccaaaataacttgttaaaatatatagtttaaaaccttgtatatattataaacttagctttgtaatattaagtatgaaagcagcaaagatagatagtctcagaagaagaagaaatgtataaattttggggagatgctgtgataaatagactagacttacctttgagttcctagcgatacctacctgacagcttccagctggaaaatctgcttggcaaggaaaggggaatatgattattgatgaacttccagc

SEQ ID NO: 2977 - DNA, 300 bp, Homo sapiens
gtttcgccttgttggccagactagttttgaattcctagcttcaagtgatccacctgcctcgacctcaccatcctagattttaaaccttgaaattttctagagctgcctcccagtgactttaacttactgtgtggatctgccttgctgccctcacttcttcatcttctcaccccgtcctcaccacttccttgtcttcttttggactggcttgtgtttacaacattggattagcagttgtaaggtcagcaatgaattcccaaatagcattcagcacctattttcagcccttcttaatttttc

SEQ ID NO: 2978 - DNA, 300 bp, Homo sapiens
gtggccagagtggagaggatgtgcagaaaggggcaggagatgaaggttggcagcagctggtcatgaaggtgttaacaaggggcctccactgggctgtgcggagctactgaagatgtttgcacaagagaagggtagggcatggtagacatcaaaactcctgggacctcggaggtgatcgagcctaacctggggccattttacagataggaagactgagatgaagacaggagaagggccatgcgtgaagtcacatagcactgggcctggctcctggggtaaactaaggggtagaaaagtctg

SEQ ID NO: 2979 - DNA, 300 bp, Homo sapiens
gtttgtataaaggttgtcagtttaatattcaagcaattaataaagacaaggtgtgagtttttctgttaatgcacctctgtcttaatgtgaagcaacgtataagcatgcatcttaccataattggtgtgcatgtctgtgtacatgggcacaaacatttctctttcagccctgtaatcacatctccaagtaatctaagtcaaaaagagcaaaatctaagccagtggacatgctgaggctatctcagggtcttctggaatgatcaaggccagaaatcccatcttcatatacattttttttttt

SEQ ID NO: 2980 - DNA, 300 bp, Homo sapiens
atctgttcagttctggcttgaaaatgtgtgtgccatactgtgacccacgggcagcccctcctcctctactgtgtcaggtggaccagggtcacctctgttctgcgcagctttgagattctaggattctacggccggcacgaatggcatgggagggttctctgcacgggacggcataacggcatgccatccttcaggctggcaggagcctgcgcaggtgtggcaaaatcttgaaacagcctgtgtcctgcctggcttttcactttcctatttaatataagaaagcacttttttttctgcttt

SEQ ID NO: 2981 - DNA, 300 bp, Homo sapiens
ggcagttctagatcttgtgctttaaactctggcctgcctttcctaattctcagaccaacaagtagtgttttcccattcgtattgcttatcataaaatgagagagtcttctgtccatcatctttattgaaagttgaaccactgtaagcaaaaataccaaggagaggtctgatcccactattgaaataaaaagaaccatgagggccctgcagaattcaactggaccttggggattactcactgaagaaggttttctattttgaatgtttattgtcttcctaccccagtctccccaacaagaa

SEQ ID NO: 2982 - DNA, 300 bp, Homo sapiens
ccggctttagtttttaatatatagcttagttggtcacatggtgcagatggcattccttcagtatttcgcgtgccagttgtctcagctaatagatatcagcagctggcaaggaccttggctgcactgcctgctgccccctcatcttcactggcacagggccctacacttagtcaacaggcagccaaaacttactgagtgaaggaaccaaaggcacaacttgagaactgtctatgtttgtgtttatagaagaggaacaataaagtcatcgactatctaaatataatgaataacaaaaaagaa

SEQ ID NO: 2983 - DNA, 300 bp, Homo sapiens
gaagaagcagcacacttattctcctgtacctctggaacatgtgagcaccctggttgttctgggctttctctgccaaggctgggaaactagagttctggcagctttgttgctcctttgtcttctgtgtgagccgcggtgtcatcagccaggtcaccccgcttgcagcacagtcgctgtgctctgggcatcggtggagcggggagctctggttgtgcacagagggccaggtgtagatgttgtgcacagaagtcagccccacccaggttaggctgagccgtcttccctgaacctgaaatggtt

SEQ ID NO: 2984 - DNA, 300 bp, Homo sapiens
agatgttataaaatgtgtaggcttttaatatataagttatttggctcctttgttttggcatacttaaaacagaagaaaaccacttctggggcagaaaagctagaactgatatcacagttccctctggtggctgctatgtgtcaattcgatctccttagaagaaaatagtgtagcctaaaataggtctttctttaccacagttagatccctgcagcaatctacttctcgaaacagaataaccattcaactatgacagctatcttaaaatcatagactgtaaataatattggtcacttctac

SEQ ID NO: 2985 - DNA, 279 bp, Homo sapiens
  misc_feature 214, 217, 221, 231, 234, 239, 242, 247, 250, 253, 255, 257,263: n = A,T,C or G
gtttgtttcatgatcaaataatgaatcttaagagcagtatttctcacagacgcagaatgttccagcaattctccttcaggcacatttcctttgctgaaacctttttagcaggtccctggagcactcatgaacaaaataaaaaaaccagaaaccctgtaaccctggtttctattaaagtctagcttggggctttttttttttgacaaagggtcgnaangtcncccaggctgnagnggagnggngcagnctnggntnantgcaanttccacctcccaggtt

SEQ ID NO: 2986 - DNA, 300 bp, Homo sapiens
gcgacgtgtctgcggagcctttttatacctccttcccgggagtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggtaggcttccaggcgccggcttccctccccgccaccgcactgcacgcgccgacccccaacccccaattccccggcacttgggtcccaccctccccgggagggggcgtcgggaggaggagta

SEQ ID NO: 2987 - DNA, 300 bp, Homo sapiens
ggttagcagagccaacaagcaccctgggagaaacacacacttccttggtggcaaattggaaatcatcactgcttttctgtagacatttagccgcagatttgattcaaaatcctgttagtaggtggtgactgaaatagtttagtgggggcagggaacagcaagaggtaggaggaaagccattcagtaaatcccccaaatcccaatgtttgccctgctcatttgagcaactgctcccattgtcaggagaaggtcattcctgtatgaatgtttacatcacaaataaaatgaagcttcagtaga

SEQ ID NO: 2988 - DNA, 300 bp, Homo sapiens
gttactgatggagagagcagagaagctggtgtttgcagtcccatctgtcagccttgacacccctactcctgtccagccagtgtttctcaaagcgtgctgatgagcaatgcaagatgatttcatgttatagataagaataaaaaaattgttttgtgtttaactcaaattagaaaaaggcaacaattggtatgtgcgacctgtggttttgcagatgatactgcttaggatgttggtacttaagaaaaggtcaacttttcaaaaatactattagtgacatgtggacctagtcctcctgaagag

SEQ ID NO: 2989 - DNA, 300 bp, Homo sapiens
gccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgg

SEQ ID NO: 2990 - DNA, 282 bp, Homo sapiens
  misc_feature 143, 144, 152, 153, 154, 162, 163, 165, 170, 175, 185, 190,193, 196, 198, 201, 206, 208, 213, 214, 218, 222, 224, 231,238, 239, 241, 243, 245, 247, 248, 249, 251, 252, 253, 259,261, 264, 276: n = A,T,C or G
gtgatgctggtgatcaatggactggaagccaacagcagagacttagacccaagaagggagcttgaggtacaagaaaacttcagggtagacaggaaggaggcgtggtgaaagtgatgaaaggggagagtagaagggtcacctcnnccccatcnnncacctctnncntctcnccccncctccttccnttctnctncancnagntcccncncctcnncacnttcntnctccccntaccccnncncntncnnncnnnccccancnacnggctcgccctcnagcttc

SEQ ID NO: 2991 - DNA, 300 bp, Homo sapiens
gattcatcttcttgttctttaaaagtcaaaaggctttttgacctttaaataactcttacatctggtcatcactgttgaaatgttctactaaattttcagagtggaaaagttttaggcttaaaactgactggtaaaaatagaatatttctttgtattgatttttcagtatagctgtacagccagttatccttcgttaagtgtttcggtattaaaactgctcacatttgtaaatattgagcagctttattgtcagaacaagaatcccttggtttcccaatccccaacttttaacattgtaat

SEQ ID NO: 2992 - DNA, 300 bp, Homo sapiens
gagaacctaacaaatgaatgtggtgggtaaggaagagaaagaagtagagatgaaatttccactctgactggggaaactaggtagatagatgatcatgaagaatctgaggaagagcagaagtcgtacaggtaagaatgaatgcattcattaatttattcagcaaaactgcctgaagaataccatgtgcagcactgcgggacaaaacagggcttgcattcccaggctgtactcttgtgaggacaacaagaaggaagtagagaaacacacaagaacaatgctaagatggggaaactccatacg

SEQ ID NO: 2993 - DNA, 300 bp, Homo sapiens
agaaggaaggaagaaaggaagggagggaggaagggagggagggagggtttgaagttaacaaatctatatttggtttggaaaatatggtcacatagctataggcattctgcagaaaacatcattccttgttaatagtcaaataacttaggaatttaataataattatacctaactcttattgagtacttaatatgtaccaggcatatagtatataaatatacctatatagtatataaaaataaattgtaaaattttgtaaaatatatataaatttttaatgtaaatatatttatattattt

SEQ ID NO: 2994 - DNA, 300 bp, Homo sapiens
cttggggccaggatcctggagtccttgcttggggataacttcctggagagctgctcagtcagctatacccttgggagtcttttgttgagggagaaataaatgtcattttgcaaagccactgatattctgtggttatcacggcagtttagagaggaaggatgggggaaagctgggttgcgctctaggccttgacacttcctgcctttgtagtgttaggcaaacatggcaaccccagaaaactcagctgcctcagttttaaggcatgcagggtctttgtgaggaccatataagccacgtgga

SEQ ID NO: 2995 - DNA, 300 bp, Homo sapiens
acagcattcgctgaccattctcctcctccacccaccaaggacaggagggctaacccaggcagagaacctacgctgagaactcaccaccagaaaaaatatctgcttttaaaagcacagtgcacaatagtactttttaaaagctaaaagagctaagtttaaagttaaagacacgtatgttctttgacacagatctcctaaaagtctgacaaaattagaagtaccagcacataaaaatagatgcccaagaatgtttattgaaaaaagctgaaaacccatgactatctcaataggacaatgaca

SEQ ID NO: 2996 - DNA, 300 bp, Homo sapiens
aggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagat

SEQ ID NO: 2997 - DNA, 300 bp, Homo sapiens
ggatggtctcgatctcctaacctcatgatccgcccgcctcggactcccacagtactgggattacaggcgtgagccactgcgcctggccgccaatagtgttttaaatggcacaaatttgaatgcctcccccttaagatcaggaaaaaggaaaggatgtctgctttcaccacttctgttcaaggttgtagcagtgagataagcaaaataaataaaaggcatccagattgtaactgtgcttttttacagagcaggatttataccaactggtttcacaaataattttaaagattcactactcaa

SEQ ID NO: 2998 - DNA, 300 bp, Homo sapiens
caattcttggctccccaaagcccttaccaaaataagtgagtaagagatggcgagtctttaaaggagtggctcatctttcctctccctggggcattttggtgtgggagactacaggggatgaggttaaaaagcttggtcggcaggtagaggatggggagagaggttagggccctgggaaaggtgagagatcagccagagacaggtttcccagaacagaatgtctggcctttgtggtgaggagggactgtggtatgagccgcagaagcgggccaggggtaaaccctcctgtgcgtccttcct

SEQ ID NO: 2999 - DNA, 300 bp, Homo sapiens
cagaacttcatatcctactaacatagaccacaacagtcattttcaaagaatactgataattctatggaatgcaatttaaggacattaaaagccttcttcttgggcatgaaatcttaccatatacaagctgggccctgaaagtttaatttcctttagtcctatttatggggcctatgattaacctgctgctctccatcctcttccctcatccctgggccacatgactaccaagtccaaggatgcctgccaccctcttgcatagtgccctttcctacaactgccaccaaactcagctgacag

SEQ ID NO: 3000 - DNA, 300 bp, Homo sapiens
attgccctctgctgcctccaccacaccaaggcatcgagacctctggcttctctcatttgctcttccctgtcccccaaaacctaccagcttaaccctcctttgtgccatgtcactggtgcctgtggctgcacgtaactggaatggaacatgccttgtttcccactcagccccctttaagctacatcctgaattccccaaaccactcttcctcgtacctgttctgctgcacccaggtgcctgcacggacagggaagcatcttttctcggtagtgcactgtgcttcagagactgggtccccct

SEQ ID NO: 3001 - DNA, 300 bp, Homo sapiens
ctcaattgtacatcgcaaatcccactcttgccctcctgcagtgtcagaggacttggctgtgatgggaataagccttggctctgttctccttgcatacttagcccatgggaacccagtttctggcctcaccaggaatgttgttgtgctttgagctccctgtggccttgcatgatgcctccgttggtccttacaggaggtgattggctggccacctcacttgctttctcctgtggacccttctttctctgtccttccttgaatgctgcctttgtccctcatgattatgctatcaacattctt

SEQ ID NO: 3002 - DNA, 300 bp, Homo sapiens
gacctttcctatagagaagaagagtagtctttgcaaatttgctttacattggtgaaaaaagtcatcatttcgaagccactcatttcatcggaattgggagggccaccatcttatagctgggcttgtgaacctttgacttttcccagtatatattggactattttgatcactgctatatgcttctagttcctcaatcagtatctgccacagaggaggccctctaaattttttgtggaattacttaatgaaatgaatgagtgattattcgccttcacaggattgtgtgagaccatataaggt

SEQ ID NO: 3003 - DNA, 300 bp, Homo sapiens
gcactagtgtatcttaaagtaagagaatgacttttattcaagaaatacacaacaggcaagtgccgtataccaggaattgttcaaggagagcaggtagtttgtcttatattctaacgtgggagaaagaaagcaaataaattacatgaattgattaattgatcagttgcatggcttttagtatacatttctgtcagtctgccaaccagcacaggtcccttattagcatgggagaagggcctgatcactgaaagtattatagatttatagagtattgaaaggaaacttaaggaaattgggggc

SEQ ID NO: 3004 - DNA, 300 bp, Homo sapiens
tatctattggcagcaaagactgtttattggtatactacaatatgatttaacttttattttggggataaatagtagaaaaaagtgaaacagaatgaaggcaggtgttttttattctaatgatggaataatacagagatactggacgatctctagcagttaattattgtgacccatataaaattatacaggtcacagtataattctctattaccgtttttacaccagtaagtcttagataaactaagcatgcttatgaattatgtatacagttagaatgcattatttttacagaggaacaat

SEQ ID NO: 3005 - DNA, 300 bp, Homo sapiens
ggttcatgcagtaagatttgttgtttatttgtaaatagaatggtattctatttcaaacttttaagacaaacctgttgccgcaaggctgatgcacattggatgatgactgttttctggttccagatcttgtctttgtgatataggagttatggaatgagccctggacaggatcctaagatccgggtttgttcctacttctactcattaatagcagtttgacatttaatataggaataatgttaacttgtcacttaaaacaagattctcttcatcttgttttcaagatttcaagattctttt

SEQ ID NO: 3006 - DNA, 300 bp, Homo sapiens
gttggccttttctcttcagatgtttacatgcaggaagtgcctttgataaagtatggtttgctaacatgagtatgatatgcatgcgcatttttggatgccaaacacataggcagatgaaactaagaagccagatgctaagatagttgttgatgaattgaaactagcctaactggctccactgttggagtcatttgctcaaactactccaaacttttgtttggtctactgaaaacattagttggaaaggtacagcgttaatttaaggcagggaagcctccagcacgtgagagtcgtgtctct

SEQ ID NO: 3007 - DNA, 300 bp, Homo sapiens
gagagaactagcctggatgagaggtgactgagaataacaactaattttggtgtctgaaaggctgccatggcaagagaatctttgttccatgttattctgtaatgcaggaatgagacaacctcatagaagctcttgagtgacagatttcagcacgattcagggagagcttgattggcaagaatctcagttacttttgtcattagtttcaatctgctgccttgcaaaacccctccaaacgggaaataagctcctcggactgagtttccattattctcctttatccagagggctcgtcggtgg

SEQ ID NO: 3008 - DNA, 300 bp, Homo sapiens
gtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggt

SEQ ID NO: 3009 - DNA, 300 bp, Homo sapiens
gcttaaggctacattaagtggacagactttatatggattctctaattttaatcttcaaaatgctatctaatgtctcattaagacttgcatataatgtatcttaagtacagtcattaaatatagtttagggagatttatgttcagatattgcttaaagatgttttaataggcccatttactctgatgatattaatgagctcttaatacagactaagcttctaaaactagtggtaaagactcccagcctgaacacaacaacttggaattaatgcctggtttggacagatgcctgagggtgag

SEQ ID NO: 3010 - DNA, 300 bp, Homo sapiens
gagaaaagctctcaggtaatctgtatggcttataagggaaacctgcagtcctttctgaaaggggagctgtgaatatgactgctttgtagaaagatgtcttaggattctgggtgaaaatttttaattcccctcatgtaggaatgtcacagagtgtacctttttgacttagtattttcctagtaaaatacacctttcttaagaaaatggctacaaagtcagatgcatgtaaatgctttcagcaagggtttattgatcatctgctttaggctgggctctatgttaggtgcctgtggattccat

SEQ ID NO: 3011 - DNA, 300 bp, Homo sapiens
  misc_feature 229, 245, 246, 254, 259, 290, 292: n = A,T,C or G
cctggagacagtttcagaaaagggatccctaacatcagaagagtttgctaagcttgtgggaatgtctgtcctcctagccaaagaaaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtanaggttgtatgacattnngctaaganattanccccgatcaattgagaatttattggaacttncngtgcaatg

SEQ ID NO: 3012 - DNA, 300 bp, Homo sapiens
atttaatcttccataagatctttcctcagtgtcttttacttcttctcctgccatcagattcttaccttgattgaaaagccatgttaagtgcaaggcaaattctttacgtctttatacagagattaacaatctctgggtgatgggagcgttaagtgatttagctttgtcactagtagatgtgtgaggttagaaaagttgctgtcctttttgggtctcagtccctcagctctgcaattacaggcagtcttcattatttggtacaaattctatgtaaaattgataacacatatccagattaaa

SEQ ID NO: 3013 - DNA, 300 bp, Homo sapiens
aaggaacatttcaaactttgacagattcagaaggaatgatatgatgagcgccatgttcccttcacccatagtgttctgcatttggccagtcctatttcctctgcgcccccagctgggcgatgttaatgtgctcccagctgtcacatcaggccactgatagacgccacagtgtgggatgctactttcaaatgatatgttcttgtttacaagtcagtttcatagtattatgatgttaagagatttcatttcagaggtagctaagtttgaacaccagctctgtctttgaccagctgtttagga

SEQ ID NO: 3014 - DNA, 300 bp, Homo sapiens
gccacatagcaatggagaactgcaggactcaggtccacttgcccagcagctggcagggaagggccatgaggcagtagagtccctacaggccaagaaactgagcagaacccatgcctccagctcaccagctgcattgaagcccccagctggcagggagactgctgtgaatggacagggtgagctcatccccttgaagaacattgagggagaattgtcaagtgctattcacatgaccaaggatgccaccaaggaggctctacatgccaccatggacctcaccaaggaagctgtgtccctgac

SEQ ID NO: 3015 - DNA, 300 bp, Homo sapiens
gccacatagcaatggagaactgcaggactcaggtccacttgcccagcagctggcagccaagggccatgaggcagtagagtccctacaggccaagaaactgagcagaacccatgcctccagctcaccagctgcattgaagcccccagctggcagggagactgctgtgaatggacagggtgagctcatccccttgaagaacattgagggagaattgtcaagtgctattcacatgaccaaggatgccaccaaggaggctctacatgccaccatggacctcaccaaggaagctgtgtccctgac

SEQ ID NO: 3016 - DNA, 300 bp, Homo sapiens
attccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatg

SEQ ID NO: 3017 - DNA, 300 bp, Homo sapiens
attatacagttccccacattgaagttgggaagaagatatatggagagcagttgaagacataaggggctctggggaacagcatagttttgctttaattctccagcttgttctcagtaagggtggaaggagaaagagaggaagtatcgattttacagacgtcacatcgtactgctaagaacagacagaaaacttgttgtaataacccgtacacactgtaggagaactaaggaggcccctggtgtagcaatcattttcccaaggatgacggattgtgaggcaggaaggtgtgaaaagaggcag

SEQ ID NO: 3018 - DNA, 300 bp, Homo sapiens
gttagaagttcaatgtgagtttagtgattcccagggaagacttagggaaccttggtttctgagttgtgctctcctctgactacgtggtgagtcttagtctctggagtcagccagatccagatcttagtctcatggagttagccatgatcattttaaacttataattattaaagtgctatgatgtacaaaggtgcttatgaaactaaaatttgaggaattagatacaatgactatgcggttttgctttttagtaactgtttctcattacttcattgatccaaagtgagatttttaaagcta

SEQ ID NO: 3019 - DNA, 300 bp, Homo sapiens
ctccgttgaacgaagccagttgtgtagggtcagtgccattttctgtcacgatccagcaggggctccacctgcttttgaaaactctccagtggaaacatctactaactctgacctaaatcagtagctgctcaaaatctacagactactggcttaaaaccttggtaagtgcccagggtgtagtgaaagttctcaataaacgccggctggtggcgctgctgctactataagcaacgttaggagagcctgggtcggctgacacctgcaatagaaacctgtacgcaacaagttggatgtcacatc

SEQ ID NO: 3020 - DNA, 300 bp, Homo sapiens
gacactttcattgttgtgccagctggttgaaattaaaactctgatattactttttttgaggatttttatttttggttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatct

SEQ ID NO: 3021 - DNA, 300 bp, Homo sapiens
gacaagcgctggagccgcagccctcagactggcacgggaacgccagcgttgggtgttcagattccacgcgtatgtctgggctcactcacagcatggccgagtgtctgcagtgctggtcctgacccttccagagcagcagtggacagatgagataagactgtttcagaaacaaagatggccacagccttcctaacaagcaggtcatctggccatgtctgtattgtaactggtaaaaggcttcaagtcagattgatgatcaagataagtcaaaaccccagcccaagattgggaaagcaggtg

SEQ ID NO: 3022 - DNA, 300 bp, Homo sapiens
gaagggtaaagtttccatttggggcctctggctcttggaaaagggcagtgtctctaaacccaggcaaacggtaaatgtggggcataggcaagagggtccgggtagtggccacttccccatcatgctcgtttctcattttgtgttttttagtagaaaaacacagtgtgttcttttgcccagacattaatctttagaatgcctgtattttctaatgttgggatttctttcacaaccacccaccttaatatttccattgtgactcagaaaatcagacttcattcgattctttagagaactata

SEQ ID NO: 3023 - DNA, 300 bp, Homo sapiens
gcacgcagcacccactcagcacctcttagaagatgcgtccgtagtatatagtatgatttttcgaaggggattttgctcatattaagggttgctttagggatgtccaggaagggtcaggtaaggaatctttcaatctgctttctaattggcttagttttcccactgtcttcgcaaaaggacaggaatttccaggttagtttgcagcttgtctttcatcaagcgaaatgctcatgctgttgggtagatggtaatagaaaccttttgctacctttatttatcaagagttgtggagccgaggaa

SEQ ID NO: 3024 - DNA, 300 bp, Homo sapiens
aacaaatccatcttgaatgaacggaggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcagcgagtaccaggacctgcgtgacctcagggctgagatccagtattgccagcacctagtggatcagtgtcgccaccgcctg

SEQ ID NO: 3025 - DNA, 300 bp, Homo sapiens
ctgtgatggttccccagctgcggagggaaaacagccttctcctgtggaatgtctttgacttgaacaccccagtccacaccttcgtggggcatgatgatgtggtcctggagttccagtggaggaagcagaaggaaggtgagtgggagaggcctgctgcccactttccttctgagctctggtgacagcggtgccagtcagtgttgccatggagtccagtaaagaagacatagagagagctgggctttaggaaccagagagccagggctgttgccacctttcgtcataggtgagtaaagggac

SEQ ID NO: 3026 - DNA, 300 bp, Homo sapiens
tggaagctctcaggccaaggtgattgacagagatggttttgaagtaatggaatgtataaaaggagaccagtatattgtggacatggccaacaccaagggtcatacagcaatgcttcatactggctcatggcatcccaaaataaagggagaatttatgacttgctcaaatgatgcgactgtgaggacgtgggaagttgaaaatccaaagaagcaaaaaagtgtgtttaaaccacggacgatgcaaggcaaaaaagtcattcccactacgtgcacatatagtagagatggaaacctcatagc

SEQ ID NO: 3027 - DNA, 300 bp, Homo sapiens
gggcatattttaactgtaatcttcaggaatgacttttctcctgaaagtaggaattctctttctgctgttaagtgacagcatgtgctggagacattggagaaattacccagtcatgctaagcagagatctggaggtcatccatggatgcagccagattctttctagagctacaaaactgactttctaaaaagtcagcaacacagcgctgaagaacatttattgctacaccttattttaaaattggattcaatatcatccaatctagtagttctcaatatttctacaaaatagaatcactta

SEQ ID NO: 3028 - DNA, 300 bp, Homo sapiens
aaaaaaacaaaaaaaaaccctgttttcagtgttatgggagagaaatgaacaatgggaaacaaccgaggaaagctggagcaggttacgtataaaaataaagtccattcaccaaaaaaggcattacttacgagttaccaggggtgagagataggatgctgaagtggtctagaaattaagctacccagtatggaagggctgacaattcagtgatcgagagcagtgccttagaacagccaaaacaatagcaaactgagatctgcagaattaactctcctgaaaataacaaggaggtactcattt

SEQ ID NO: 3029 - DNA, 300 bp, Homo sapiens
cccgcatgaactctgctttgttccatgttcacctgactcccaggctagtacttattccagaggagagcctcactgtaactcagctcaccactggcatctcctgcaattgtttacccatgttcctgacccagaatgcctggcagaggcccgggagcccataaagcaggtattcatcttgtctcctgaccagggacacaaaaggcttcttttgtccctttatatcttatagctttttttggttttggtctttgcaaggcgaatcctgccatctcctctgtagattaagtctgtgaatagggg

SEQ ID NO: 3030 - DNA, 300 bp, Homo sapiens
agaaagaaaaagaaaaaagccatatggcatagaaaaaaaaaattctgtctttggaggaaaaaggaaaaaagtcccaggtttgaagccagttgtggcctcttactaggtatattattgagtctttcagctctgtttcaaaatctagaaaatgagttcagtattacctgtttaaatttgtgaataacgcattgatgtacaccctggattccctaaaactgtcttaactgcgtgagtccagtggactcagtgcatgagtctaaatccttagacttctatcagaccttctcccctagcagtttc

SEQ ID NO: 3031 - DNA, 300 bp, Homo sapiens
gatacagaaaagaggccccaacattaagaatttctaaactttattctttttgttatcgtttgtcctctggtagtgatcagtggtcagtctttgaaaagaaaggacctatgaactcaactttagttacagcaaagaaatgagtaggagacggagggaatggccagcagccattgaagagggagagcaggctgggcccaagggggacccagtattggcagaaaggaaagctcagggtgtcaagtgggcctgagaagggatcatctggctgaacaagagaggtccacatgtagctctcagcac

SEQ ID NO: 3032 - DNA, 300 bp, Homo sapiens
ataacctaggtcttagaaggataggaacaacaaacatcatgatcttacacacctgcactttctagcaccagctcctggagaaaaatcgagaggctgaatggtgtctgttaacagattatagtcagtgaggcctctttcctcagatgttgtatcttatcaatggcagacattttcaacctgaaagacacatgctcattacaagacttagtagtgctctaaccctgttttcacttatcagtccaagacgtagccgacatcaaagtattcagcttattacagaattgacttcctcaaagtttc

SEQ ID NO: 3033 - DNA, 300 bp, Homo sapiens
aaactgtttaaattttaaaggggtgtattggtgtatgtcactgaaaattccacaggtacagtgggcttcaggcatggtttgattgggatgccagctccgttttgctgagattccattggttctgctttctaccgtgtttcagcccggtttaggtggcaaaacagtggtggaaatgttaggcttcacatcaccgtaccacatagaccaaaatgagagctaatatccaggatgagaatgaacagctcttctaatcaggctgtcataaaaataaggaagcttattttatagaagcctttacca

SEQ ID NO: 3034 - DNA, 300 bp, Homo sapiens
  misc_feature 284: n = A,T,C or G
attgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaanagaaatcattaatttg

SEQ ID NO: 3035 - DNA, 300 bp, Homo sapiens
ctggaatgggatgactgaggctcccatcgctgtctttatctcagaccttgggtttaagtaactttctgaaaaccacagtcccaccacagcacagaagccagtggggtgacacgaggagcaggcctgggttcccccggttgcctggttccaagaggggcccgtcgtcctgtgctctggggtggccttgggattaggagagcccagctaaacaaccttcccatcaggctcctggtcacagcacgaggctttaacgtcagccgagcctggcaaagaaagtgtcatattatggggctttaggat

SEQ ID NO: 3036 - DNA, 300 bp, Homo sapiens
cttccaccaggtactgagtagatagatgcaggcccccagaggaagctggaggctggagatcatgaacaagctcatttcccataggaggtggggagggcagcctgaaggttactctgcagttctcttcggcagaatcggaagcagcaggctggcatttgtgcatgagctaagtgaggacaaggagtctaggttttcagccactgcacacaggctctgtggcctgcgaccggtcctatcctgcttgatgaactaccaggagtgagagctgctttctgttttggtagtgggttcctcacattt

SEQ ID NO: 3037 - DNA, 300 bp, Homo sapiens
ggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccagctctccccgagggctctgtgccctggaccgcacctcaaggttgaccagccggccacaggcctcagagctcagctgggccccacttgctggccacaagg

SEQ ID NO: 3038 - DNA, 300 bp, Homo sapiens
ggaaaaggcatttatgtcttggtagaacccatgtttgggcaagtaaccgggacttgggcggcatgagctccagggctgtgaaccagagtcataccctggcaacagccatcaacactgaagaggacctggggccttgcagcagagcttgtggctgcggtggccattttagatgatgtcattcagctccctggccatgccctgcttcccacccacctcacattggtggctgctcttttttctttgactagaatcaaaccaaacaaggctctataaataaccctcagggatcttcaaaaagat

SEQ ID NO: 3039 - DNA, 300 bp, Homo sapiens
ataacttctaaggaaacaaaccaccctcacatgcactatctcatttgtatttctgtcaattctgaaaggccagcatttggccagtattatttgaatctgtattgtattttttaaccagaagaatgaaggtttatagcttcattcttttggaagaggaggctggagaccacaggttaaatgcaggtgcatcgctcttggccggccctggaagggtcctttctccctccttttacactcgcagacaagcttgtggatgctcaataaggacagctgccgtttggacagagattaatcatttat

SEQ ID NO: 3040 - DNA, 300 bp, Homo sapiens
ctcctatgccccaaccattgggtcatgggatcccagcatccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggac

SEQ ID NO: 3041 - DNA, 300 bp, Homo sapiens
gtgagccactgcgcccggccaaagacactttcaaatactcatgattggatatgcctctgtgattgacagtgagatttcaaatgggttaaagattgctctgcaaagaggttaactgttgagattgatacaggctatcttcaacatatgtacattgctgtatatgacatttacctaccattgtgcatctgggacttcctgatggaccacaggaattcccttttcttcccattctcttccagatctttcttctacttgaaaccccttatctacaaaaatgaataaacaacccaatctcatttc

SEQ ID NO: 3042 - DNA, 300 bp, Homo sapiens
ggtgtgcggctgtaatttgagctattcgggaggctgaggcaggagaatcacttgaacccaggagacgaaggttgcagtgacccgagatcgtaccactgcactccatcctgagtgacagagcgaaactccatcttgggggaggaaaaaaaagaaagtaatagggaggcaaatcagaatttgtgtgggagtaccccctagttctggctcttgttagtatactcaacctgtcaggctattctgagagcgaaagctcctgctttgggctagtttccattcagaatggtttttgataggtatgaa

SEQ ID NO: 3043 - DNA, 300 bp, Homo sapiens
  misc_feature 294: n = A,T,C or G
gccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggcttttgttttgttttgatttgtttttggagttggagtctcgccctgtcacacaggctggagtgcagcggtgcaatcttggctcactgcaacctccgtcacctgggctggagcaattcccctgcctcagcctnccaagt

SEQ ID NO: 3044 - DNA, 300 bp, Homo sapiens
ttttaccctcctataatgcattttctttggatattctcctagattctcagggatatttccatattttactattcatgagtttagaagagtgtttactttcctgagttttcatttccttctttttcttctgtcataggtaatttacagagcaaatagccaccagagaggataccgtaagggatgtggaaaatgagttcctttgcgcttatccagtgaggttgattttcagtcaatgagcattcagtatatgcctgggactctggctttattttttagctttgtgatgccaaacccatcaat

SEQ ID NO: 3045 - DNA, 300 bp, Homo sapiens
aattccgttgctgtcgcaaaaacaggggcccacagaagaacctgaaaaagcagatcgggggaggagagctgcaatgatctaaaaatatgtatatgagcactggtgtccaaggctgtggaagatccaatatggagatacagaaaagggcacggagcttggcaaagagaggtgattgacttttgaagaacagaagccaggctaggatgggcgaagcatgaatgaatggatgatgaggagcagggcccaccctgggctaaattgcaaagcagtgcatgtggaggcccccttttcccttgtggc

SEQ ID NO: 3046 - DNA, 300 bp, Homo sapiens
acattgtttaaggggaaagctgctgtgagaatattgacagtaggcataaacagtgatatattttactcacaggtattttgggggttgctttcattttcttcagatcagtgccacttctgtgctaacggtaagagatagatagacagataggcaatgaagtgttcacttaattaccttggtttttagtttactaattattacattcatcgtttttgtgatcacaaaaacacaaagaaggaggtctgcctggatgggattacaaagatttagccagtttcttggtatataacagaaggtacc

SEQ ID NO: 3047 - DNA, 300 bp, Homo sapiens
gtggctgttaagaaaacaatggtaatttcttttaaggtgatcatttcatgttcctatggtatggatgcatgtagaccttttaagaacagttaatgaagtttaatctgcttatgtggaggagaaggtatgatggaaaggcttctggcatgcaacgggagccgccctgctttcccccgatgtgtctattaggacatttctgtgacactgcctggcgtctgcaacctgctacgttgctcactgatggaaggaagaggcctggccgtggtagtggaaagctgagctctgttgtgatatgagagt

SEQ ID NO: 3048 - DNA, 300 bp, Homo sapiens
gcaacaaaagcatacaagatctcataaaggaagtggaggagctgcagggacgaccgggagctttcccagtaagcatcagttcagaaacaaatttaagtaaagaaatggaatctgtaatgaaagatataaaaaataccactcagaagaaatatagagactatagcaagaccccgggctcaccagacaatgattttctctttatgtactctgttgctagaaccaatttagaacttgaattgattcatcgaggaggcaatttgtgttcaggtggtgcaagcacagctggcaaaaggtcttgtt

SEQ ID NO: 3049 - DNA, 300 bp, Homo sapiens
acggagaggaagaattctttgatgccgtcacaggctttgattctgataactcttctggggaattttcagaggcaaatcagaaagtcacgggaatgattgacttagacaccagcaaaaataataggattgggaaaactggggagaggccctctcaagagaacggaattcagaaacacaggacatcgctgccggctcccatgttcagcagaagcgacttcagcgtgtggaccatcctgaagaagtgtgttggcctggagctgtccaagatcacgatgccaatcgccttcaacgagcctctga

SEQ ID NO: 3050 - DNA, 300 bp, Homo sapiens
ctctcatgtggcagaaaaatgatttccaatattcagcactcacctctctccccaagaaaaacatgtcaaatgcaagactgtgtgctcttaatgacatctatattaagggatctgaattttccatcataaatgaacatggtagcttaccaaatatcttctgataagtcattcagtgctcaggttctatgttttttctcctgtagaagagtgaagaaactacacatcaccaaaatattgtaaggctaagtaataataacggtgactgggaaaatgggaaatgagatagcgtcaaacgtttgt

SEQ ID NO: 3051 - DNA, 300 bp, Homo sapiens
ctgagatgctgacaaccactgcaggcaccatgaatttttaatgtggtggtgattagaaggctggctagggcctcatttcgtttcattggactgctgtgacacttgtttccttcatggtatttagacttcctgggttatttcccaatccagactcatgttctgtttcatgagtgcccattgcacccatgcacttattgaggtgtgtttgaaagcagaatttaaaaatttgatctcagttattgaacatcctacgctatttcagaaagggatgcttcttaaattcctgaaaaggaattcaat

SEQ ID NO: 3052 - DNA, 300 bp, Homo sapiens
ccccttttcactttgccagttggacttatgtctttattggtcattcaagtggggcaaaggaaatatccttttaaaactcaggcaaactgggtgtttgtctgtatcctgtcagaggaaacaaattgaaatagatttactggaaagtcttacacagttagttactaagcggtttgtttgttttgtttcgagacggagtcttgctctgtcgccctggctggagtgcagtggtgggatctctgctctctgcaagctccacctcctgggttcacgccattctcctgcctcagcctctggggtagc

SEQ ID NO: 3053 - DNA, 300 bp, Homo sapiens
gaaaagaaaaaaaaagaatttaaaattctgttttagtggagtcatttgaacttaagtctaagtttataacaacactggcttccacagcacaggaggtgagcatgtgttaatatttaagattggcataactccctttaggtgcaagtgttcaggccaaaatgttcctgaggcattttgattcctcctcctgctgcccatctataccaagcccagaaactgtctggaatatattttagtttcctgaatgacaccaagaagtagaacagtcttttcaaaaatgtattttaaaaataagctgaa

SEQ ID NO: 3054 - DNA, 300 bp, Homo sapiens
gcctcccgaccccccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacag

SEQ ID NO: 3055 - DNA, 300 bp, Homo sapiens
tgcttgcagagcatttgccaggacttagggatatagtggtagcagaaggcagataaagttccagttcactcacaggagttcatattctgatggaggagacagaaaataagctatagcatatctgtgctttgtgaatttgtcattgctgcctattcccgttgccttttttttacatctgtatttctgtcatctctgtcctacctggctcatcagggaggtgcagaaggctgaagaaagcaaagtccctgaggactcactggaggaatgtgccatcacttgttcaaatagccacggcccttg

SEQ ID NO: 3056 - DNA, 300 bp, Homo sapiens
cctagtagtaccctgacctccaggagcccctgagctctgggaaagcctttctgatgatctcaagcttgcagattctgtccctgttctgaccgggggtcacagcctagtggtagaacaggacctcctgctaagatgctggaaggaccctttgggggagctgaggcctggctcccctctccccaggcgcaggtgcacaggcgtgtgggctgtctgcaagcacagatcctgcctcacagcaccattaccacaataactgaatctgtgtttcctggctgctgttaattgtgctagagatttggg

SEQ ID NO: 3057 - DNA, 300 bp, Homo sapiens
atgagcccatgaacttccccagaaactcattgtcttctatttccgtaacagctcctaaccactagtcgggctttgcacacagcgacttctccgtaaatgttgactgcagggcagaaagaaaggctaaaagttcttaggagaatgtttgcctttgcatgtatatgctggcgatgctaataagtcccagctagacctggcagtgagtaagttcaggggtggcaatttaattttcttgctattagtaaaacaaacagtaggtgggatgggtggtaagcttaaatatctctgacgcgccattta

SEQ ID NO: 3058 - DNA, 300 bp, Homo sapiens
atgaatgtggaacttttatttttatccattattttcaaattggatcaatgtcctcctgatctattagatctaagacctaagaggaacctaccttgttttggctagcgggtacagactttcttactaaaaggtgggtgtatttcctagaatagcattttctgttgagtagagatgattttcagcaatgtggctggtcacttagcttcaaagtaattattgagtgtgaaagtaagcagttgtaatactttttaaccactgtctgtgttcttaccaaatggaaaacaacactcgtcttgaaac

SEQ ID NO: 3059 - DNA, 300 bp, Homo sapiens
gggatggaccacacagtctcttggaatgttgacctgtggcagtgacgaaagaagagactctcccggccgaggccccagtgcatggagagaaggaagaaatcaatttcctaattggtaccatatacatcagatggatggtttctagtgtgcttccaaaccccacctcggctgagtgttgggcagcacttctacatgatcctatgactcttgatatggacgcagtcctgtcagactttgttcggtccacgggggcagaacctggtctggccagagacctgctggaagcaatgttcacagcat

SEQ ID NO: 3060 - DNA, 300 bp, Homo sapiens
gcattaggcagtgttgcaagtacatatcggaatctctttggctggctctaagaaagagtttgaacttatttacctccttagccctatgtaacaggtaagaaactaaaaggtacagaaaatagagatgtttgatttttctaagttgccccaagctaccgtttttaaaaacgcctgcaagcatgtctaaaacaggagcctgttagctacagttgccaaaccggtttaacagcactgcctccatgtattctgggtaagaaggagctccgagtacataaatttatcaaagatcactatcccaat

SEQ ID NO: 3061 - DNA, 300 bp, Homo sapiens
ctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtc

SEQ ID NO: 3062 - DNA, 300 bp, Homo sapiens
gaaaaagagatgggtcagggaggaaagccaagatggaaaatggatgggaatgaatgaggaacatgatgtgggttggggtgtcaattcatggttaatacaacatgtgtggctcagtataaccagattgtcataagaagctcaggcagctctccccctctgttgcctggggcttttcgcagttacaataaaagtggaaagatgaagaataagggcaagcagaagacacacacatttgcctgtttccctctttttgtccagattgagtagatgggaggcagggctgttacccatgatggtgtt

SEQ ID NO: 3063 - DNA, 300 bp, Homo sapiens
gcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctgga

SEQ ID NO: 3064 - DNA, 300 bp, Homo sapiens
ctcatgaagacacccatgcaagtggtggtgagaaagaggactcccccataccttgctccagcacggaccttgctccagcaccggccctgctcagccagattttcagaacgagagggatattcttatctgtggcaaagaatattctctatattctgtatacatcatttgagacttaaatgggtttcaacagatccattctttttgtagatgtaggaaagtttgacatatgattgttctttgccaaatagccacgttcgcgggattccttttgatggaaattatttattaggacttaaaaaa

SEQ ID NO: 3065 - DNA, 300 bp, Homo sapiens
actggcattctgctgttctcaggaggctccgctttgatggatggctgggcagcctgtgctgcatggaccaccagtggttgttgaggtggtgaagtgtgtccccgttaactccactctgggcagtgaactgaagagggagcaaagcccaggaaatgggccttcgtggcagtggtggaggtagagtgacccacagcaaacctccccacttgtccctgaccattcagtagttccagaggcagtgagcttggaatcttagcaagagagatcttggggtggggtgtggactttccacaaaggcat

SEQ ID NO: 3066 - DNA, 300 bp, Homo sapiens
ctagatttcggtatcattccctatcctttcaactctgttattctataaacatgagctggagattgtgtctctgtctttccctctgtcagtgcagccagcttattaaggccctaggtgagctcccagctttcattgttatcactgactaaaacccttgcctgttgatatttgctgagtgtggaagaatttaagctaatgaggaaggagttcaccaaattttacaaggtctaaaaacagttagaatataaacaagtgatcccaaggaaggaacaggatatggtttattcagctagtctcaaa

SEQ ID NO: 3067 - DNA, 300 bp, Homo sapiens
agaagatgaccgagagactcttgtcagccaatgcagggacacactctgtgttaccaagaactggctgtctgcagatactaaagaagagcgggatctctggatgcaaaaactcaatcaagttcttggtgatattcgcctctggcaacctgatgcttgctacaaacctattggaaagccttaaaccgggaaatttccatgctatctagaggtttttgatgtcatcttaagaaacacacttaagagcatcagatttactgattgcattgtatgctttaagtacgaaagggtttgtgccaatat

SEQ ID NO: 3068 - DNA, 300 bp, Homo sapiens
ctgatgtattagctattttcatatgttttctaacatacttaatatccttacaggcattatgtggattcagggtaaacttctcagactgtgagcctgagagttcctctctaggaggctccacaccattctgcctgctagatcggggccagatgagatgaaagtcaacgcttgagaaagaaaaccaacatgcattaactgaaacaccgtcttcacttgttcatccacagggtatagagcgagttccaagaaccaggctaggaaatgacacgctaagtttcctatttctagcagctgccaagg

SEQ ID NO: 3069 - DNA, 300 bp, Homo sapiens
ctggaaatgtggagtgggtggtgatggcagtatcattggtggcaatgctttgtctgcaattaagccaggaatcaggaaggaactgcagatttcttagaaagttgtagtgctctatgagggcacttagccagttgttttgaccgactaggcagataatcacactgagctgatacaatcgtggtgctaaagtatcataattattaaaatattagtcctatgtgttctcaacacatgtaaaggaagagtgaccagattgatcttaatcagaaatgtccagttacatgtcggccgacagcattg

SEQ ID NO: 3070 - DNA, 300 bp, Homo sapiens
ctcagccccccagtttttatgtggacatgttttcatctctcttggatatatacctaggagtggaattgcttggttgtgtggcaattctatgtttagcattcgaagaaattcattgaatggtaagctgaaaagtgacgtggttgaatttctgatttcagaaagatcactgatgtgatgagaatgaataactctctggagtgctaggatgtgggggcagggagctagcttagtatattattgcaaaatcttgccaaagatgagctgatcaaatgagaggaagcatgaactaagaggggagca

SEQ ID NO: 3071 - DNA, 300 bp, Homo sapiens
ggatagtgttaactttccttaaaaagcacttttgataattcaggaggtataaataggctgcttatttaaaaaccttcacttggttaactttagaaactcaagaattataaactcaaatttatacttcttgatacacaaacttaagaactaaagctatcttctgactcttctatttgaaaaggtactaacacttctttccgtcagtctctcattcttcatttttgttggtatcctgtggaatttttgtctagtctagtaaaattaaattattatcactttaatgttttgtagctctttttt

SEQ ID NO: 3072 - DNA, 300 bp, Homo sapiens
tagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcaggtatgact

SEQ ID NO: 3073 - DNA, 300 bp, Homo sapiens
ggacaacatggcctttgtggaaatggaggccttggagcccagagaggggcaggactagctcagggtcacacagcagggactcaggaaaaagaacaagatgagctgagtgctatggtgtgcaggcgcacggctcagtccacaggatcccgtgctgccccaggtgctctcacctccttaggcctgcctgggtcatgggtggggtggtcaataagatctttccttggctccagtctctgcctccagcctccttgactagcccacctgcttacctttgggtggatcccagaaacctacggtctc

SEQ ID NO: 3074 - DNA, 300 bp, Homo sapiens
cattagtgtaagtgcaggtaattgcttcattaggacatatgtattgaaggagggagggcaagtctatagcatggtgataaaaacaggcctcaccctctttctctacccacacaggagcatctcagcttgacttcagggatccaggagccaccagccaccctgtaaacagcccagattaatcctgggtttcagtgtcatgggaggaaggaaggatgacctagtaaagagcaacttacttactttctttggggtggtaactcattgctgaactctggatggcactggtgcgttcaaggcaat

SEQ ID NO: 3075 - DNA, 300 bp, Homo sapiens
cgtagaaacaccccaatttcaaagctaatttatctgttgtttttaatcacgagtcctctccttctgcactatcaagtgtcttctacttcctgcttaagtctctgttgtccatttcattaagacagaagtttctattattgttaaatttgaactgtatctatgttataatagtaatggtaactcaatccaaaggacctaataacaggaagtaacatgtcttacatatcagtttatatttgtttttttgtagggacatactgtgatcttggtatacttgtaattttttagtttcctggtcgg

SEQ ID NO: 3076 - DNA, 300 bp, Homo sapiens
aggaggtgtttgatttaaaaggaaacacaccagttatgccttcttgtaggggcatgtgagccagtagagtttgcagctgcatggagagatgaagcaaaactctgaacattcaactgcattaaaaaaaaatcatgccaagagggcctttgagcaagaaattcttgcagatttatgacacccgatgcctgaactctgtgtgtgacatcagggttatggctctgtaagctcttaaccctgcagctgacccagtcagcttctggctgtactaggggttgatgcggttcactgtggttgtttgta

SEQ ID NO: 3077 - DNA, 300 bp, Homo sapiens
gaactagtcatgccaggtactaaatcaaagggggcagtgaggatctggtgcagaaacaacctgatcaatgggacaggacagggagtctcaaaatagccataactgcatataaacatctagtatatggttaccacagtattcaattcaagggggcaaaatagagactttttaataaatggtgttggaataaattatagttatttgttcaaagagttataattttatgcattccttacaccatgcactagatgatcctccaaatggattagactgaaatggaaagaaaaaaagggtgaattc

SEQ ID NO: 3078 - DNA, 300 bp, Homo sapiens
ggaaaacggaaaaaactcaagagtgaaaactaagtggtgtgtgaaaatgtcattgtgcctgggtggttgaagtcattaaagtcagagagccaaaaatacctaacagagtggagcgaaaaaagagccggacagaacagtgagaataatatatcactgatgtaaaaacaactcatatgatgcttgtaaatgtggaaactataactatccctggaggggtatagagatgagttcaattaggagggaaactgagtgacaggaggacaaaattggaagggagatttttactgtataactttgtat

SEQ ID NO: 3079 - DNA, 300 bp, Homo sapiens
gagaagcagagggacaaggtgtcatccaagtgacctacctgcctcagcctcccaaaattctcggactacaggcatgagccactgtgcccggcctgttattgttgtgttgtcctgcttttatggtgcttctttttctttatttgtaatagtttcccctcccactcccactgttttcttaacatggagaaactttttttttaattgttcccagtgaatgctgtctcttcccatgttgactccattcacttgccatgaattgacttagtgccagacctctgtgccttcttcatgtaaccagct

SEQ ID NO: 3080 - DNA, 300 bp, Homo sapiens
cccgccacagtggcctgtttctttccttgctgctcctgcagcacagccctgactcgggggctttgcgtgtcccctcagcgctgcagggcccactccttcctctgtcctggtctctgcttagccagcgcacggtcagggaggcatgggtggccagcccgcaaggagccaggcctcccagcaccccttcccttgtgtggcctcctcccacatgggatctcagccggtcctggcttcaactaaacaggacgtggcaggcgtgatgccctgccaattccaggcctaagccttgacacagcctgg

SEQ ID NO: 3081 - DNA, 300 bp, Homo sapiens
ccaggactcaaaagcagaagcaccagcctgagttggcgaagaagccaccgagtagacagaaggagcttttgaaaaggaagctggaacagcaggagaaaggaaaaggacatacattccctgggaaaggccccggtgaggtgctgcctcccggggacagagccgcagccaacagcagccacgggaaggatgtgtccagaccgcctcatgccaggaaaactgggggcagctcccccgagaccaagtatgaccagccccctaagtgtgacatctcaggcaaggaggccatctctgccctgtccc

SEQ ID NO: 3082 - DNA, 300 bp, Homo sapiens
ctgagtgagcctgatagagatagaatacagcttcttctttcctggcttctctgtactatagacaaattcttactttatctgaatttagaagtccttaaaatttcattcaaattcaatttgtagggcattgaattagtggcatttttctctgataggttttctgtatcttatgagaaattttactatacaatcctcgtatgttcatagggagaactgatctgctttcactaaatccagagtatgccagaagatctgaccataagatacttaatttctggtaaaattgaaagtttttttgtt

SEQ ID NO: 3083 - DNA, 300 bp, Homo sapiens
caaaaaaaaggcttttccctgatttccagaatgtactgggtggtgtccatctggtcttggatggtgtaagcataaggatttattgaatgaagtatgaagtgtggtttttatttgaagtcaaatatttggcagttggtgttcatttattctataaactttcaaaacagatgacaagttttaaggaaatggggcctaataccaaatttggttgaattaatgaattccaagattctttctagctttttctttttaaagacagggtctcactctgttgcccaggctggagtccaatggtgcaat

SEQ ID NO: 3084 - DNA, 300 bp, Homo sapiens
cagacttgagccactgtgcccaaccggtatttaaatatttgaaggattcatggttaaacttgatttccatccaaggtaaaattctagaatggattattaaaaggatcttaaccaaatagacttggaaacataatcagggcatgtgcacggtcctgtcttggagtaaagaaaactatttgtacagaagagtagagacctaatttagcattttccggcaatttgacattgctctagaagtttatgagagagaaatgcagattatgaaattatttaaaaatatacctcagaggagcagggaat

SEQ ID NO: 3085 - DNA, 300 bp, Homo sapiens
gcccaggccaggcccagcagagactggagcagaccagctcgtccctggcagctgcactgagagccgcagagaagagcattggcaccaaggagcaagagggcacccccagcgcctccaccaagcacattctggatgacatcagcaccatgttcgacgccctggctgaccagctggacgccatgctggactgagccctccagcagtgcccactgtgacctgccgaagtccactgcctttgccccagcacagaagaggcccctgccaccctagggacgggccaagggctggtcaggctgaagt

SEQ ID NO: 3086 - DNA, 300 bp, Homo sapiens
accacacctggctcatttatttttattttgtctagagacagtgtctcactatgttacctgggctggtcttgaactcctggcccctaatgatctgtctatctcaatcacccaaagtgttgggattacagatatgagccactgtgcctggcctatttctgactttttttctttttgtatataagaatatatatttcgagacaaattgtggattataaatggatgcttatttatctcgactgcctttcagacctttttcccccagccaaccagtttttttcttctcaaagaagacacaggtga

SEQ ID NO: 3087 - DNA, 300 bp, Homo sapiens
atttcaacatactgttgtctaatcatcgtgactcccccaatttctcttttttagaggaaagtattgtacagatgtatcttgaagattataatcttggttgattattgcctattctcactttaggaatagatggtgatagcttatgacttgtgttgtataacgaggtagaaatattgctgtcttctctgacatagcttctcaaagagatcattaatgtatgatatctaataaaccatctaatgcatgtaacagtgatcagcaaattaataaattagacctctattcatgcttaaattatca

SEQ ID NO: 3088 - DNA, 300 bp, Homo sapiens
acactgttctaaaggtgttgtgtgaattttcttttttatttattaccacaatactgtgaacaaatacaaatatctttccagttagtgcattccctcaaattgaacttctggctgcaaggaaagctaggaatgattatggttttgttagtaaggaaaattatcaaaatggatattaggttggctactagcagtcttggcctcatgctttcagtaaatagtgtgcacttcagatcatgtggcattggagaaaggaagaacatgttaataatataacatggttaggtcatggagtcttgatta

SEQ ID NO: 3089 - DNA, 300 bp, Homo sapiens
gtgaaaggagatgaggaacagtaagagatgaggtcagaaaatgtgttttaccaaactctttggagattagcgtctggggaataaagaatgagctggaggtcttaaatgtctcgtgactgggacaaaaacagtggttgagaacatgatgggatttttccacatggttgttaggaaagttgctatatttgagactgtgaatgtcagcaaagctgaggaacaggaggtcttccatggagtacacagtgccctagagcatcgtcctttgaaacccgtttccttttatatccgtccatagaggcc

SEQ ID NO: 3090 - DNA, 300 bp, Homo sapiens
gggttgtaaagcatcattgagataatatcttagatattattgggtaatattttgttttataacagtgattcagtatatctgaattatggattatatggccatagaactacaagcaaaaaggatacacaaacaaattttgtagttaagacaaatctgttgcactaagatcaagaaatgtaatagatggaggccatgtagaggttagaaattcaaagaaatcgaggtcaaaaactggccaatcataacggcatagggattagttcctaaatttggtcacttgagaataacagtgtgaataga

SEQ ID NO: 3091 - DNA, 300 bp, Homo sapiens
gggtgcttctgtatatcctgacaacagtggccagccattaaagagttttgagtaggggaactggatttgtggttttagaaagatcatttggcttctgtgtgaaagaggccaaaaccaggagcagaaagaccagttaggaagctgtgacagcagttgagagacgatgttgtcaaagtctgcagcagaacagaacaggggtgaccccacatggacatcatctctgctcttcagtcacctgtagtgcagagttttgaagtaggtctgagcatggaaccgtagtggttgggaaggaaatgccat

SEQ ID NO: 3092 - DNA, 300 bp, Homo sapiens
gaaatccctctcctgaccacttgtcagaatcagaaagtgaggaagaagaaaatattagttacctaaatgagagttctggggaagagtgggattcctctgaagaagaggactctatggtgcccaacttatcgcctcttgagagtcttgcctggcaggttaagtgccttttaaaatattccacaacttggaaacctttaaatcctaattcctggatgtatcatgctaaactgttggatccaagcacaccagtccatatacttcgagagataggtctaagactctcccattgttcccattgtg

SEQ ID NO: 3093 - DNA, 300 bp, Homo sapiens
aaaaccagtactcagaatgagaaagagaaggagaaagcaaatatagtaaaaatggacatttggaatatctgggtgaaaggttcttgtatcttttctgtaagtctaaaattatgccaagataagtaaaaacaaaacacctattttctttttacagttcttcctatttttcatggatttctgaaaaggcagagactagaagaaacttgtttagctatctcattctgctcatttaggggctctacttttaaaattaagatggtaaaaggaaagcattttacccataagtaaaagaatgcttcc

SEQ ID NO: 3094 - DNA, 300 bp, Homo sapiens
acttgatttggtaatgaaagacaaatagctttcataacatgaacatacaaaaatagatgctttgctgttgttcagttttctcaagacttactgttttaagcttgtaaaattaatgaacagtaaaatagcagaaaatagtgatacattggatgattttaatagttttattagtgagatatttgaggtattcgaattactacaattctttccaatcctacaagttaaaaattttgttatggttgctgacttttaaatgctgtttattctctgaaggcagttttatgatgcatttagaaaaaa

SEQ ID NO: 3095 - DNA, 300 bp, Homo sapiens
gttaggtgtagctctaactgggagttccatttaggcccagttttggcaggaatactttgtaggtgatgccgtgtacatcccactgtattgccttgaaggcacaggtatgagaaggcacaggtgtccggtcattccactttcagcctgtgattgaccagtgggggcagggctgtgtgagtctccactttatagcgcccatcagactcccctctcatggttgtagcatccattgctcatagttgctagagccatgatttcattaaaggttgtcaagtgatgactgtctaatttccatttatt

SEQ ID NO: 3096 - DNA, 300 bp, Homo sapiens
atagtaaattagtcatagaaaggcaaactcaaataactttgaacacagctctttgactatccacctgtgtgtaaacaaacaaaactacaaagaaattttgtacttcacttagttggtagtgatctggtatagcaattctgaaaatattttctgtgtattgtaggattaaacaaataagtaaatataatgatattcttgggagctgggatcctcactatgagagaagaaagataaaaatatggagtgaaggaaggcaaagaagagctccatgaattggaatgagagattccacagattact

SEQ ID NO: 3097 - DNA, 296 bp, Homo sapiens
  misc_feature 253, 262, 288: n = A,T,C or G
ctgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtangtggaagancaagagtcccttccagtccatggggnaaagccct

SEQ ID NO: 3098 - DNA, 300 bp, Homo sapiens
agattaaattgaatatgtataatctttgttaggcaactgatgactatacttatttcacaactggtaatgtgaattattattgcataaactatagtgctgaggccccagtctttacacttccatttaataacttcacagtttcatatcttcttgagatacttactaatttcaagtcccatcttggtcacaaggagttgtgaattagagaacaattaatatcaccagttaaagaagttagattagaaatctgaaccatcctaaacataagaagtacctgcatcttcagagtcttatcccaaa

SEQ ID NO: 3099 - DNA, 300 bp, Homo sapiens
gatcacaccactccactccagcctgggcaacgaagtgagaccctgtgtcaaaagaaaagaaaaagagaaaagaaaagaaatctgaaggtctgacaacccttggtccccatcctcctatgacttggacctaagtcagagctgccctcttgtaacagggtgtggcccctctatttcactgtagtctgcttcattccctgcagcctccttgatacgaagatgcagtgacaggccaggcactgtggctcatgcctgtaatcccaaggaggccgaggcgggcagattgcctgagttcacgagttc

SEQ ID NO: 3100 - DNA, 300 bp, Homo sapiens
attgcttctgttttaatggtaatttgtctaattgtaaaaataccgaagtagtgattccaagttagaaagtagtgatccctaagaacagttggagaaacatatggtttgttctatagctgtaagcggtaattttgaagcaattttgaaagcattctttccctttaagaaaaaaatagtttcttactgaaatgactttttaggatgtcttgaaaaacgtagtgaaattcatctagaaacttacaaggttgatgctagccatcacatgcatgctgcaatttgctgaaatgtcttgatccaggg

SEQ ID NO: 3101 - DNA, 300 bp, Homo sapiens
ctgaattccaacctgggtgacagagtgaggccctgtctcaaaaagagaactctcgatgtcactggctttccatgtaagcagagcacatcatgtgagccccattcgtggatgtcagtcagcagaacagaatcttggacctggagcttgtttgtcctgtgctagaggttggaggtgtctctgtctttctgttggttcctgtcagttcaggtcacttagagattctgttacatacaccagctctgacaggttgggggagatgatcaaccttccgcctgcgcctgttcccttccctgactcatg

SEQ ID NO: 3102 - DNA, 300 bp, Homo sapiens
gatagctcaagatttttttttggtttattttgttttttaaaagtaagcttgtgccggttggggaagaggaagtgaagttcctttttgatggtgttgagtttgagatgtccagtaggcagttagaaatctgggagggccgttgagctcattagtctagttttgggaaacgtgtgtgggtaaggtaggggttgaggatatcacccagggtgacaccagcctttcaggggcagaagggaaccccaccaaggcgactgaggagtgagcggatagtttcaatttcaaggagggggaaagaggagc

SEQ ID NO: 3103 - DNA, 239 bp, Homo sapiens
ctttcatggtatgtccataggtgtaaaatgatggccttaatgcttataataataaggtaggtttttgtatgtctaatatacagagaaatttccaaagactttttaatctttgcttagcataaggagtttagtcagtaactattacaaggaaaaaatgatcagttttcatttgtcagttctataagccccaggcaagtttctttcggttttgactttctattaattaaccatatcctaag

SEQ ID NO: 3104 - DNA, 300 bp, Homo sapiens
acacattcttccatttgtcagtaagagtaataatttgactgttttattggattttagcctttttgatttcatatagctgtatcttaatatatcattgtttttaatatgtctacattgaatacttattacttgtgcaatgaaaaataataattaaagatgaaagttaagcctgttaccactttcagagaacaacgtgacgttttggaatttaaaattttttcagtagatttgagaaaaacttgggttaaaatgaagatttatgctcagaactgagattccagggtttaagtctggttttaa

SEQ ID NO: 3105 - DNA, 300 bp, Homo sapiens
atgcctagtggtctctgagtgtaagattcttgaacctgctgatttgcatttcacctgtagttctacagtaaaaaatgattttatataacttttggtatataagtctcaaaaagtgtgagtcagaagagatgaaacattatatttaaaatttcatatcaaagcttctaatacaacgttgctagagccatggcttggaaataaatcaggaaaaaaccctcaaatacagaatcagttgtgttaatgcactagaacttgccttctgctttaaagccataattaatcatttaaatgctggataaa

SEQ ID NO: 3106 - DNA, 300 bp, Homo sapiens
gagcagcagctgcacgcccaggctgcggagcacctggaggcacaggcccagaactcccagctgtggcgggcgcacgaggcgctgcgaacgcagctggagggggcgcaggagcagatccgcaggctggagagcgaagcacgaggccgccaggagcaaacccaacgagacgtggtcgccgtctccaggaacatgcagaaagagaaagtcagcctgctacggcaactggagctgctcagggagctgaatacacggctgcgggatgacagggacgcctgcgaggccaggcgggcgggcagcagc

SEQ ID NO: 3107 - DNA, 300 bp, Homo sapiens
acttttacagcagaatttaagagcccaccttccagagcctgatgcagcttgtctgtctgatgcttttgttccccatccacgtcccccccagtgctgaagctgtttcgtgtgtccttacagtgtttcctctgcacttccacttgtggttgataagtggcagggggacaataaatagagttgatgaaagatgggcttgggcagcagtgggcccaagtgaggcagaaatgagaaaaggactcctggggcagaggtggagtgacaaagccttgagcacgagggtgtgaaatgtgaacttggtgc

SEQ ID NO: 3108 - DNA, 300 bp, Homo sapiens
gttacctggggggccgctgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggca

SEQ ID NO: 3109 - DNA, 300 bp, Homo sapiens
ccagaaagtgcctttacatttttgtcttggaacaactctgcaatttcatcttgatttaatatttctagtaataaagcatcttccgactccacattcttatctctgggcagacattttattcttaagaattgtagtgattgataagaagctaaatggagatgattaacgtgtcaatgattaataattataacaacattcaaacacttagaaattatagtatttcatcagatgtctttttaaagaggcatttctggccagttgtggtggctgacctttgggaggctgagacggctggatcac

SEQ ID NO: 3110 - DNA, 300 bp, Homo sapiens
gttaacttctctgagagagttccttgtaaggctacttataaatagtagtatatatatatatagtttatggcagggaagatctgggaagtaagcaaaaagagcctttagttaggcaacatagaacaaaatagaggtcacaggttccatgcactgaagaatggaattgaaatagagactccagggtcatagactcttggaaggaagactagagtacattcatgaccctcacccttaattacttcacaggtgagaaaaccaagagctacagaaaataagttattcctcagctccagggctacc

SEQ ID NO: 3111 - DNA, 300 bp, Homo sapiens
gagaaactgcattttgggggggtttgaaatccaaagaatgcagtttgtaggcagtcgagatccttgaaaaatcaagatggattttaataatgtattaagaataaattggatttgaatcaacacaggaaacagggattttacttagagactatttcagtaattttgaaatcattgcccaagattgtagttggtttgtttataatgggtaggttatttatttgtgaatcccaaatgtactccatcaacattccattgaataatttacaaaagcaaacagcaggggtttatgttttctcttct

SEQ ID NO: 3112 - DNA, 300 bp, Homo sapiens; identical to SEQ ID NO: 2225

SEQ ID NO: 3113 - DNA, 300 bp, Homo sapiens
cccagggagtggggaggataaggcgctgtcatggaggacgccgccgcgccggggcggaccgagggggtccttgaaaggcaaggagcgccgccagctgcaggccagggaggagccctggtggagctcaccccgacccccggcggcctggccctggtgagcccctaccacacccaccgggccggggaccccttagacctcgtggcgctcgcagagcaggtgcagaaggctgatgaattcatccgagcaaatgccaccaacaagctgacagtcatagctgagcaaatccaacatttgcaagaa

SEQ ID NO: 3114 - DNA, 300 bp, Homo sapiens
ctcaatcaaacaaaagctcaaagtttttgttttgataagaaaataaaaattttgtgggctcttacatagtgggtactttgattatgtgtgataatactgtgctgtgacaaataatataatgaagaaattaataccaagattgctattctgaaagattaaacattctttaatacttagatctttcatctgtttatgtaacaaaccctaacatacaggcttaatgccttgcagatattaacttctttaacttaatctttgtaacagtcccatgaagtaggtactattattattacattttcc

SEQ ID NO: 3115 - DNA, 300 bp, Homo sapiens
gttttcctcaggcacaatgagccactgcaggcttttgaggagaagagtgacaagctgagagctgtgttttaggacagctatcctagagctatgtgtgggcagagagtagcaagcaggttagttaggaggctagggtaaaaaggcagacaggggacacatttgtcatatgccctagtgaggcacagaatcagggaacaggaggtctgcaggtttcaggacaggccagttcagggagaaaagggactagccgtgattatcaggtcactggtgatttatttatcacttccttgaagtattaaa

SEQ ID NO: 3116 - DNA, 300 bp, Homo sapiens
atattattttaattttatataatagcatgtactgctttacacatttttataataagtcaccacagtattacactataactacgttataagtgcaatagatatgggtacaataaataaaaatagttgaggagaaaaaacctttagaccattcattataacgtgccagactgataaggggaaaaccccccatgtcacatgagagaaataaaacccactgccatttctctgtgcctgggtaactgagttgattgtattcaccagaaggttcttgttctgccttttagacctgcctgggtcatt

SEQ ID NO: 3117 - DNA, 300 bp, Homo sapiens
gacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagccccttgacactat

SEQ ID NO: 3118 - DNA, 300 bp, Homo sapiens
ctgctaaaaggcggatagatgttcagttcctccatgaaatgagatttagttcccatgtaatggcattttccataataactgctgatatcatcaaggtaaagagagctgcttctcctaactacccatgaaagaatttagctttttatatttctacctctcccatatagtttaatctctccccactgcgagtatgactgactccaaggtattgaagtctgtgctctaattgggaattcaatgaacaagacttcagtgaatgaacttttttagccatattatataaaatgaaaaaggatctgc

SEQ ID NO: 3119 - DNA, 300 bp, Homo sapiens
gccacctagcttattttatttgtatttaagtgaatataccaaacatttatatgagcaaaccaagttttacataacatgcttttggtatgtattatgactttttacatttctacttggatttcctcttcagatctcagtttccacaaatctgcatccaggttcagggcctctgattctgcacaaatcatatgagccaagtggattgattactagacagatcagatccttccccagctaataactctgccttctgattccagtcctcaaaataaattgcagcctgccattttctttatgttt

SEQ ID NO: 3120 - DNA, 300 bp, Homo sapiens
ctacgaccccatcaatttggcctataacttgaaagagaattctatcctgctagctaaagttgctcggagtgaccagtgagattgttccacagcatgtatattataaaacaaatattaggcagatagcttataatgactttttaatatttatttattcatttattttataataagcagacattgggacaagaaacttctgaaaatatttatagttctctgaaagaaggtgtcttcccttccttctgggagttaaggaatgttttgacaaggaagaaagatgggtgaataagagtgtattgt

SEQ ID NO: 3121 - DNA, 300 bp, Homo sapiens
tgtgaattagcttcttcctccgcccacccctgctttctcacttcctatttcccaagagtacttcccccaacaaccttctgcatgcgattctccatttcagtctgtttccaagagaatccatcccttcctcaagaactgtgccctaacatggagtccattccaaagtcagtaccagtgataattgagcaatgggatgatagaatgtagatgaggcagttagtggttccagcaaaccaaaaagatggcaaggcagtgagagaccagcagtgtaggaaacagccagctatattcattgaaaaa

SEQ ID NO: 3122 - DNA, 300 bp, Homo sapiens
ctctactacatttttaggttttatttcatttttatttatgtctagttttttgggacaggaccattcattggctgttttttaagtatgatgttgtaaagtgcagttagaataaaaagaacagaaaaaaataaagtagggtttggaggaagatgggatgcacatgaaaagataatggcagcagtagaggtgagggaaggagtggatatgggggaatgattttataaaggtcatgaaactagaatctgagtgagggaaaagctttaaaatatctgtgtctcttttctagagggtggataccct

SEQ ID NO: 3123 - DNA, 300 bp, Homo sapiens
cacaagcctctttccatttgacccattcttgttcttcatgaaggactgaggatattgtttgtgcacagttctgaaataaggagaaaatagtactcacaatctagttagggaggcaagactaacaagtgagctttaccgtcagtaatatgtagtctgagtctgtgccatacatatttggataataggtgaatggtggggtacggaggatggacaacagtctgctggaactggagcagagtgccccagcctccacagtttgtcattttgggccagacagttatctgttgcgggaactcctcc

SEQ ID NO: 3124 - DNA, 300 bp, Homo sapiens
aacaagattctgataatggtttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggagaggagggagacctgctggtgcccttgcaccagggtgaggcctgactcacgctgcttccccccacaggccctgctttgcttgcctgctttttccagaatcgattttgcaagcttcaagattctgttc

SEQ ID NO: 3125 - DNA, 300 bp, Homo sapiens
aagaggagaagctgaatcagttggagtcctctctttgggaagaggcctcagatgagggcactctgggaggatcccccaccaagaaggcagtaaccttcgacctcagtgacatggacagcctgagcagagaaagttctgaatctttttccccgcctcacctcgactcaaccccgagtctcacctcccgcaagatccacgggcttagccactccctccggcagatcagcagccagctgagcagtgtcctcagcatcctggacagcctcaaccctcagtcgccgtcgctcgctcctcgcctcc

SEQ ID NO: 3126 - DNA, 300 bp, Homo sapiens
atgatttgattgtaaattatctcatggtccctgtttgcaaaccaccctcttaagagagaacattgttttggacctaaagcttgaagaacggtttatgtatttttctccttaagtagcattgcattgagtgttaggttcttttccctttttttcattcttggtcttcccaaagcttcttcccacatttcgtttgtgtctgtttccaccattcatagaaaccttggaaccactctcacagcaatgctaggatgtttcatggacctgttaagcattttgatgatacaagacatcctatcaatg

SEQ ID NO: 3127 - DNA, 300 bp, Homo sapiens
ggtcattgatagcaagtaagtacttcctgaaggctttccagttcaaaagattacaagccattctgcctgccaaacaaattatattctgaagatgcctgttttgtaacccttgatgtgaattttttggtgtctgaaatttacaaaagaatgaaattgaaattgtaaaacactaaatgctttgggtttattttgaagtaatctgttactttaaaatgtcaacattaggaagccataaaacaagatattatgaaacccagtattataaatgttatctacatctaaagtattttaaaataactt

SEQ ID NO: 3128 - DNA, 300 bp, Homo sapiens
caaaaataatagaaaaaaaaacagaatttccacaaacccccacctaatttatctgcctcctgccatcagtgccaatatactgtgcttttcttctgtggatacattatttaggccactattcagggccaacccctccacctgcctactagaggccatcaccacttgtttattcaagggcacagctccaggtagttttccttctcttggggatcatcagtttccttctgtctaccaggtcattcccattagcatgtttttgccgcttttcttaagagataatatctcaaccctaattcctcc

SEQ ID NO: 3129 - DNA, 300 bp, Homo sapiens
ggaacatgcaaagcagtagccctctgaggagcagagttaaggctagtacagaaaagacttttcctcccaaaacaccttcagtgtttggagaggctattatgtcaataagtaaagaacatgctactgtgaaaaaggtacaggaacaaaaaagagttgccaaaaataaaaaatattattgtaaggtaaaaaatttcataaatgggcctaatagtgggatggatataactgaaaactaagatggtgatgaggaagacagtcaagaataaatataccaaagtagcaaagaaatacctgtgcaag

SEQ ID NO: 3130 - DNA, 300 bp, Homo sapiens
cctaggcgtagtcatttctttattagtccttactttatttttcaaagttacgtaataaatgtctatgtttctaagctatctttagatttgtaaaagggctaaaatgttacttttaaacatgtttggtttattcaaatttgtttataaatctctcctttgtacccctggctaccacccctccccactcctctgcctaaaactaagggaaaatcctgtctttgcccatagcttcagaatgttctgcaattttagacttttacttttaactgatcactgttaagcaagggaggaaatttacca

SEQ ID NO: 3131 - DNA, 300 bp, Homo sapiens
ggaaaagtaaagagatcaaaatgattttatatgtattttttttgtactcagagaattacattttcactacccccgcctgtctcagggaatagcctttgataagaatcccatggagatctctggaactctattacagtgtgttcagatttgttagttcatatgtaaatttcagagctagagcttcaaaactagagtattgtaatctcaggaacataagattatccaagaagcctgaaccttgctcttttcatgataaatgacatccaaatttcctttgtctaggagataagcatagatccc

SEQ ID NO: 3132 - DNA, 300 bp, Homo sapiens
acagggtaagtgcatgtgacggtgtccaagacgcacagcagattttcattcacaaaaaaatctgaccacaagagctaaacggaaataccttccgctgtccttcccaagtcacagagcaaacacctcagttcccaggggtccgcatcagttctggtggaggcggtgactgtgagcgtgaccagctgggctaattcgtcctgacatttagttgggacagctatagtttcctacctctatgaccagagagtgaagcgtttcactgaagaactgtggccggcgtctccaggaaaggaaggagcc

SEQ ID NO: 3133 - DNA, 300 bp, Homo sapiens
tctccatgtgtgtcgtgttttgtgctttcttgcggcaggagccttttgctttgtttatctgatgcttcccttttttggttttccccgggctttccagctcttggagcacccttttgtcagcagatgtacttttgtttccagtttttaaattctaattacagtgtaactcaactaaaatcatggaactggggaacataaaacaaatcattagggtaatggaggcatagaagaaagtgaaaggaatccagtccacctctttgctgtactaggtatggatatgcctcagctgtgagtgagggc

SEQ ID NO: 3134 - DNA, 300 bp, Homo sapiens
gaatcaaaaccaagtaccagaattatgtgttccttaaggaaaattgaggaactgtgaaaaatagaaagtgagggtaatcattcttaatctaattacctaagcatagatactgttaatatcttggtatatgttttttctggtctttgttttagtctgcatggattgttttaacatccttttatttgctctctgaatgctgttttatggtttatattttccatgtttttatatttttacttaccatgtaatatatatttttccatattacctagtatttgaaatggtaaatggctttataat

SEQ ID NO: 3135 - DNA, 300 bp, Homo sapiens
caaagccatatactggtgaatatatactgggtcaagcaccacatgttagttttggaatgtgtatttcccagcgaatagaatttactgctccaaaaagcttttttggcataaatcacaatacttacagaaatataattgtatcattgaaaaaaacaaagctcaccttcctaatgatacatttcacaaactgcacattagggcaatttcttacttatgaggaggtacaaagaaatactctgtcaatatagtataactgcttatttcaaattgtatctaggaatgaataactactattattta

SEQ ID NO: 3136 - DNA, 300 bp, Homo sapiens
atgcgcttattaggtattttatctttcaaaaatatatgtacccaactgtgtttgtttgtttcctgactgtgaacactgaagaggactagatcaaaaatgaccaattgagtagcaattgaacatttacagtgctgtgtgcagtgaacttctgtagcacccaaattgtggtgttgggaaaaaccattccaccttaaaagaaaccaagcctttctggcaaaattgctgattctaggttttgggcaagaaatgtacatgctgagctggaacattgtcataacagttagtaaggaggctgttaaa

SEQ ID NO: 3137 - DNA, 300 bp, Homo sapiens
gaatcacagggcaaagaacccacatccatggctcagtagaacctgagctattacacccaagatccaaacaggaaagaaagggaccagagaaaggaaagggtccagagcctgaagggaaagagatgtagaatcagagaactcgagaggaacagtatgcttcatttgagacacagccagagatgagttcacaggaaggatgctgggtgtacatccttaggccttacccacctacctatttcagtcttctcttaggggtccccatatgctgaacccagcctgaagctaaaggacttaagagcc

SEQ ID NO: 3138 - DNA, 300 bp, Homo sapiens
gccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaag

SEQ ID NO: 3139 - DNA, 300 bp, Homo sapiens
ctgaatggcataatcttattaatgagatgttttgtttctcgtttagcatttgaatatttagattcatatatcaaaaatgcatgattctggcactaaatcagaatatttgcatatcttaccatttacagtgggtttttaaatttgtttttatgtcatatcactaatttgtagcaagtagattttctggtggtgtaactgttgctaatgatagtaaatgtttcatagactagctgaaacacagagtagctttttcaccctgaatgttgaactatgaaatattattttgagttttaattatag

SEQ ID NO: 3140 - DNA, 300 bp, Homo sapiens
gtcttcactctgcgacaacaagcttcttgaaggcaaagaccatattttaagtatcttttgtgtcctagatgcactgagtaaaattccagggatgccgttgatcataaatttgttataatttttaaaaatagactttaaaatttagatttacagaaacattgcaaagatactgcagagttcctgcctatcctacactgtttcccatattattaacgtcttacatccctgtgatcatttgtctgtattaataaaccagtattgatacattatcacagagaccatactttatcaggtttccac

SEQ ID NO: 3141 - DNA, 300 bp, Homo sapiens
cggcgcctgggctgctcgtctggctgctcgtgctccggctgccctggcgggtgccgggccagctggaccccagcactggccggcggttctcggagcacaaactctgcgcggacgacgaatgcagcatgttaatgtaccgcggtgaggctcttgaagatttcacaggcccggattgtcgttttgtgaattttaaaaaaggtgatcctgtatatgtttactataaactggcaagaggatggcctgaagtttgggctggaagtaaatgagatgccacctgtggtcccaactgacaaagattaa

SEQ ID NO: 3142 - DNA, 300 bp, Homo sapiens
actttgcatttgctcgttttgttcaacttttccttccttctctgcctgccaaagaaactgtaataactgtaataatttttatgactttctcttcaatgacagttatcttcctttaccctaattccttccctcctcatccttcaaatccccttcctcatcattcaaagtctaactcaagctagcctttcctccttattttccccttatctttccaatccgtatggagatttctcacctttcctgatagaggttgcgccagaatggtgaggattaaattgtaattgctttctaatagactgc

SEQ ID NO: 3143 - DNA, 300 bp, Homo sapiens
gaccagtgatgtcacaggaggtaggaactttatgtgaagtgtgttgcctgccgtgacccgcagcctcctctctaaagggttgtgacaggaactgtcccactgggaggcctgtggctgtggagtgcactcatagcctccactgtccgtaaagggagccatacaaccagagttcgtcctgccccaaaccctgccactcacaaccacatatgtacagtcagatgccatataacaggctgcatatgtgatggtcccataagattacaatgaagcagaaaaatccctgtcacatagtgacatcat

SEQ ID NO: 3144 - DNA, 300 bp, Homo sapiens
  misc_feature 268, 270, 280, 283, 290, 291: n = A,T,C or G
cttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacagctcaatcttagtttgcctccagttaatcttttatgcttagggattaaatgtgtggttttttttttgtttttttttttngnaaacggattntcnttttgtnncccaggttg

SEQ ID NO: 3145 - DNA, 300 bp, Homo sapiens
agtgggtagcaagagttctgtgtaaatacttgggaggcatccaagcggagagttaagtaggcactgaatatttaagttgagctgaggggagtgatctagactggacataaattttgggagtcactagtatacagatggcatgtcatggaactgattgagattgtttgtggccttaagatcaagccctgcgagactggagtaataaaactctggtctcccacacagccagctctgtgtggggaaaaaaaagccctaaaacactaacaacggctaaagcttgggcaaaggagactgaaaagg

SEQ ID NO: 3146 - DNA, 300 bp, Homo sapiens
  misc_feature 217: n = A,T,C or G
gctatccctcctcctgttccaccctccagaggtagtctctgttacccttttatttataacttttatggtttttttttctgtatttatacaaatcgatgcacaaagagggttctcttctctcataaaagtgattattagtcttcagtgtgcctttttttctcctaacaaatgtaaactgggagcattttcccaagtacatatttataatacttacggngcctatctagtattctgtgaatatatactggtaatttattccttcccattgacagacttaccttgtttccatgtattgccatt

SEQ ID NO: 3147 - DNA, 263 bp, Homo sapiens
acttaattcacttgagtagaaatttgtaatttagccataggaatttaggaagtgttagttacaagaggtaacttgaagctgtggacatgatgatagcttttgttgcataattagaatgtgccaaacactttgctaagtgcttatgatagcttttctcttcagaacatcaccatgattatttacagtataacctgtattttacagatggagaaatgtacgcaaaggaaaggggcataacttgcctccagggtcacatagatagc

SEQ ID NO: 3148 - DNA, 300 bp, Homo sapiens
ataacactgagaaaggagtatggtatacttggtttgaactgtgtgctacactaccaggccccttccacattatactactaatttatttaaaatagataggtatcacactgagaggatataaaaaaaatttctgcctcttcatttttgtttcttgtttgaacagaaaaaatgaccaaaatattgggagtacttctaaggaaaaggcaacacacattccagttaacacttggatgtgaaaatatcaatgaatattagaatttataagtcaaactggctctgctcgctgattgcaatttttag

SEQ ID NO: 3149 - DNA, 300 bp, Homo sapiens
cccagggaatgctggcttcctcctattgctattccttgcctttcctaatgccttgaatcagtgcattcattcatttgttcatttcaatcaggaaatatctgtttagcacaaacatagatatttatttatctaagtggaaaagaatattgtaattctcagtgttggtaactgctcctgagattttaaaacgatacaacattttttcagagcaagttgttgatatgtatcaaaagtcctaaagacacacccttttacccgtcaattctacagtcgagtcatctttctaaaaaaaaaaagaat

SEQ ID NO: 3150 - DNA, 300 bp, Homo sapiens
  misc_feature 286, 292: n = A,T,C or G
cccaccttctctctctcattgtctgattgaaagcaccaggtctcccacattgctttcatctttgtgctgtttgttgtccctttccatatctgtatttatgctacctgttagggctcttgccgaagcaggggtgggaacaagaaccacagatatacttctgtggtttgtgaagcattgtgtggagggctgtgtacacagagtacctggggcagttgtcacagccactctgtgtggtagctgctactgtgcccatcttagaaatgagaaggctgaaggacccacccangccacncagccagt

SEQ ID NO: 3151 - DNA, 300 bp, Homo sapiens; identical to SEQ ID NO: 2321

SEQ ID NO: 3152 - DNA, 300 bp, Homo sapiens
attctgctgaaagcctgctccccagaagggtgggaacaatagggacaatgaactgctgttgttcgttatgtttcatccccattccgtttcattttattgaattgtaaaccgtgtgtataacaacactttttaatcaattttttaaaaaagagagagtggaaagaaaccgcttcctacaacagaactgaagagcacaccagtgattacagtgtccagagaggagggtgcattaacactagttttattatttcaatcagatgccaagcaagaatatatctggggttcagacaagaaaggctc

SEQ ID NO: 3153 - DNA, 300 bp, Homo sapiens
ggaacctctacaggaatgcagtgggcttagttttttaatatggaccaggtcttgtttacctttgtgttcccgcaaggcctagcccttcttaagttttcagtaaatattttgatattagcttacctgaaggttttatattgtttatatttcctatgatttatcagtctagaatataagcatattaagcagtgatgaagtctgaaagtagagaaaacttcagattgtttcaaaataggtgatttggaaggtgtatttattctgataaagcaaatatatagctgcgatgggaaaatatctaat

SEQ ID NO: 3154 - DNA, 300 bp, Homo sapiens
gcaatatgtagtttgccataaaatgaatgcatgtcttattcttttccatagttcttcattaatgagacttgtagtcaagaatagattgaagataccattctccttgtgtagttcaaaaaaatctcctctggtaatactgaaacaactaatttttcttattttgtttgttcctctttattattaaatactatgtgaattaactctttagtagttggcctggttgaagctctgtgaggagcaaagcagccctctccaggtgaactgcttgactttaccacctgaaggagtatttactgcaag

SEQ ID NO: 3155 - DNA, 300 bp, Homo sapiens
ccaacgatctgtatcaaccacgtcttcattttccttttcctgtttgtcttactctccccccaaaaagagtcagtttcctgttttctcaatttctcagtttaaaattagagccctatggcaggtgccatgtacagctgcaaaggtggcaagaagccctgagaaagctcaagaagcaggtcaagggggtgggtaaggaagatgggacgttcaagcagaaacaaaaagaggagctaaaagtgaaagccaccccgccaccagccctcaccagtcacaggtggaattaaagaaatctggcaaaaa

SEQ ID NO: 3156 - DNA, 300 bp, Homo sapiens
tggcagtgggagtcgaagcgagggtctgaagttcacgactactagaaggggaggggagtggaaaggctctcagtgaaaaaggtattagaattatttctgaattatcagtctctcatttgtgctttggagaagcagaaaaggcaaaaggggtctttggccatcttctgctggagcttccagggaggatgtgtctccaagagaccagatgtaccgagtttgaaatcccagaagcccaagaggaaaagaatcacagggaggaaaagactgtccaaaggctcctggagtcttctgttctctaac

SEQ ID NO: 3157 - DNA, 300 bp, Homo sapiens
agcataagaaagctggaaaataacctataaataatggcaaaaaaaaagcaaacaataggaagaggaactatataaaaggaacatttggagcatagaagagagttcatggaaatgtaaaaaatgatggtaccctgggtttgatatagtaagtaaaaaactaagggtaagagggtcatgaaagcatctagaagtaggagggaaagccagtcaaattcacaggatgaagtcaggaagataatagagcagtgcccgcaagatcctgagggaaagcaagttccaatctataagtctgtaaccctc

SEQ ID NO: 3158 - DNA, 300 bp, Homo sapiens
attagatactatagtaggttaataatgactaacaccttgtcatctcatcactgagcttttgtctaagatagtctctgaatttagaactgggacgaaagtgtacataataggctattataaaatttttagaattggatttctaaacttggggtcagtgaatctagcaggcttaagcagtgttctcaggtttttctggcacagacaaggaatataagaggaggagagaaaaggagagacagtagtgggagggaatagaatgagagaagatagaaaatatggaattaatagagaaaggataca

SEQ ID NO: 3159 - DNA, 300 bp, Homo sapiens
  misc_feature 192, 230, 235, 239, 244, 280, 286, 287, 288: n = A,T,C or G
agcataagaaagctggaaaataacctataaataatggcaaaaaaaaagcaaacaataggaagaggaactatataaaaggaacatttggagcatagaagagagttcatggaaatgtaaaaaatgatggtaccctgggtttgatatagtaagtaaaaaactaaggggtaagagggtcatgaaagcatctacaantaggagggaaagccagtcaaattcacaggatgaagtcnggaanatantagancagtgcccgcaagatcctgagggaaagcaagttccnatctannnctctgtaaccct

SEQ ID NO: 3160 - DNA, 300 bp, Homo sapiens
taacagtcctatattgttacctgggcaagttaaatagtcctaattgtccctgagttgttagagaatgtttgtgaaccactcagcacagaccttgacagataggtttttgttttttgcttttttgaagtacatgatatagacaggaacacagatttttaaatggtagctgttactaagtgtgggagagagctttgactctggcagtttgggatggcctttcaaaattgacaagtgtggttgtaagggttagagagtaagttggtgatgaatgatacactactctttggagaataaagagcc

SEQ ID NO: 3161 - DNA, 300 bp, Homo sapiens
gatagaataaccaatttaaaatgtcttatagataaaatctagaatgaagctttggtaagaagtctgagctacgtacataagattatcagcaacatatatgttaaggtggagccatttaaagaaagaacagaagggacctatgatttactgattgttgaaaatcaaaataaaggaggcagagaaaataaagattgtgagtcagcaggacttttgtcttattttcaagtggatttattgattacttttcttcttacagccaagtgcaagatttgtgaatgggcgtttgaaagtgagccacta

SEQ ID NO: 3162 - DNA, 300 bp, Homo sapiens
gagttctcttgtgttttactctttttacagtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacc

SEQ ID NO: 3163 - DNA, 300 bp, Homo sapiens
gatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatacgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggt

SEQ ID NO: 3164 - DNA, 300 bp, Homo sapiens
gtaatttgtaaattctgtggtacttttcaaatgtatatcatttactgagtctgattatcacacggcctggcatataataagtactctataagtattggctgatttctaataggtctgaaaatttatcctttagaattttttcttcagttggtttagcgagtttccctttgatgttgaaaatgtttttttttaaaaatctaacctagaccatcccaaatcatgaattactgttgtgtgaaacagtgagactactgtttttatgccacaggtttataattatgcaaataaatactacatctt

SEQ ID NO: 3165 - DNA, 300 bp, Homo sapiens
gtgatctgcccgtctcagcctcccagaggagcacgtggattacaggcatgagccaccatgcccggccctggatgtattttctatcctagaatgtccacctttaaaaatgaagcccagtgaaaagtgttcccccactaaaatgtggactgttttgcttgcagggatgtgtgggtttctggtagatagaaggctagagctagcaccttcccaaattgcagaggaatcaatcctggcttgtctgtgagctggggaggaatggaaaggtaggggccttgagagtccttaattacatagggaatg

SEQ ID NO: 3166 - DNA, 299 bp, Homo sapiens
agtaaataatataatattaggatatgttaggtactgtgatgaaaagtgaagctgataagggtatagtggtgacttagggtgctgatttagagtttggtcagagaaagtctttctgaggagctgtgcgaggtttgctactatctagaggcacagacgagattcagcccaatgaagatgacaaacgctcctgtaacacattacccacattttctgtaggacactgttttgtcgacctatacatatatggctaagtagtctgacactatggattcagtgaagcatacggtatgtgcccatgg

SEQ ID NO: 3167 - DNA, 300 bp, Homo sapiens
caagagcaagggtggagggggacagattgtcaggtcccgaaatgtgtgttgacacacatgggcttcgggttagctggcctgacatggagatagagtgccaatgttcccaggccacagaattatggaggcctcacccacagtattcacagctctcaactggcctttgagaatggaagccttttcctgccctggatatggcgcttcttcctgggagaggagcagagccacagagaggtaggaagttgaggcagagcaaagggaaggcttcagagcttaggcccggttcatctcagatgtgtt

SEQ ID NO: 3168 - DNA, 300 bp, Homo sapiens
tctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattcatgactcttgacagcttttctctcttcactccccaagtcaaggggaggggtggcaggggtctgtttcctggaagtcaggctcatctggcctgttggcatgggggtgggacagtgtgcacagtgtggcggc

SEQ ID NO: 3169 - DNA, 300 bp, Homo sapiens
aatagcatgagcgtcaaaaacaggctgattcaaatcctgttatccagatgcaagtggttatgtactctaagcctcagtttcatcatctgaatatagatatggtacttatcttacaaggttgtgataactaaacataataatgtatataaggcatagcatagcatttggcacatactaggtgcccagtgtgtagtaattgctgtgactacatggtataccaccttcctctccctgagaaatctcaggatattggacacactgaactactccattctaaaccttaaaaataaaaacaaaagg

SEQ ID NO: 3170 - DNA, 300 bp, Homo sapiens
attccatccacttcctccccccattcagcacaaggtacggttttgacaggtagcgtgatgagatttagaacagaggctgaagttaattgaggttagcaagaaaaatattactgtcaatttcagattttttctttaattattttaaactcatgaataatcagttaaatgaaaaagaaatgcacatttaagagcatcttgaaaattcccactcctaggtgcgtcagaggagagaagcctcttgtgacactatctacaatagaacacaccactggctttttgcagatgacatagtttttgttt

SEQ ID NO: 3171 - DNA, 300 bp, Homo sapiens
gtgaccaccactccattcttgtctcctgtgttctcggttcagaccacccacaaaggcagcttcaaagccaaatcctcaggaagggggatctgcccgggctagctagtcacgtgtcaggcacagtcagctctgttgaggggtgtgcagtgagggctcagtgaggccacagagctcagatgtggctatgaagactcctggttggtgggggatggcagttctcacagatgagaggtatggatgggctgggtgcaatgactcacgcctatgatcccagccctttgggaggccaaggtgggcaga

SEQ ID NO: 3172 - DNA, 300 bp, Homo sapiens
gtattcttcttctactggagaaggtaccgaaaaagaatttgatcctctgattgcctagggttttgagacatgagaaataatgtactttgatctggttttgagaaattattgcatattttattttaagtgcttgctgcctctgcctttccccttttgctcctcaaatatataaagtaagtagcctgacctacaggaggactgttaaaaatcatatcactagattaaatagaattaaaaaagaaacaggaagattgaagatgtagtttaatatatgtatcattaataatagaataaatacaa

SEQ ID NO: 3173 - DNA, 300 bp, Homo sapiens
cttcttttcatttttcttaaactaatttctcacaattttcatttttgtcctgagacttgaagggaaagtaagttttaatctagaccatattatttagttacatctaatctctctagacaaaagacagtctggagagtactctttagttctatttattaattttgtctctagattgagccagatttccccatgcatagctggcattttattggcctctgcagaattgctttttctggattggactttggtaatccatatgaaaatctctatgaaatttaattgctcgccaggtgtggtggc

SEQ ID NO: 3174 - DNA, 300 bp, Homo sapiens
gatcattttaacatgcaatcagcataaaaaaactgagaaatctcacatacttttctgtgtactatgtctttgaaatctgttgtgtattttatactcaaagcatactttaatttggaccagccgcatttcactagtttcatgtggctggtggctaccacatggctcagtgcaggtgtaagacacagataagtagtctgtattgcatttagattactgcagtgtcctcgggtgctttcatcgttcacatcagtggaaagccttgttcaaaccaatgtggaattggtgtttcagacaatggta

SEQ ID NO: 3175 - DNA, 300 bp, Homo sapiens
ggggtctcttctactgtcttattggaccctagcagtggctctgagccagcagtcctgtcagttgatttcttggtcgttcctttgttttcttctataatcacatgtggactcagaatgaattttgagttactctgaaatctatttattcaacagatatttacttagtacctcctattgccagactctgctttatgttggatattattttttaaaagcccaccttgcctagatttcctcaaaggaccaggtggcttccctggttttgaaagaccctaattcttactatgatcttaagtaaat

SEQ ID NO: 3176 - DNA, 300 bp, Homo sapiens
gagcaaatgagactgttctggtgaaatgatgaatggcagttacaggcaatggtgggagaaagtaggtttcctcctagtcctacatggtagcatgattttccttggcagtaacatattaacttgattacgtgtcaccggctctgtaatttgttaactcatttgattagaacatgttgctaattcagtcaaggtttccagttgtacacattcatttttgcttctggatctttgcatatgctattctctccttctagaacacttgtccatttgtccaccggctcttcacatgaccaaatccta

SEQ ID NO: 3177 - DNA, 300 bp, Homo sapiens
cttcagacctgtgtttaaattttagctctgtgatctggtagcttttgaccttgagtaaattgcctaatgttactcagtcttagtttcctcatcagaaaagtggtaaggatgataaagtagttcataaacattcattgagcactaagtatttgcaagatactggaggtataaagatgaataaaacactgttcatgtctttgaagacttcctagtcaagtggtgaaattaaacataaaaacaggacattttaatattacgtgcaaagcacatagtgggcaatgtgttggtttgaagaaggat

SEQ ID NO: 3178 - DNA, 300 bp, Homo sapiens
cctagacacctcgtattggggaaagtcttaagtggttggagcccatgacatttgggtatgatgactagattttttgtacagctgagcctcaataaactcatgcgtacacttgtgagaactcaaatcagaaatgggcacagaaactggattacatttctgtgctctgaaatcccacagagttcataaaaatacacatgtatacacaaaagcaacaaatgtaagttacattttattatggaaattgatattagtgaaattgacagctttctatggttaaagattatcctgtaggtgagccaa

SEQ ID NO: 3179 - DNA, 300 bp, Homo sapiens
gtattctgttataggtaacagaaaacaaactaatacaagtggtaatgtgtccagctaaaaatttgggttctgttaaggttaaaagaaaatttgaggtagccagcagtatctgcctcagatgctgagaagcctcctgagataagagcgtataccatgtccataactgaagttttaacattctctgccaaacagaaccagaatttaagggcaggagaatttgcaagatagaatttgcaatttgcaagagggaattgcaatttgcaagagaggggcaatttgcaatttgcaagagagggcaat

SEQ ID NO: 3180 - DNA, 300 bp, Homo sapiens
cagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggcaagtggaatataagcccctttcgggcat

SEQ ID NO: 3181 - DNA, 300 bp, Homo sapiens
aatcaatgaaacatttacaagaagttcaagtaagatctcagtggtgacaggtctagcttatttcaagagctgcacaaaagccacttaacctggcaacaaaaagttaatgtgttggttccctttggtgtattatattcagtctattaaagttttgattgtgatgttttcattgcagtttttataccggataaaatgtattttagaagtagaacttttggagctgaaatagtctgcagaatgtagcttgaaaaccacggcagtgaactactaagggaaagtttcagaattcaagtctagact

SEQ ID NO: 3182 - DNA, 300 bp, Homo sapiens
ttgaaactgaaagccaacttgaaaatggaggtatggcttataattcagctgtgctgaactgtaagtgattaaatactgtttcatcacatatacacatatatatacttatgtggtatataggtcctgttctcattgtacttatgatatttagtgttgttattgccatatcctgtggggggaaagctaagaacctcagtaatcttagtaaatagtgctatcatcagttcatttactcaagccagaaacacaagagtcaccctcagtttctccgtcatcccacatttaatctatcgccatttc

SEQ ID NO: 3183 - DNA, 300 bp, Homo sapiens
caaatacctaatgcatgtggggcttaaaacctagatgacgggtagataagtgcagcaaaccaccatggcacatgtataccagaaacttcacattctgttcatgtatcccagaatttaaagtaaaatttaaaaaaagaaacgtactggaaaatctgaatagaccctctgctggaagcattatgaaaagtaaataaatggatatactgcatcatcctcagaaaaaataaaaaagaaagaaaatgcctgcccccttctgcccacaaaacagattaagcaggggctcattgttggtgtcagaag

SEQ ID NO: 3184 - DNA, 300 bp, Homo sapiens
gaaaggacagcgtggataaaaaggtttttaaaacatggatgttaaggctgttttgcttggagaagacttgggactgggacagtctttagatattatttgaaatgctggcactgtctatctggatcccagggcttgaactaggatttgaggaagtcacagggaagcagatttcagtctgacatttattcagtgcaagttttttggtgctgtagtatatgatgaaagatgtaaagctgaataaagcattatttctgccctagagttgttcacagcctagtcaggcatatggatatgtaaaca

SEQ ID NO: 3185 - DNA, 300 bp, Homo sapiens
ggccaggctggtctcgaacacctgacctcaggtgatccaccctccttggcctcccaaagtgctgggattacaggcatgagccactgtgccctgcctgtaatttttatttaatttttccggtgatggcatgagtgaatgtccacatttaaagttattttggttcacacatggcctttgtttattatttatgagaaaaaattatagaaataatttaagggtggtacagaaatgcaaatctagaggacttaaaatgtacatgaaaactccatttgatatgacaaataatttacaggtcaaata

SEQ ID NO: 3186 - DNA, 300 bp, Homo sapiens
aatggatgaatttttgtttgggttgaagaatctctctgagaagttgacacgtgggggcaatggtttgtttctcttgtatttctgaagttgcaaataatcatgtaagcagttcaaccaggagtttacaccaaacttttaataggcgatatatcattattttttttcccattggtttggataacatccactttaactggcagttagtcatacttagctatttttgttaaagcaggtgatttattgttattttatatttatgacatgattaataagtgaatatggaagattttacattgactt

SEQ ID NO: 3187 - DNA, 300 bp, Homo sapiens
gctactcaggagactgggcaggaggattgcttgagcccaggaggttggggcttcagtgagccatattcacaccactgcgttccagcctgggtgacagagcaaggtgctatctccaaaataaataaataaatgttaaatttgcttttttctctctctctttttttatgtagaatttgtttgttgatacttactgaatgtagtgaccctgctgtggtaatgaacacttctagtgccttctaggcttaaaataccagacagccccaaataacaaatgctcttttgtgttttgataggttggat

SEQ ID NO: 3188 - DNA, 300 bp, Homo sapiens
gctccttcttactctagtatctctgcctttggtcagtcagagagcatttgatgagtaccatgctgggctggaccccatcctggctgccctggaagatagagacaggtcaccttgatccctgcctgtagcatttgggctggctgagatggtggaagtgtgaacagaatattccagtccagtgtcctctgtggtagggatggggatggacccgggagaggccctcctgttcctggcaggaggtgggactcagagttaaaagtgaggtcaaggcccagtgcgatggctcacacctgcagtcct

SEQ ID NO: 3189 - DNA, 300 bp, Homo sapiens
ctcagcctcccaaactgttgggattacaggcgtgagctaccacacccagcccataagcctgatttaaacctagtccacaaacacctggctttctctggcataatttgacagttgctttgagtgccagagaatttacgtcattgtgcctgggagctcacactcagcatggtttttgctttgactccacgtcccggtttgttgttgtttttagggaggggctttctctgtatgttgcccaggctggagggcagtggctattcacaggcaccagcatcatagcacactacagggctgaactcc

SEQ ID NO: 3190 - DNA, 300 bp, Homo sapiens
ccactgctacagccttagtccagactttctctttctcttatctaggctgttaatatagcctaataaatgttccgggccctccagtctatttgtcattcaatcacttgtttcagaaatattactaggcacttattttatgccatggcacaattctaggtgctgaagacgacacagctgcgaataaaacagacatgggacctgttcttgtggagcttatactttagtgcgtagagaaactaaacagagaggtatgaaagatagttgatgggacataattctactgaaggttgggtgatcaaa

SEQ ID NO: 3191 - DNA, 300 bp, Homo sapiens
gtcctcaccaatgctctaaaacagagccatgctccttcgctttgtagggcctggtttaagttttactctagaaatatcaagcaacagattgtttccttgcggacagggattcttgtaggttttttcttgatttttctcttttccctcacaacaatattcattccatcaataattcctgtcacctctactttcaaagtatatacagtcaggtatcgcttaatgaaggggataaattctgagaaattcatggttaggcaattctgtcgctgtgtgcccattacagagaggacttaacacaaa

SEQ ID NO: 3192 - DNA, 300 bp, Homo sapiens
gatggaccctttttgccaatatgcagatgtatcatttctagaagatgtactttaattatgaccatttaatagaccaatactgtctaccttaaaacctcctttggtatctaatttcttgcaacatagtgcatctcaaataactggtaggaaattgtttgtgtctttaaacatatttttagtgtctttaaacatatttttgtttgtgtctttaaacatatttttaggaacgtatggcatgatgcatatgtccttttctttgaatctgggaggtggaagaaagcttagtttgaacaagcttat

SEQ ID NO: 3193 - DNA, 300 bp, Homo sapiens
ggcatagtcagaccctgtctcaaaaataataataatcagtaaacccagtgtggggttattcctttagattactattattttgttcttgaacaattgatttttatttttttagactttttagcctttatataatcattctgtgtactctgccttcataataaaactggaaaaattatgagcaagaaataagaggtactagttctgaggaatagttaagattatcatactgagtccaattgtagcagaattttttgttgcttctttgtatgatacttaaaatagttgaaaatttgattggat

SEQ ID NO: 3194 - DNA, 300 bp, Homo sapiens
gttgggcttagaagatggggctgagtagggagagagggtgctgcctgggagctgagccatacaagtgactgcacaggttgacatggaggattaggtggagtgaggcttccaagcagggaggggaatgatggtggggcccaaatgaggagccacatcgaagtagatgagagaatagaaggtgaagtaagggctggcgttgggtagggggagacgccagcagtgatgctgatgcccaggctgtaggtgtataggtgccatccacctggtaaagagagagctgtagcgcaggaatgaggttgc

SEQ ID NO: 3195 - DNA, 300 bp, Homo sapiens
ggcacatgtatacatatgtaactaacctgcacaatgtgcacatgtaccctaaaacttaaagtataataaaaaaataaataaataaataaaaataaaaaaataaaaacacattataaagggggcaatccagatggccagtaaaccattgtaatagccagaaattggaaacatatattcattgacaacatttaagattataatatagtcatataatagtcctgatataacaatggaaataaattacagctacacacaacataatggataagtcttaaaaagccacatgtacagaatacatac

SEQ ID NO: 3196 - DNA, 300 bp, Homo sapiens
gcgagctgaagtacacaaagtttcaaggccagaaaatgagcaactcagaaatgataacaagagacaagtagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaagaagataaacttgagaaacaggagaagcctgtaaatggtgaagataa

SEQ ID NO: 3197 - DNA, 300 bp, Homo sapiens
gggaattcgaccaacatggagaaaccccgtctctactgaaaatacaaaatagccgggcgtggtggcatgaactaccacactcggcagcatattttaaaatgcagttatttctgaaagtttttggttttacacaattttttttttaggtaataagatgtattgtaaggattatgcttacgtatggtacagagtatacttcacattgttcctgtcttttttgtgggggagggaatgaccgaaagcattgggaatgttaaaggcaaatgagtaaaaagaaaactaaaaaacgattacttcttt

SEQ ID NO: 3198 - DNA, 300 bp, Homo sapiens
aaaaaaacaaaaattcccataaaaaaaatagatgtttctcacatgttgagcatatatggatttcatttttaatatgattgtagaaacattagatttaaagcatattgaaaaagaaaacagtatattctttaggagcttcaaaaaagggttttggtttagttcaaagggtgaaagaagatcttttattattttggtaaataacttctaaggaaacaaaccaccctcacatgcactatctcatttgtatttctgtcaattctgaaaggccagcatttggccagtattatttgaatctgtatt

SEQ ID NO: 3199 - DNA, 300 bp, Homo sapiens
gaatggccaaagttataattggtctttcagattttttcatatggacaagaaactgacccacgaattataaaatccatgtggaaaagaattgatccaaatcaatgtaacttcaagaaaatgtagaaaactttataaaggagtaaattggctttattctcttgatgaaaactcagtattttggtgtaaactctatttaaacaatttcgttcataaacacaaagacaaaccatggggtcaaaatgtgtcctttgcttttaaattctgtccttcatttacttgaatgacctcagtgcttacgca

SEQ ID NO: 3200 - DNA, 300 bp, Homo sapiens
gaataagtgaattggaagatagctacacagaatgaagcatagaagggaagagatggaaatacacagagctagagggtaacacattgatgctacagacagaacacctaacatacttctggagttctgtaagattagaggagagaaaatagagcaagagaaatgttgcaaggatttttccaaaaggtataaaatgtatccctgaatatatttttagtaatctcaaacttcaggcatgataactaaaaccaaattaacataaaataatacaggacgcaaaagaccaatagaaaatctgaaaag

SEQ ID NO: 3201 - DNA, 300 bp, Homo sapiens
gctcaatcaatatttattgagtgcctacgacatatcaggctcagttaggagctggggataaagcagtgaccaaagcagacacagttccttctccagtgagattataatccagatgggataggctataaataaaggaagaagttaacatatatcaggtggtggttagtgctgctgagaaaaatgaaggaggggagagagaaaaggggatgccacaaggctagggtagagagttctgtttcatacagtggtaaaggaaggcctttgtgttgagtgctttgctctggaacgactttaggatgg

SEQ ID NO: 3202 - DNA, 300 bp, Homo sapiens
tgtacttaactgttgtgtgatgtgtgcttttgttaggcatcactgtgcccaagtatttcatgttcattgtaaagaggaaaaatacagatttctctataatgtcaccacttatttctaattgccacttttcatcttgtggaaatgccatgttttgattcagtcttctgaatttgaacattattcaggttatttccaattgctgggaatatccttactgctaaaataaattcttagcattggaattgctaggtcaaagattatgcatgctttttaagggctttagaaatgtattgccagtct

SEQ ID NO: 3203 - DNA, 300 bp, Homo sapiens
aaaaaacacatccaataagaacaagcttgaagatgaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacg

SEQ ID NO: 3204 - DNA, 300 bp, Homo sapiens
tatctgtctgtcttgatctctattctagcctctttttctgattggccctctcccctctcttctgtctgattggcctgtatccttccatcaccccatctgtctgctggattctccctgtctgcctgcagtaatgtatgtgatagcactttataaattataaagcactatgttgtataaaacaccattatcactttgtcttccttcttaccttattttttcttcctttatctgtcttcccttcttctctctttctctctctctctgtttgcctgtctgcatcccttttggtgattttgcctg

SEQ ID NO: 3205 - DNA, 300 bp, Homo sapiens; identical to SEQ ID NO: 2437

SEQ ID NO: 3206 - DNA, 300 bp, Homo sapiens
ggcagagtaagtacggtaatttctgcacccgaatgggtagtgttgcctttgaagtagtcaccttgggaagatgtatgtttattccagtgaagctgaccttacacagaacattcctagaaccctctttagaaactgtcaacttgtaagggtcttcagtgttggtaaatctttgtcctttaagggtagatctattttttgaggaatgatttttttttttaacagctaaagagcattagaaaataagtctgctaaataaaatgggtgaagcagctcaggatgatcttggtgggcaggaggagg

SEQ ID NO: 3207 - DNA, 300 bp, Homo sapiens
cagatataaaatggttttctctgttggaaagtagcagctggcttgacataatcagacgttgcctgaaaaaagcaatagagattacagaatgtatggaagcacaaaacatgaatgttcttcttttagaggagaatgcatccgacctctgctgtctcatttcctctctggtgcaactgatgatggacccccactgcagaaccagaattggtttccagagcctcatccaaaaggagtgggtcatgggtggccactgtttcttggatcgctgcaaccatctccgccagaacgacaaagaggagg

SEQ ID NO: 3208 - DNA, 300 bp, Homo sapiens
cctccatgttattagtaattctgtattccattttgttaacgcctggtagatgtaacctgctaggaggctaactttatacttatttaaaagctcttattttgtggtcattaaaatggcaatttatgtgcagcactttattgcagcaggaagcaggtgtgggttggttgtaaagctctttgctaatcttaaaaagtaatgggtgatttaaaaagaaaaaaggaaaaaaatctttggctgaatatgttcattgcttgtatttttaaaacaacagaatttccagtatgaaacaggctgaaagag

SEQ ID NO: 3209 - DNA, 300 bp, Homo sapiens
gcagtacccccccccaccccacagtaaggcgggctccagcagagctgtggtctaacccaaactctgctgtgtacctgctgtgtgaccctggtcaagtttctaacctctctgagctccagcttcctcacctgtaatatgggaatagcagtgtcttcttcatggtgtggctgtgaaaatcaaatgacataagaactcaggtcctgacatatggtagaaactcagtcggcagtagctatttctaacagagtttcccctctcagcatctgatagccttcctgttcccttccaccctccacctgg

SEQ ID NO: 3210 - DNA, 300 bp, Homo sapiens
aaagcatgtgtgttggggggtgccgtatcattttaccatgtgataagcacttttcataggtagcaaagacacattatgtaaacttaggaggaggagagaatgcaaatttgcatgtgaattttattttgattaatcgctttttttgcttttcagcaatgttatttatgaacaacaaaattatagaaaaagtgagaaaaagtcaattatcaattattttctgatgaacaacaacaaagacaaaaaaatggtgggattgatttattttcccctgacagaattgattgtttctttaggttctat

SEQ ID NO: 3211 - DNA, 300 bp, Homo sapiens
tttagatggagctcataattatacaaactcatctcgttcacaaatccctagggctcaatgttaaagtcagccattgtttaaggcagaaattcaggtttagatatagtgtagcaaagattttccattatatgagatatcgatcctattaaacataaaacttttctcttggctttctattttactgtcttttgttgccatcagctgtatgccccttaattttttctagtaataccttggaatttaaaaatgaaattacaaatgtttatgttttagtgtttttaaaaataattcgattaagta

SEQ ID NO: 3212 - DNA, 300 bp, Homo sapiens
attgcacattgattttatctgtaagttgtctttatcagtggttctcaaagtgtggtcccctgctagtatagtatcagcctcacattggaactggttagaaatgcagacttctcaggatccacctaattgcagtagttaattttaacaagcccttcggtgatcctgaaacatgttacagtttgagaaacactgctataatacgtttcatttaaattgtttcaggttgtgggggtagggaataagactaccaatttattcatcttctgtgcaatattacctgtttacctaactcttagagat

SEQ ID NO: 3213 - DNA, 300 bp, Homo sapiens
aaagaactcaaagggcagcaataccagcaagaaggaaaccagttaggagataattgtagtaatccagggaaagaaagatggcagtttatactggggcattgccagtgtggatagaaatagatctcagaagaattttaggaagtagaagtggcaaaacttggtgactgaattgtgagggcagaagtgggagaaatcaaggatagagtttcttaaacaagctttggtgaagacagggactaccctatttgctgtcatgtatccacagcttagcacaaatctttatacgctggagatgcttga

SEQ ID NO: 3214 - DNA, 300 bp, Homo sapiens
gccctctacagctgctgtggatccccccactgacctccaaatcccctcggcctgtctgagttcacaagcagctgtggtgtgtagcaagttgatagctaatgagcttctcatgggggcaccaaggagctggtgttactggcatgcaggcacagttggtgtgtgcactgggggagcatgacgttaatgcccctggaggctgccttctgccagcaggggtgggaggcagggaataaatgccccaggctcttatcctctgctaggatgattctaaggtgagattcacagggtttttcatagggt

SEQ ID NO: 3215 - DNA, 300 bp, Homo sapiens
ctgagtctccttatagatgaggcagcagaggccttttacaaatacctctcttgttccagttacacaagtcataatttactgagcacgatggtaaaatcctttaaaaatgtagtaaaaagaacagagtatgcatatgcaaaggaggagattggggaaagcaaattagaagtctatgcattctgtagacagtgaaagctggttcaagcagaatgaataagaaagtaatttaaaaagaaggcatcacttattgactaaggtcaaacaggaggaatacacataaaaaccagaaactaacttcaa

SEQ ID NO: 3216 - DNA, 300 bp, Homo sapiens
gagagggtggcatcaggagctgctcaggcttggcggagggagcggcatgggcgatgtcactcagccccttcccggtccgcccgcttccctccttcatgatttccattaaagtctgttgttttgtgactgctgccagtgtggttggccctgcccctgcaggccacatggtccagggagggagggggacatggaaatctgccttagagacaaatggagtagggcagcccggagctggggcccaagggacaggacaccactgcctgctcttcgtctggggcctggggccttgcctcccactga

SEQ ID NO: 3217 - DNA, 300 bp, Homo sapiens
ttttagtcacagtgttgggatttgtaatgtaagttatctcatttgacatatccacgtctcagtcggtggatgggtaatgggatgcccgcttcccctactccagatgattgatgaagaaatggaggtgtatggagatgaggtgacttgcccaggatcagagctttaagtgacagaggcaatattggaactgaggtttccctcattcaaaagccagtggtgcttgtttgcactgccacactggagcagactaactgagaccgctcttgatgggtccttttctacgagaggctttgcctgcca

SEQ ID NO: 3218 - DNA, 300 bp, Homo sapiens
caaacctgttggaggttcagcacaggacctccaacagaagagaaagggagggaagttgggtttctactttgcctgttttaatacgcagctacttgagtatgactatagattcgggaggatacatcgaaactgtagttttacccatgcttctgaactttatcgccaagggaatgccagtgtttcctggcgcattgattaaagtggcgttctgactgctcagtactagaaatgctgcgaaaagggcttctggagtgggacggccctcgtttgcattatgtcccccgcttcttcctaggtaag

SEQ ID NO: 3219 - DNA, 300 bp, Homo sapiens
gttgttttcaaagctgagtgagataacatgttctgcataatgaggaaatagtaaatgttcaatatatgggagctgttgttaccattgatattaatattaataatagtccttgcagctgtcttctaaagaacagttgtttgaccctgaaagcaaaagaaggagaaagcataggttttgggtcagatcctgcctggcttttttctgttacactgtgctgctccacataaccctacaaaatgacatacatctatggcttcaacttcattagctctgtggagaggaatattaccattttccaaa

SEQ ID NO: 3220 - DNA, 300 bp, Homo sapiens
gaaaaatatagctaacacttaatgtttgaggtctgagcactttacattaaatatttaacctataaaatgaaatgagaacttacttttattatcctcacttatacagatgaggaaaccaagacacccagagattaataatttgcctaaggtaacaaaattagtaagcatcgtaaccaggatttttggtcagtctacacaccttccccgttccctcactatagtgcctgctgcaaattgtactttaagctatagttggacaaaatattaaaatctatctgggatgataggtgaccaaaaaaa

SEQ ID NO: 3221 - DNA, 300 bp, Homo sapiens
  misc_feature 224: n = A,T,C or G
ctcggacataaattatttcattcacaccatcttcccttcccacacacacaccctggagcaaacactggcaccggttctaacaactcaaggctgcgtcccgaggatgactgctccagctctcttacgttcctgcctgagagcctgccaagagaatcaactgtttgatagggcccatctcccaggctttgagagagagtaggggcctaattttgttaagctccagntagtaaagccagagagcctaatcgcgttgacagcccccttcctgcttttcagttatttctgcttccctgaatactg

SEQ ID NO: 3222 - DNA, 300 bp, Homo sapiens
actaaaggtgtgagccactgcgcccggcataagtaagaattattaatctgttcttgcttcagaacatctgtcttttcaacttaatacgaacaaatataaatattaaacacttcactttgtcttcaaaactgctcaaaacacttcactttgtcttcaaaactgctcccagaattttcctagcatttttggtgattcaacattcatgtcaaaccaccacacttgggctccccagtttcttcatttcctcattgttgcatgcacaaatttttctctgctctatctcagccacatcctactcct

SEQ ID NO: 3223 - DNA, 300 bp, Homo sapiens
ggttgttctaggtagtttcatgcggatgctgacctaaactagaatgtagaaattagtaggaaagtgaatgcccactaggtggaaacctgaaagcacggggacctgcgatcttgtttactgttatattcctgctgcgcagctcagggtctctatgtaaaaaatgagtgaatttattttctagctggtgcctacaaaataatctgcaatgtatccatactggtttattaatggtaacagatgaaccgtactaatatgagataataggggaaactagatatggagtgtatgggaattctatct

SEQ ID NO: 3224 - DNA, 300 bp, Homo sapiens
ccagattgaaagagtcttgagtactcagcacaattaatgaaaatagactaatgctgacatacattaccatgataagtcagaatactggaggcaaaaagaagactctgtagtcttccagggaggggggaaatgtcacagacaggatcaggagtcatgatgacctcagcagcacttctggaagccaaacaatgaggcagttttcttcaaaggtatgaaagaaaataattactgatgcagccttttcttttttaaccaaacaatgaatgaagtgtgaagatggaatcaagataagttcagaaa

SEQ ID NO: 3225 - DNA, 300 bp, Homo sapiens
aacctctctgtgtctcttattccacatctttcacgtggggttgctgttatggttaattagaaaattctggacctgattcattaaccccgcttttcttctctaatgtgtcctgaagctgagctagatgatgagtaaattctttgctgactgttgctcatcactttctctcaaagttagaacttttcagtataaaaataattagcttttaactgattattaatgttctttaatagtttctgtcaaaacttgtctaaaatttgtgttgtgccaaattggaaatacccactataatatggcgca

SEQ ID NO: 3226 - DNA, 300 bp, Homo sapiens
gcactttcggaggctgaggttacaggtgtgagctgttgcacgtggcccgttttgccgttttatcttcgtaggagttgccgctgctcagtactcccgtctctgttctcactcacgtgtggtgttctctgtggacgctgagcctctgcagaagctgctgactttgtcaggtccgaggctgtgtcctcagcaccaaggacagcacagggcggacactccgcgtatttgagtgagaaaatgaatgctttgcaacaaccatatcgtattgaaccgttctgtgaacgaggcccctttgctagggct

SEQ ID NO: 3227 - DNA, 300 bp, Homo sapiens
gcactttcggaggctgaggttacaggtgtgagctgttgcacgtggcccgttttgccgttttatcttcgtaggagttgccgctgctcactactcccgtctctgttctcactcacgtgtggtgttctctgtggacgctgagcctctgcagaagctgctgactttgtcaggtccgaggctgtgtcctcagcaccaaggacagcacagggcggacactccgcgtatttgagtgagaaaatgaatgctttgcaacaaccatatcgtattgaaccgttctgtgaacgaggcccctttgctagggct

SEQ ID NO: 3228 - DNA, 300 bp, Homo sapiens
tcctaaaccctctgtaggctacatgccttccgccccactgcaaaggtgtttatcagagtcaccaactcaactttgccaaagctaatagttctcaagtctctttttttaaattctccaatagaatttgatgtaagtattccctcctccttgaaatactttcttcacttggtttctaggacacaatagagaacctctttgttgatcttcctcgttttcctaaccctaaatgtttgagtgccccgaggcaatactatcttgtctctatctctgctgccatggtgatctcattcaagagtcatg

SEQ ID NO: 3229 - DNA, 300 bp, Homo sapiens
ttcacattaagtttttactggcagaatattgcttttgtttcaaaaacccatagttgcgttacagttccagatacagcattatctatttagatttaatttcgcttatacatgttttcttgctctctgctgttgtttacactctttatttttctgttactgagatcttcattcttactataatttttgtttgttaggagctcttccatgagtaattttcgttggacagtcttaatgggtagtatagtttctgagctattagacgcccaaaatattttttcatttgcctttacatatgaatgc

SEQ ID NO: 3230 - DNA, 300 bp, Homo sapiens
aagcatggctctgccctcttgaaagactaaagaaatattccatcagcagtttactttagaagaactgaaagaataggttgatactgaacccactcccagagccaggtagctgaaagggcactgtgattgttatcttactaggaacacgtggagtgggagtaaggcagttttctgcagaaaagagggattctgggcagacaaaaactacatatgcactatgttttgttttgtttttttgtttgtttgttttaaattaaaaccagaaaaggcgaagacttggagaatgctcaaaattttttt

SEQ ID NO: 3231 - DNA, 300 bp, Homo sapiens; identical to SEQ ID NO: 2494

SEQ ID NO: 3232 - DNA, 300 bp, Homo sapiens
gcctaaaattagagaattatctgctcagtccttattcctgcagaatacaaatgtcacattctaacctgttaagagattgtcttcaaaataaaactgttattaactacattaatgttagacaaagtacactttagggcaaaaggcattattagggatagatttcataatgatagagttctatagtagaatatagtaatgcaactgaacaaaatgaagctcattccactgcatggaagaatctcacagatgtgatgctgaacaaaggaagccacgtacaaacacttactatataattttatg

SEQ ID NO: 3233 - DNA, 300 bp, Homo sapiens
gtaagatcctgcctcaaaaaaaaaagtttatgttctcaaagtgctcataatctagtggtagtacagtatttgagatattagagcagtttctcctccttttgcaactaaggacatgtatccttaaagcagaaggaatggcagagtcgtgtaataaaccctcaagtaccattacttagcttcaacaactatcgacactctactgttcttgtttcatttatgcctcacctccttcccatcccccacttgaatattctcatcctttttttacagtttttaagataacaattacataactgaaat

SEQ ID NO: 3234 - DNA, 300 bp, Homo sapiens
cctaggttctagagtaaactctgccactacctagctaggttgacctttaacaagtctatttaactttttcttaggttatttctaagagagtttcaaaatgaaaaaaaatactatgtgtttgtaattttatgattataattccatttaagtaaaataacaaaaataacactcgtatcatagacattagagagttcttacttggaaagtttcatttcctaatgacatcactgaaacagcaggtatgacagagggttccctgactttgatagttttaattatcttaatttatcctctgtcctc

SEQ ID NO: 3235 - DNA, 300 bp, Homo sapiens
gcggctggcggcaaaacctctcgagtgagcccctgcccgagtgccgcgggggagaggccgcgagcgggaccgagaagtgggctgggagcagaggtcgcggaggtggcgagcgaggccggggcccaggcggggaccgggaggggcccgggagtggcgggcacgccagggtcagggagccgggcgagggagggggcccggggttggggaagggggcccggggagggaggtaaacagccctgcaggcctcggggcaccgttgctgggcggcgccggcggcatgtgctagggcccgtcccgcat

SEQ ID NO: 3236 - DNA, 300 bp, Homo sapiens
ggcaactgtaagaaattcttctttcaaggcagttgtcttcgtatctatcattttaccatacctggttaaaacagagtcccaggtacatattaaagcaagccttcatacatgttggccctctatctaaaagcctcttcccactcctttccctttacctggtaatccctgttattccctagatgcctgctttaaagagatttcctttggtaaatcaccctgaaccctcagactagtccagacctctctttgatattttcctcttgacattcagcatttatcccaattgaaagtaataattac

SEQ ID NO: 3237 - DNA, 300 bp, Homo sapiens
cttcctccaggcattataatattaggttaatttagaggagcatatttatatgtggagttacattgtgttggccattcaggagactgactgtgaaagaatccaaactttatatttctgccttgccagtttttttttccttttcttcactccatttgagacactcttgacctaatccagtaaactctaattaatagtcttggtaaattctgtttcaagccatcctgagtagcgtcactgacacccgatctgtttcagtaaggtcaaattagcatcctttactatttttctggcatttaaatg

SEQ ID NO: 3238 - DNA, 300 bp, Homo sapiens
ctcagatgccagtcacaagtcccaggcctctcatacttctgaccgactggctacaaatcaggggttcccactacctcctcagattagataatttgctggataaaactcaggaaaacattattattaagggcacaactcagcaacagcccagtagaagaggtgcacggagcaagcacggggggacgtggagtttctgtgccctcctagggtggcctcctgcccagctcacccttgtgtgtgcaaggtccccgaatcttgtagttagagtttctgtagaactcaatctctaatcctttcctt

SEQ ID NO: 3239 - DNA, 300 bp, Homo sapiens
gtggaataatatcttttgaaataactaagtccactaaattatacagtatgctattctggttctaagtacatattagtcccttggcaaatctgttctttcaaagcataccttccccaaatgagcctacctacttcttaaaaaacatataacacaatgtggtagtagtaggtgtaaggaaggtaagttttttcatagtggtatgcaaacatatcattgaaatattacatagatataaagacttagggaataaaaatagcagcaacaaatacttgatagatttatcctacttgggagaaatat

SEQ ID NO: 3240 - DNA, 300 bp, Homo sapiens
  misc_feature 272, 273, 276, 292: n = A,T,C or G
aaactcttaagtatacgctacggtctgtgtgtggtgctttatacgcaccattttacttaatcctttgttaagcagtattattttgaggaaacagattgagagcgattatgtaacatggccaaggtctgacacttagtaagtgataaacttgggtcttaaatactagtcttttggacttgggcatttaaggacgactagcctgtattacctttcctttgagatccttcctcacataggaggtgaatttaataatctggatttcttgaaataanntanactccaccaaaacaantcctgcct

SEQ ID NO: 3241 - DNA, 300 bp, Homo sapiens
atgaatttgtctctgaggatattcaaagaaagcagcagtagtagtgttaaagggtcccagctaggccttttcagttctttcctatcattgttaatgtagacaaccatttcccagatttttgagataaatcaatttatttatttgcaatatttacatgcctacatggttttttaaagttattttaatgtatttttaatgattaaaaaattatgtcccgtatttattagtcattcattacttaccattatttgcatttaatccttaaagcagaagtgtacaaaaaagagattaatgtaaagc

SEQ ID NO: 3242 - DNA, 292 bp, Homo sapiens
  misc_feature 214, 231, 232, 243, 246, 247, 252, 256, 262, 268, 274, 282,284, 286: n = A,T,C or G
gcgagactgtctcaaaaaaatcaaaaaaaagaaaggggatgtaaaataatcgctgcaagttacagtgtttttcattaatgacttccaaatgtctcacatgtattgtctcttcccagtagcataaacaaagatgcagggaggtgcaatgagttcctacaggccctagagctgacggtaggggtgggaatacagttcacaccgcgtcttcagctgngttccttgtggatgacnnccactgtcagncanntgatnaaancagttntcaatnctaaantgctgganantnactgct

SEQ ID NO: 3243 - DNA, 300 bp, Homo sapiens
attttaagtgtgcagctcagcccgtatttagtgtattcacaatgttctgcaaccaccagcctcctgagtagctgggtgtgcaccctgcacccagccagaagtggaatatcttgttggggctgggcttagagctggagctggtggccggctctgctcgcttacagaattctgtacggtttctgatttctctcagcccatctgtccttcacttgcaagcatctgatgactgctgcatgtaccataaaaacatgcaaatatataattcttggctttgaggaggtgaccctatgaaattgactt

SEQ ID NO: 3244 - DNA, 300 bp, Homo sapiens
ctcagggtattgaaatctgagaccttaggcttctatttcactgaattcttataataccactgcaagttgaggtatacatttcctgattttatggataaataaactactgttacaataatactgtggaacaagcaaccacaaaatctcagagtcacaaacatttatatttcacttgggcacctgtaggttggctgtgatttagctcatctaagctggactcagctgggctgggttccaggctctgcagtaggtccagtgtatacagcacccttgatgtaagtaactccatcttagaaaaat

SEQ ID NO: 3245 - DNA, 300 bp, Homo sapiens; identical to SEQ ID NO: 2544

SEQ ID NO: 3246 - DNA, 300 bp, Homo sapiens
ggtgggcaaaggacagtccgccgaggtgctcggtggagtcatggcagtaagctcataaagaagcaagataatggaatacacaaatattactacgactttatgggtggcataccttgattcttgatccacgtggctgtgttcagatctggttagcacacattgacatcaggggctgagccaccagtgagagtcaaacccagcagccctgtcagtctaccttctctcttgacttgatccagcctcataacttcactttccgcaggagaaacacacctcttgaggtcctctgtcacaaatagg

SEQ ID NO: 3247 - DNA, 189 bp, Homo sapiens
cagaactcatatagtgtttgaaggaatgcaaagttgcaaagtggtacagtgtttttgtaacgtaacagtttttaacatatttaaacatacacttacgatgtgacctagccattcccctttgagatatttgctcaaaagaaattaaagcggccaggatggtggctcacacctgtagtcccagcattttgg

SEQ ID NO: 3248 - DNA, 300 bp, Homo sapiens
gggccatgtacctcccggacaccctctctccagccgaccagctcaagtccacactgcagaccctcccagagattgtggcaaaggaagcacaggtgaaagtggccgaggtggagggcgagcaggtggacaacaaggccaagctggaggccacgctgcaggaggaggcggccatccagcaggagcaccgtgagaaggagctgcagaagcgctcggaggtggcgaaggattttgagcccgaacgtgtggtagctgctccccaaaggccggggaccgagccacagccagaaatgcctgacacag

SEQ ID NO: 3249 - DNA, 300 bp, Homo sapiens
gagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaagcgtttacccttggtttattgtgattatcatggccattcccgaaagaagaatgtatttatgtatggttgcagcatcaaagagacagtgtggcataccaatgataatgcaacttcatgtgatg

SEQ ID NO: 3250 - DNA, 300 bp, Homo sapiens
atcaggcaactcatactgaagagaaactctatgaatgtaactagtttgtaaatcagctgggatttcttcctttttatttcattcttttaaaaaatttattttaaggtagtacatgtagttggaagaactactataaaaacaatatatgtgggaaaacttccagccctctgttaattgtgtgtctcaaatttgttctggaaaagaaagggggaaagtctatgaacgacttttcaacctggcaattccatatacaatgttaaacttgattcttatgacatattcctatgaaaataataaata

SEQ ID NO: 3251 - DNA, 300 bp, Homo sapiens
  misc_feature 193: n = A,T,C or G
cttttccatgactccaggctgtgcctctctccatgtttggtcccttctgtgcccatggtcaggagctattcgggtggcacctcgctggccaggctctcccgagtcgtggcacctccacaatgtgaattttctgaatccctattccaggatttctgggaataatgtttacttctagaatgggcctgttgtaaanccatctcatcgaggtgtggtaaagccattggatgaggaggggactgccatggaaaggagagtttgttacttacggttctgagaggaggggccacataggaaagcccc

SEQ ID NO: 3252 - DNA, 300 bp, Homo sapiens
ggtaaccaagcacttcgtagtggccaccaatcaggaggaagtccctgattgacctagctcaggtcacatggccattctcagtccagtcaatgtggccaggcataagtgaggggggagaatagggtctggaagcagggaacctaaggctgattcacgctgatttcctagaatggaattaaaaggaaaaccccaactttccatgcccaagtaacaaaaggatcataagctacttcctttgcacccccacccactttttcttcgtggcagatggaaaatggaaagtactctgattggtcccct

SEQ ID NO: 3253 - DNA, 300 bp, Homo sapiens
aagaggtagagatggaagattttgatgcaaatatcgaagaacagaaagaagaaaagaaagatgcagaggaagaggaaagcgaactgggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctgggaagaagagggtcagatgggcagacctggaagagaagaagg

SEQ ID NO: 3254 - DNA, 300 bp, Homo sapiens
tctgtggttggaagcctgaatgtgaatcgctgcaaccagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcgg

SEQ ID NO: 3255 - DNA, 300 bp, Homo sapiens
ggtggtcatccctaccttgttcctaatcttagggagaaagaatttgtctttcaatgagtaagtctgatgttacctctgggattttttggtagatgctctttatgtgtttgaggtaaatcttgtctagttctagtttttttgagtgtttttaccttgaataggtgttggatactttgtagatattaaaaatactatgaagggagactggattattcttttttagctggaaatagagtagtatgtgaattagaatgataaagtctgactgttgtctcaggcatacaatacttaaggcaccaa

SEQ ID NO: 3256 - DNA, 300 bp, Homo sapiens
ggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggct

SEQ ID NO: 3257 - DNA, 289 bp, Homo sapiens
  misc_feature 223, 234, 235, 238, 247, 252, 262, 263, 271, 277: n = A,T,C or G
gtccatctttgtagctgacatgacacattttaaaaatttcacattaaaatgaaggcatctaatggctccattatgtcttttagagtggtctggcccagctaattgcatattgaaatacattagatttgtcataaattactttcctttattgtcttttctgtcaatcttaggacattaaatgtatatgtttgaaattgtgtttaggtaggttatctgagcattnggttcagatanntanagagagcgntatangttcactgtnntccccacnggcttngcgactgatatg

SEQ ID NO: 3258 - DNA, 300 bp, Homo sapiens
gggcaggctttgagaggatcgactgcaattttgaaagaagttgtaccgtgagtaaaatgcgatcaaacagcattgcatgcttcagagaaatctttcttcacaaaaggaacaattggtgcagcaaaattaattttcttattttaagaaattgtcagccgggtgtgagccaccatgcccggccgacataggctattttttaaaatgcaagctcttctgaaccatataatatgatgttttaaaatatagactctgaagacaaagacctgggctcagaatcaggccccaccacttattttcaat

SEQ ID NO: 3259 - DNA, 300 bp, Homo sapiens
cccaagtcagactttgggccttacaactgataatggtctccacaccttcacttctggtggttttacatgtagcctatcatgagggtagagagaaaaggcacagaaagaaactctatgtcagcccaggtacaatggatgggggcctatggtacgcttatcttatcagcctcattgttaaaactggttttgaaattggcttccttgttttattttataagctatatgatggctttagtgttccctaccttataaagtgtgatttgaagccttgtcccaacactgtggactgcttcatctcca

SEQ ID NO: 3260 - DNA, 300 bp, Homo sapiens
ccgggtctagccaacatgtgactacaactgcatgaaagaccttaaatgagacctactcagccaaactcttcctaagtcctgtccaaacaaaaccatgaaggataagaaatggttattattattttaagctaccaccttttggtgtgattattatatgcaataataggtagcagacactggctttggttggacatgtatgttctctgcatattctgcttttgtgcatgtggagaaatgggctttctgggctgctgacaatgaggaggtagagatgttgttcaggcagatgcgtttagactt

SEQ ID NO: 3261 - DNA, 300 bp, Homo sapiens
agaaactacttctatgatttcagctggagtctgaagatacttgtttctgttcaagtcccactttaaattatgtcttaggagactgaaagcggaatcttctgagcattcctagatatctgcttagaaatatcatgcgataaagagggaccttcttaatacactgatgttcttcactaaatggatggccacaagaaaaataaagtagcatgcctataaataattgaaccataaattttcatgtcatgtgatactggaatatgggatacttttcatgtttatatatatatatatatatgtcta

SEQ ID NO: 3262 - DNA, 300 bp, Homo sapiens
tctagctcagggtctctcatgaggtttcagttatgatgttggcttgtactgtgtcgtctgaaggcctggctgggctgaagcatctgcttccaagctcactcatgtggccatttcccagaggcccagtaccttactggctttttgccagggaggccttaatttcttacatatgggcctctccatagggcagcatgcaacttggcagctggtctcccttacagtgaatgatccaagagagtatgagagagtgtgccacaatggaagccaggtatctgttataacctcatcttagaaatgata

SEQ ID NO: 3263 - DNA, 300 bp, Homo sapiens
tggaaaagaaaataaaattggcagctcactcttctgtcatttgatcttctgtcatttgcttttctgagttttggccctcctgtacaatctatctggtcgggtttacttttctccatcttcaagcagggtgtgtcttcaagcatgcatgtctgtgttttgattcggaattgatagttataatagaagcatgagctgctgggaaattatacctcctgatttgtgtggttttatttgttcatcttgcaggtttgagtagtttttggtggatgtgttgggagatttgaatgttacttagctgtt

SEQ ID NO: 3264 - DNA, 286 bp, Homo sapiens
  misc_feature 181, 189, 190, 191, 197, 199, 200, 202, 203, 207, 215, 218,225, 226, 227, 230, 231, 235, 236, 238, 239, 241, 242, 247,248, 254, 255, 256, 261, 263, 264, 269, 272, 274, 278, 279,280: n = A,T,C or G
actggctgctctaatttacattcctaccaacagtgcataagagttcctttttctccagctactcaggaggctgagggaggagaactatttgaaccctagaagcagagggagccagattacaccaccactgcactccagcctggacggagagtgagattctgtcaaaaaaaaaaaaggcccntttttttnnngttttngnnanntttngtaatttnggnctttttnnnaanncccnncnnannggatnnaaaagnnnccctnannggggnttnantaannnttcctt

SEQ ID NO: 3265 - DNA, 300 bp, Homo sapiens
gtcaagcattccacttttcctatctgcaaaacagggcttaaaatagtatatcaaacaataactagttagaagatacaatggaagaaaaagtgccactttcaggagcaacaaagatgagataccagaaataaacttaacaacaaactctaaaacctacatgataaaaaatgtaaaacatcattgaagaacataaaagaagtttggaacaattgaagaatatgtcttcttcataactggaaatacacagcaccataaagatgttagtttaaggtaatttataaatttaatgtgatgataaga

SEQ ID NO: 3266 - DNA, 300 bp, Homo sapiens
gccaaatccttcagtggatgtgaaaggaataggagatgaattatataatccagaaacacataaacgacatactttgttttgtgggacaactgttattcagactcgtttctacactggagaactcgtcaaagccatagttgttagaacaggatttagtacttccaaaggacagcttgttcgttccatattgtatcccaaaccaactgattttaaactctacagagatgcctacttgtttctactatgtcttgtggcagttgctggcattgggtttatctacactattattaatagcatttt

SEQ ID NO: 3267 - DNA, 300 bp, Homo sapiens
ctttagccccagtcaagttacctcagcaaagactagctgaccctgccaagccctgcccaagttacagaatcatgagcaaataaatggctgtttctgttttaagcttttaaattttgggggtggtttatgtgtcaataataactgaaacagataatatatacagaataaactttagttttaataatctaagtaaaagcccactaattcattatgcagaaaaaaatgatttttttgagacggggtctcgctctgttgccaggctggagtgctgtggcacaaccatagctcactgcagcctcc

SEQ ID NO: 3268 - DNA, 300 bp, Homo sapiens
cagcgcccagctccgaggttggagcagccccgccgggcaacttgaatttctgcaaacgaacacagcaccgggagctctgcagacctgtgtcggcgcggaacccggactgagacatgccttttgaacttctcagatagaggaaccccagtgaagactgatcagttcttacaattctcaaagcatggcccataaatatgtgggtttgcagtatcacggatcagtgacatttgaggatgtggccatagccttctcccagcaggagtgggagagtctggactcttcccagaggggcttgtacag

SEQ ID NO: 3269 - DNA, 300 bp, Homo sapiens
ttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtatcaaagctattaacataatgaaacagaaactgcatgacctttatcatgatatttttagtagattaagagatgaccaaggtaggccagtcaatcccaaccac

SEQ ID NO: 3270 - DNA, 300 bp, Homo sapiens
ctttgtcccaatatttgtgacaccagtgtaatgacttggttaagttgggttgaccaggttcctccactgtcaggttatactttttcattctgtaattaatgtatcgctatatattttatatactttgaaactgtaaacatcttgtcctcatcaaaccttcacctactaattttagcagtcattgctaattttttaaactcccattctttctacatttagtagttggcattctactataaggaagaattttccctttttccttatttgtgtatacttatttattaatatttattatttatt

SEQ ID NO: 3271 - DNA, 300 bp, Homo sapiens
cctgtgtccaggccactttccaacacagctcggcagctcctcccataagagggagagtccctctggtcaccccttgaatcttggctggtcttgggacttgctctgacaaataggatatggcagatgtgacattacggtcatcctgaacctaggcctcaaggagccttgctgtttctgctcactctccaggaaccctgcctacgccatgaggacaggcccaggctagccttcggatgatgagagacctgtggccctgctaagcagcagacgtgagagatgccatcttggagctgctagctg

SEQ ID NO: 3272 - DNA, 300 bp, Homo sapiens
agacactttagcaactgcctaactatcacctgatggttgccttcctctcctgccctgctcatgtctgcttaactacctactctaacagcagcagcagcaggaataatagtactctttaatgataaactgccttggaaggccttatttgtacatgcaatgttgaatcttcagtttccaagtggaaaatgttggtcataagcatcttccttgggcttgttttctagattatatgtatagtctttttattttgaagtcatctaggacccaccgtaagttataagatactacagagaatttcca

SEQ ID NO: 3273 - DNA, 300 bp, Homo sapiens
ggagagagaatgtcttttcgaggcggaggtcgtggaggctttaatcgaggtggtggaggtggcggcttcaaccgaggcggcagcagcaaccacttccgaggtggaggcggcggtggaggcggcggcaatttcagaggcggcggcaggggaggatttggacgagggggtggccgcggaggctttaacaaaggccaagaccaaggacctccagaacgtgtagtcttattaggagagttcctgcatccctgtgaagatgacatagtttgtaaatgtaccacagatgaaaataaggtgccttat

SEQ ID NO: 3274 - DNA, 300 bp, Homo sapiens
gaaagcttcatgttccgcacctggggggcggatgttatcaacatgaccacagttccagaactgtcagaagataaatttctgttgttctcagccatccagtttgtggtactttgtaacggcagccctaggaagctgatgcaggtgggattgattcccctgctccagagaaaggactgttttcacagaagaggcgatgcttgaactgaatctgaagggatcaatgtggcttcccttggcaaggcatggagtgaaggtggagtatatcccaagtggggaggacagcacgtgacatggcgcagg

SEQ ID NO: 3275 - DNA, 300 bp, Homo sapiens
taattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgctttcaaatgcagtgg

SEQ ID NO: 3276 - DNA, 300 bp, Homo sapiens
ctgaagtgaggttgaggtgggtgcacggagcccccatgccctcagtgggtacaccagcctcccagcacttcctcatgttcaccaacacggaagcttatcagagcttgttgtttcagaactcaattgccagctcactgctgaagagattggtgggtagggctgaaagaaatatcagtgggtctttgtggtattcagccccatcctgagatggcctatccaggggctctataagaagtcacctcattagcataaactcacatgtgaccaaaaggatcttgttatgaataacaaaagatgttc

SEQ ID NO: 3277 - DNA, 300 bp, Homo sapiens
cagagatctgcaaattacagcccacatgccagctgcttgtttttgtaaataatgttttaccggaatccagccactcccacttgtttacatatcatccctggctgcttttatgctacaatgaagtggagggttgagtagttgaaacaaagaccttattgcttgcaaagtctgaaataaacacactcacacacactgatttatgtatagaatatgtatacaaatatatcttttatttatctatttttttgagattgagtctcgcttgttgctctgtcgcccaggttggagtgcggtggcaag

SEQ ID NO: 3278 - DNA, 300 bp, Homo sapiens
ctcaggagctgctgcttttcccatgcctgaaaatttttcagttaagttctggattttgtcacagaacatatgacctgcccttatgcataagtttgattgaattggaaaatcagcaagagtggcatgaaagaacctagaaatctgagtctggtcaaccatctcctctattgttcttactcttgattgtagaaccaaaggacaaccagcgttgtgattcatagggctgctcttgcctctgcaagggtggtccaaacatgattttagtggtaggttcatcatgggtatgcccaagcgatcaga

SEQ ID NO: 3279 - DNA, 300 bp, Homo sapiens
cccctgtgccccttccccaggaaatcaagtcctaaggaataagagtttgttggacagagttgagccttggagggacacaaaacattgtaatatctaagatttttttcatactctcccagaaagaaccaattttcaccctggggtggcggggtggtaaaattgcccctgttcagaatacatgctctaataagcggcagccatgggattttatcctaatactgagtctagatgccaaatctttttcaccctgtctcaaaacaaacaacaacaacagcaaaaagatcactttggctgttttta

SEQ ID NO: 3280 - DNA, 300 bp, Homo sapiens
caggtgtgagcccccacgccctgcatgaatatgtatttcttaatgttatcactcattgaaaagtttcttttaaaattatatatatggcccaatcttgaactatcttattttggaaggttttatctatttttaatttatgtcctcccgcctttctcatacccagctccacaagaaaatacagatctgcagaaaatgatttgaatgcctactttctcactcgtccaaggatgatgctgcatagctagtaccactctagatgcttggaagaaaagttaattcaatcaacagatagtgcattag

SEQ ID NO: 3281 - DNA, 300 bp, Homo sapiens
  misc_feature 124, 133, 135, 140, 142, 143, 144, 146, 151, 155, 161, 162,166, 177, 181, 186, 204, 237, 255, 264, 269, 275, 289, 294: n = A,T,C or G
attgcactccagcttgggcaacaagagtgaaacttcatctcaaaaaaacagaaacaaacaaaaaggcagctgggttgtcactgatgggcagcatttgagcctgccacactggcctggaaggtcnccttccagncnggatntnnnangctantttnttacanntaangctgtcacgantganacctngctatcactgtcagctgnatatggtcatcctatcacgacatgctatatggnccgtcaacagagggcccntactttacnagttnggaccnaacacacttcaggnctgancttggg

SEQ ID NO: 3282 - DNA, 300 bp, Homo sapiens
gtcgtcggttttctgagggtacttcagctgacagagagattcagagaacgttaatggaggtaatatttggtaaagggggtttataaagaaaccaatgtttattaaatgaagaactgaacattgcatatttgatagtcaaaatatatagaacattttaaatgaaatatgaaatttgaaaatattgtcaggaacaaacatgtttctctatcacaaactctaagaaaatgactactggaaaataaggctatctgccaaattccatttggtatacacctgtactattctgtgttttttgagtag

SEQ ID NO: 3283 - DNA, 300 bp, Homo sapiens
taacagactaaattttctctgtaagaggttatttcctagatagttaatatttttggtactactttgtgctgtattttataactattaaggaatgttgcagagaaatgctatcaattgttaaaattttgccatgaatacagcagcctcactgaattctcttagtagttctaatagcttgccatttgattctaacaggttttctatgtaaaagatggtgtcatcttcaaacaatgatagtttcatttcttctctttcacctcttaccttccttgtgtttctttagcattgggcaggtccttc

SEQ ID NO: 3284 - DNA, 300 bp, Homo sapiens
agtgctgggattacaggagtgagccacttaggctagccctgaaatgcttttgtttttgtttgtgttttttgttttttaatgaaaatacaggacatggagatgtggaaagacaccttgctttattactgttgttattattattattactacagtataattcatgtatcacaaaattcacgatttttaagcatacctttcagtattttttactatattccaaaagtttgcagccagcagcactacctaattccaaaatattttcataatgccaaaaagcatgcctgcacctatgggctgtca

SEQ ID NO: 3285 - DNA, 300 bp, Homo sapiens
caaacccctcctttgtactcgcccttcataatcacttttgcttcacacacataacctctgacagccactgatgtgctctttatgactatagttttaactctggaagaatgtcatgtaaatggggctctgtgttttgcagcatcatgcagctgtaacctttgattcagcagataacaatgtgcatggcctctccactcaaggtaatgcctttcagattcattcaagtggccgcatctatcggtagttctttccttttcattgctgagcagtattccatcacaagggtgtaccacagtttgt

SEQ ID NO: 3286 - DNA, 300 bp, Homo sapiens
cctaaagtgaagatggcagcctggaaagacgtttcaaggtcagtgtattagtggctcatgcctaggggaaggaataacatttggagcaaacaggagacaaattgaaaagcttcaggaggaaaggctaggaaataagattctttgggcgagaataaggactttaaagagattccacatattcctgggaatctgaaagaccatacacatgcctagggctgggcatgtgcttaaaaagacttgagagggccctatgctgtcacctctgcctgaccttcaggctctgtgcaagcaggaagtgaa

SEQ ID NO: 3287 - DNA, 300 bp, Homo sapiens
tcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattct

SEQ ID NO: 3288 - DNA, 300 bp, Homo sapiens
cagaggctgaggtgggaggatctcttgagcccaggaggttgaggctgcaatgagttgtgattgcaccagtgtactctagcctagacaacagaggaataacctgtctctcaagataaagaaataaattaattaataataataataattctataagtgtaatgaaagaggaaagggaaatcagtaataaggaaggacgtgtatttcaggaccattttaggaatcaggtggcatattgaaggttgatgatggattgagatttagacgttcactagggaaatatataggttaaagcatatgatt

SEQ ID NO: 3289 - DNA, 300 bp, Homo sapiens
caccccttttaggatttacattagttctgttccagtaaaggcttaggtaggaagcacaggatgtagagctgagttgaacctattcccctgatcttactaatgaggtgcctgatattcagagagaccaagggacatccccaaagtcaaccagcaatccattagagctgagcctagtaccttgattctcagacatgaatgctacttgttgaattgaaaattgcattcataatacatctcttcatagattcctggccaggaagccccagagaccaaaacagtctttatcaatatttagaatat

SEQ ID NO: 3290 - DNA, 300 bp, Homo sapiens
gtgaagtggagatatgtgattgaccttgttcttttatttgaaatatattttcctatgtcttcattttccttcactgtctgtggtgatttatgtacatcagataagacaaccacctctcccagtctcgtcagactggtctcatacaggagaaagatctcaacaatgtatcctgccagagattttaaggtccttctccaatctcaaaaacagactgctatatctcctttttgtggcccactggagcttagaatgtgttatgtcctgtcagtaccctcatgaatagtatggtaggagcaagac

SEQ ID NO: 3291 - DNA, 300 bp, Homo sapiens
ggtgtaaagatatccatgatgataatgagctgagtatatagttcattcttcagtataggaaattaaaatgtgagtttatcagaatgagtaacttaaagagaaattgcatatctcttttcctgcctttttaaatgtaagaatctctagaaatattttttgtttaaagtagtggtagagctgtaaagtgattgttttttaaataattatttttagaagttgtattttttgggttttttgtttttgtttttgagacagggtctcgctttgtcacccaggcaggaatgcagtggtgcaatcatg

SEQ ID NO: 3292 - DNA, 300 bp, Homo sapiens
tgaatctgtagatcagtttgggaaaaattaacatctcaacaatattgagtcttcaagtatatgaatatctctccactctacttacatctttcatttctcccagcagtgttttgtagtttttcgtgtataggtctttcacatcttttttgtcatgttatccctgaatgtttctcatgtttcagttctattgtaaatggtttccccggaccttcagctccatctcttccacccagggagtccactgggctcttcttcaccttcctgcccatgacctggagcctctccccaggcagtaagtgg

SEQ ID NO: 3293 - DNA, 300 bp, Homo sapiens
gctatgtgctgacaaatgtggcctactttacgaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgc

SEQ ID NO: 3294 - DNA, 300 bp, Homo sapiens
ccatgcccagctgtaatttcttattaggtgccagacattatgaattttaccttactgggtgttgggtacatttggatgtctttaagtattcctgagaattattctcaggtgcagttaggttacttatgaatagtctaattctttagagtcttgctttcaagctctcttagggcaggagcagcctttagtttatgactaatatggccctggtactgagacactaccattctaagtacctaaatacccaatgccctgtgtagcatgaggcatttcactctggctgataggactgtgaactag

SEQ ID NO: 3295 - DNA, 300 bp, Homo sapiens
ggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaaaccatggcttcaggatcatgactgaagtcatggtttcttccctgccagaaatgaaggttcagttatgaggcaaccctctagtaaggcattgtaaaagttactggatttggtttaataaaagttgaaata

SEQ ID NO: 3296 - DNA, 175 bp, Homo sapiens
ctgaatccagtcagacttagaagtagaagctcgcagagaggaaagtctgcgtctcttcgcaatttgttcctggcgcttctccttctaagtctgaatccagtcagaaataagattttttgagtaacaaataaataagatcagactctgaaaaaaaaaaaaaaaaaaaaaaaaaaac

SEQ ID NO: 3297 - DNA, 300 bp, Homo sapiens
aggacctccagttaaatttgaatttcagatgcctatgaatagttttcagtataagtatgtcccatgcaatacttgggatacgattgtgctgaagtggttttcattgtttgtctgaacttcaaatttaactggacatcctgtatttttatttgctgtcttgcaacttggttctgagagagagacccgagttcttcccattcacactgtgtgttgggcagggcatttgggccacttgatgttggctaggtaggttctcatcttgagaaaccaaatttctgattcccagctctgtgccggtac

SEQ ID NO: 3298 - DNA, 133 bp, Homo sapiens
  misc_feature 85, 96, 103, 104, 124: n = A,T,C or G
ctccaaggatcacagtaggatcctcgttggtgacagtcgaggccgagttttcagctggtctgtgagtgaccactccaggccgttntgctgctgatnactggtnngaaagatcaagcttacgaanaaccttctg

SEQ ID NO: 3299 - DNA, 300 bp, Homo sapiens
aagagaccatcatctcatcaaagagagttaaaagtagggatgttctctgcaaggcctcttctgatatgattaattgattgtaaattaagtaatcaaggcatactttgttgatttgtcatatctgggtaaaaggtttatggtttatttaataaatgaaactgcaaaatcagttttctacatttctgttatatttttgttaaagcacttaaaagaatttctgctctgtccaggggcaagattcttgccaagagaattaatgtgcgtattgagcacattaagcactctaagagccgagatagc

SEQ ID NO: 3300 - DNA, 300 bp, Homo sapiens
ggtcagcaatttgctttttctgatgagatcctggtgagagtcatgttcaataaagtatttagtcacgtggggctccagtgatttctctgtttacaagctcattccttcctcattttctcagaactttggtgttaacagcctgtttcctatttgtaggggctgactttgacttagcagatgcctttcgtgatggaggaaataacgacccagcacctcttaattcacccaagctgaagccaaatgcgaaccctgagcagcctggattcattgacgagccagcaccactgaacccacccaaac

SEQ ID NO: 3301 - DNA, 300 bp, Homo sapiens
ctcagcctgtggccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggaatgcctgaactagatgaatacaccatggagagggtcctagaggaatttgagcagcgatgctacgacaatatgaatcatgccatagagactgagg

SEQ ID NO: 3302 - DNA, 300 bp, Homo sapiens
gaaggacaaaaatatggctatctgaatagatgcagaagaggcatttgacaaaatctaaaatattaagtaaagaagattatattagtccattctgacattactataaagaactgtaggagagcagccccagtgcttatagataaaactcccatctccctaggacagagcacctgggggaatgggcggctctgggtgcagcttcggcagacttaaatgttcctgcctgccagctctgaagagagcagcagatcccccagcacagcgctcgagctctgctaagggatggactgcctcctcaag

SEQ ID NO: 3303 - DNA, 300 bp, Homo sapiens
tctagactctggtcgtcaggaacgggtcaaggccttcaccatgagaagagcaccaaagggagttaatatggggttgaccagaggtaggcaaaggaaggcctgtgggccaaatctggccagctacctgtttttataaataaagttttattggaacacaaccatgctggggtttgtttcatatttcctgaggctgttttcacactgcaatggcagaggtgagtggttgacacagatgccgtctcaccaaagcctatgatatttactgtctggccctatacagaaaaagcttgctgacctctg

SEQ ID NO: 3304 - DNA, 300 bp, Homo sapiens
gagatgtgtccagcgccccctgtggtgtgtgagagaaagcagctgcaactcaagtgactaggtgggcccagctggcttcgtgcaggagggcacgtcactgcatacgacccggccacccgtgttctgaaggacagcgccaaagatgggttagagtcactgctgtgggagtcttcgtccccacacagaggacaggctgctcagctccactgtgcaagatgatgcacacccagaccagtgacgtcaggacgatgctgctcacgacagcaatggtgaagatgcctaccgtggtcccatccttcc

SEQ ID NO: 3305 - DNA, 300 bp, Homo sapiens
gaaaggccagtgacatttcagtattagtgacatccagggttcgttctgtaatacttcaagagcgcggtgatcgtgatctcaatggcctcctctcttcactcgtccagctgctttcagcccccgaagcccgaacactgtttggcttccaatcactagtacagcgagagtgggtggcagctggacatcccttcctgactcggcttgggggaactggggccagtgaagaggctccggtgtttctcctcttccttgattgtgtctggcagctcctccagcagtttccagctgattttgaattct

SEQ ID NO: 3306 - DNA, 275 bp, Homo sapiens
  misc_feature 108, 118, 140, 146, 149, 153, 155, 173, 196, 199, 213, 214,215, 223, 237, 251, 254, 256, 262, 265, 267: n = A,T,C or G
gtacttcctaggagtggttgcatttgggaatggaattgttaaaacttgatgcttaggagcgaatgcagactattcattgggtgtttggggtgggggaagggggggtgntcaccccatngtccatcaccttcctcctctgntctggntgntaangnaagcccttccggttcccncaggctatgatgctgcatggcanatnctgttataactcannnctacatantggaaattttttanttttctaaataccnatncngttttnctncngttacaat

SEQ ID NO: 3307 - DNA, 300 bp, Homo sapiens
gcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttaccgtcgatcacaacacgctcgcaaagaaacagagttcttacggctcaaaaggaccagacttggcttggatgact

SEQ ID NO: 3308 - DNA, 300 bp, Homo sapiens
ctcagctcatgggaatctgcctctcactggtcctcactgggtttatcccagtgaccaattctaggatgaccagaagaatgattccactgggcttgggagtgtttgctggtacctctaatctctgtgtagagttcatggtacctgtgtgctctgtggctaggtcctcagagtcagtccctgggcaggtactgtcagccttcagttttccccacagactgtgttcctgggcctgaatcgctcagactacatgttccagcgcagcgcagatggctccccagccctgaaacagatcgaaatcaa

SEQ ID NO: 3309 - DNA, 300 bp, Homo sapiens
ctgccttccaacaaaatcgtctagcgggcagaggagttggtggggcaggagttgccttattcgctgaccagtgacaactgcgagcacttcgtgaaccatctgcgctatggcgtctcccgcagtgaccaggtgcatcttcagcctgcatccccttcccaggagccaggccactccctcagctgccagaggctgggtccctgctggggccagggtgggatggaaatagacatgagcaagacaaaatagcagatatgaaactgttgtccttgagggtgtcacatttggggtggggacaagggt

SEQ ID NO: 3310 - DNA, 300 bp, Homo sapiens
gccatacaagagactccagatatgcagctagagaaacttaaggaaggtgagcttatcaacgtgcattcagaaagtggttatgattacaagaatgaagatatcccagaggaattgacattgtcagaaaacttcacattaatcgaattctcagagatgtctcacaacattgaaagcacaaaagatgaaatgttagaagctggtgcacagtaaggataaaggagtatggcagttcaccaaggcatggaaaagatgcctgctccatattgttaagttatacagtgagaagaaggaggcgaacat

SEQ ID NO: 3311 - DNA, 300 bp, Homo sapiens
gtaaaaaccctctgatgcaaaaaaaagtattaactttcacaagctgtttgtactcaaatacattttctcagtttcagatcctctgctgttttattgagtggaaagttgagctaaaacggttcaagaagaataatgttgcatttccttatgtctcaggaaacactttttatggtaacttgtcagattgtctatgaacaaacccacttttttagacattgataaagtcttcttttcttcacgtgatattttatacaagagcacttcagatgtattagatgtgactgattttaacaaatccta

SEQ ID NO: 3312 - DNA, 300 bp, Homo sapiens
ctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccg

SEQ ID NO: 3313 - DNA, 300 bp, Homo sapiens
gaaagcagtggaccccattaataatcctggccaactctcgtagtggaactaatatgggagaagggctgttgggagaatttaggatcttgttgaatccagtccaggtaactaaagaaaaaaactttttatattaatgttttcattttccccaaaatgcaatgattattaatgcttcaagtcactaatcacctgatcataggaaagaataataattacaaaaagatcagccatttaaatatgtggataaacaggcactcttgtgggaatataaaatggtacaacctctttagaagacatctt

SEQ ID NO: 3314 - DNA, 300 bp, Homo sapiens
gagagtctcactctgttgctcaggttggagtgcaggcatgtgatcatagctcaccgaagcctcaacctcctgagctcaagtgatcctcttgccttaacctcccaagtagctaggaccacaggtgggcatgaccacacctggctaagttttaaaatttttctgtagaggtggtgtctcactatgttggccagactggtctcagatgcctgggctcagcagtcctcctgcctcaacctcccaaagtgctgtatgattgttttaaataggaaaaaatttagaattttataatatcaaggcact

SEQ ID NO: 3315 - DNA, 300 bp, Homo sapiens
ttctacttgtggactaattttggtgaccatctttctgtctctgcagtctcttaagcagattgactatgatgcatgtcacataaaacagttttctttctgttctattgtggagtttttctggggctggagaacattcttttgttatttccaaacactgtctataattaccagacatgatataaacacataaggtgccaactggaatttactctagaggggactttccctctcagacttccagtcaactcacacttgtgcaacaaagtgcatgctgtcccctaaatatgcaagcagaactgt

SEQ ID NO: 3316 - DNA, 300 bp, Homo sapiens
  misc_feature 96, 97, 108, 109, 119, 126, 127, 130, 131, 134, 135, 139,144, 150, 152, 153, 157, 162, 164, 167, 168, 169, 171, 227,228, 229, 234, 244, 245, 254, 257, 259, 262, 263, 264, 267,273, 277, 279, 280, 286: n = A,T,C or G
gctttaatttgtgttatttctttattgacgggaagaggtacatctttttttccttactgaaaacaaatatggattaattgcctcaaatttgcatanntgattggctanngattcttgcntgcaganngtnnagnngtanagacnctatcngnngcangccgntnctnnncnaccataagatcgtgcattatcctatgacaagatgaagcccacagatatgcccgagnnncagancacttcctgnncccctgcgnaancngannnagncctggncgtnannctggcntccctacgcgacac

SEQ ID NO: 3317 - DNA, 300 bp, Homo sapiens
aagaccaagcgcatgcgaacctctttcaagcatcaccagctccggaccatgaaatcctactttgccatcaaccacaacccggatgccaaggacctcaagcagcttgcccagaaaacaggtctgaccaaaagagttttgcagggagaacaaatcttggggcattacagccaaacatcccgacgtttgaaaattccctaaagtattaaaagaaggggaaaagtttgatcggaaatccactgcagtgaagacaaagacactattaggttatgataatcatacattaaaaaatttattaagcca

SEQ ID NO: 3318 - DNA, 300 bp, Homo sapiens
catcgatcttctggtggcagtcctccttgaagaggttgctgatgatgttgctgcccgagggacacaaattgttcttgagcactgaggtggtcaaagcagtcagtgttcttgagcactgaggtggtcaaagcagtcagtgtgctggagccacagcagtcaaggcctctagaactatagtgagtcgtattacgtagatccagacatgataagatacattgatgagtttggacaaaccacaactagaatgcagtgaaaaaaatgctttatttgtgaaatttgtgatgctattgctttatttgt

SEQ ID NO: 3319 - DNA, 300 bp, Homo sapiens
  misc_feature 229, 237, 241, 247, 249, 251, 288: n = A,T,C or G
ttcaggagttggacgactgctctttggccggattgcagattatgtgcctggtgtgaagaaggtttatctacaggtactctcctttttcttcattggtctgatgcccatgatgattcctctgtgtagcatctttggggccctcattgctgtgtgcctcatcatgggtctcttcgatggatgcttcatttccattatggctcccatagcctttgagatagttggtgcccangatgtctnccangcaatngnanttctgctcggattcatgcctatacccatgactgttgncccacccattgc

SEQ ID NO: 3320 - DNA, 300 bp, Homo sapiens
gtgtgggtcacagacatcaagtactttacaaggtaatagaatatcacaaggcaagtggaggcagggtgagatcacgggaccagggcgaaattaaaattgctaaatgaagtttcgggcaccattgtcattgataacatcttatcaggagacagggttttgagatcaaccagtctgaccaaaatttattaggcgggaatttcctcttcctaataagcctgggagcgctatgggagactggggtctatttcacccctgcagtttcgacagtaagagacggccacgcccagggggccagttaag

SEQ ID NO: 3321 - DNA, 300 bp, Homo sapiens
gacaaagcaaaacatcaacattaagtcataggctaggattatacaaatgagaacccccaccttatacattacttaatataagttaactacaaagagcctctccacttacatttttatcatgcatcttacattttaatgtccttattcttttatagaaaaggtcataatacccaataaaaaagaatctgtaatatccctgatgcagcaacaattgatcacatgctttcacatgtgaccacaataggaataaaataacagcgtaaagaaatttgaaagttgtattacatcattattcactgg

SEQ ID NO: 3322 - DNA, 300 bp, Homo sapiens
catccatgtaacgttgatattaaggccagcatctgggcccctgtgtcagattaacaagattttcttggagtattaactaacactttaatttaaaaaattgtaaaatattataaaaaagtttatagaaattatatgttatagtcaagtgattaaaatttaatagatttgtttataagatttgtgagacatttaattggcctcatgctgtctttatcagggcttattgtttggggaagtaagtctcctctctcaaagaataaaggtttttgccttttttttgaaatcttcgagttatcactt

SEQ ID NO: 3323 - DNA, 300 bp, Homo sapiens
ttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgc

SEQ ID NO: 3324 - DNA, 300 bp, Homo sapiens
ctgtgaagacctggaaacagacaaaaaagagcttgccaagctccagactgtccagctggatgaagatatgcaagacttatgaactttatttcctcctcacctctttttggcatcagcggcaaatcttttcatgaagccccaaggacacaaaacattttcccatttaaaggaaaacactctagttttgcaagtatatgcatacaagagactttagattgatctgcatgaagatcacagttaagtatacaggagtagaactgcattattgcagcctttttgttcacttataaatttctcttt

SEQ ID NO: 3325 - DNA, 300 bp, Homo sapiens
gtacccatatacacatatacacatatgtgtacccatatacacatatacacatatgtgtacccatatacacatatacacatatgtgtacccatatacacatatacacatatgtgtacccatatacacatatacacatatgtgtacccatatacacatatacacatgtgtacccatatacacatatacacatgtgtacccatatacacatatacacatgtgtacccatatacacatatacacatgtgtacccatatacacatatacgcatatgtgtacccatatacgcatatgtgtacccat

SEQ ID NO: 3326 - DNA, 300 bp, Homo sapiens
ggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcagcttttccagcgcgctcgtcatttccggactctctgctgcggaggggggcaataccagtgacacccagtcatccagcagcgtcaacatcgtgatgggcccctcagccagggctgccagccaggcca

SEQ ID NO: 3327 - DNA, 300 bp, Homo sapiens
aattccgttgctgtcgctcagcccgcctgcacccaggtgaaatagacagccatgttgctcacacaaagcctgtttgctggtctcttcacactgactcgagtgaaatttggtgccgtgactaggatcgggggacctcccttgggagatcaatcccccgtcctcctacactttgctctgtgagaaagatccacctacaacctcaggtcctcagaccaaccagcccaagaaacatctcaccaatttcaaatccgtgatagatcacaacaagagattatgaagagggcatggccgccatgtcat

SEQ ID NO: 3328 - DNA, 288 bp, Homo sapiens
  misc_feature 145, 149, 162, 164, 168, 174, 179, 184, 187, 210, 235, 238,245, 266, 269, 282: n = A,T,C or G
cccagctacatgggaggctgaggcaggagaatcacttgaacctgggaggtggaggttgcagtgagccaagattgcgccactgcactgcagcctgggcaacggacagtgactccatgtcaaaaaaaaaaaattaattaattgcctntggnttaaacgtaaaancntttnttggancagcntaaangcntaaaatctgtttttgttccaggnggttgttaacaggactcattttttnggnctttganaggatcccggttactcaacanaantgaaggaggaatntgtaaa

SEQ ID NO: 3329 - DNA, 300 bp, Homo sapiens
gtcagttgagagctgttcacggggccctgtccaagtgtcagtagaatcccacagttcctcacacagttccagagtcagtcctaggggaaaagaggctccctgcttgaggatgtttcctccttgcacttcccggagaggatgttcctgcataaaccatttccattttattatggaactattctgggcgctgccatccccatttgaatgtttctctgacatcatgtgagaaagcatgggtatttcaggtgtcaagatcattttatgtccttcagtcattagggatagtttcagttaatgtcc

SEQ ID NO: 3330 - DNA, 300 bp, Homo sapiens
ggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgcgtttgacacaggcttgcgggacgtgcagccctacctgtacaagatctccttccaga

SEQ ID NO: 3331 - DNA, 300 bp, Homo sapiens
gaagaactaatacagagagatattgtatacattttacctagtttccctcaattataacatctttgcaaactacaataccatatcacaaccaggatactgacattgatacctaagacaaagaagataaactgatagatttttaagtaacttttgtcttctttgtcagtgattgtcaattagagagagtcaggctatgagaggtaggctacctgagtgtcagaatgaggtaataagaataatgcttctcctcatctctactaaaaatacaaaattagctgggtgtggtagcgcatgcctgta

SEQ ID NO: 3332 - DNA, 300 bp, Homo sapiens
ggacagcatgagcggcggttggatggcgcaggttggagcgtgacgaacaggggctctgggcctggcgctgctgctgctgctcggcctcggactattcctggaggccgccgcgagcccgctttccaccccgacctctgcccaggccgcaggccccagctcaggctcgtgcccacccaccaagttccagtgccgcaccagtggcttatgcgtgcccctcacctggcgctgcgacagggacttggactgcagcgatggcagcgatgaggaggagtgcaggattgagccatgtacccagaaagg

SEQ ID NO: 3333 - DNA, 300 bp, Homo sapiens
  misc_feature 175, 177, 178, 180, 186, 193, 196, 201, 207, 210, 216, 223,224, 227, 233, 239, 240, 247, 251, 259, 260, 261, 266, 270,294: n = A,T,C or G
gactagaaagaggccctgccctctagaaagctcagatcttggcttctgttactcatactcgggtgggctccttagtcagatgcctaaaacattttgcctaaagctcgatgggttctggaggacagtgtggcttgtcacaggcctagagtctgagggaggggagtgggagtcttancnntntcttgntctaggnttnatggnaaccanttnttcacntttttannatnccttgntttatnncagtttntttngtctgttnnngagtntgtntgtctattttttattttctttttntgtttt

SEQ ID NO: 3334 - DNA, 300 bp, Homo sapiens
  misc_feature 142, 173, 177, 198, 236, 260, 267, 269, 275, 279, 285, 292,294: n = A,T,C or G
aggaagattagacactgtggccgagggcacgtctagaatcgaggaggcaagcctgtgcccgaccgacaacgcggagactcttctgatccaaccgctagaaccgcgttgggatacagcctgaactctgctgcagtgttcagantgtcacacagcccaactttagcccgcatctncaancaggctttctaccatacccancccacagcatctggtatgacagactcccggtttagctnacacctaactccattgcctattgntacttgncntttgcncatncatccnaaccttnanggtcca

SEQ ID NO: 3335 - DNA, 300 bp, Homo sapiens
gaaagagatctgacctaaccaactttatcttgccttaacttccaaactgcccttagtcattgatgggcatgggccaagctaacattgggagaaatttatttcatagtttaaatgataatagccctttcaaaaactaaatgtcctttgttaaattaatgaaaagccaccagatggggaggatgacaggggcctgaattctgctaagatgtaggcatagttaaatgattaccagtcattattctggaggtcccaatatttgcaatttccccaattacttctgtaaataacatcattattata

SEQ ID NO: 3336 - DNA, 300 bp, Homo sapiens
ctcaactttgtacctgtgtggctcctcttgttagtgcaatgttgactgttgaaaaagcagcagtatgcttacaggtttgcttagtttggggacaccgttaccaccagaatggctgctctgacaatatgcctagggactttctcatggcttttatttaataaggaggctgggcaccctataaagcctcatgcattcacacctttgcagcatggtttatgcctcagtgttatgtgcactggaatgttttccacttcacatttccaagtagaaatattagtgttacggaagtgcctaatatcc

SEQ ID NO: 3337 - DNA, 300 bp, Homo sapiens
ggaaaagttccaggaccctgagacatcttgggattcctgtggtttaggaaagacctttaactaccagctggtagttgtctcagcattcttcaaatagtccggtcttgtttaatattattattattattgttatttaattttattttattgcaactgtacttagagaatagtctggtcttgagaccttttcactgtggtctgttctggtgtacggctcccaccagtgtgaagcagaaggatgactttgctctgttgtcaggacaaccttgaaggaaggagccaaatgtgtggaggtctgtg

SEQ ID NO: 3338 - DNA, 300 bp, Homo sapiens
attcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtagtatcacgctggtatggagggattctgctaggaccagat

SEQ ID NO: 3339 - DNA, 238 bp, Homo sapiens
aattcaaggcctctcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcaggggaggtgtgggagg

SEQ ID NO: 3340 - DNA, 300 bp, Homo sapiens
cgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgaactggtggtgggagacaccagcgggaaggtgtctgtgtataaaaatgatgacagtcggccatggctcacctgttcctgccagggaatgctgacttgcgttggggttggagacgtgtgtaataaaggaaagaacc

SEQ ID NO: 3341 - DNA, 300 bp, Homo sapiens
atcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtg

SEQ ID NO: 3342 - DNA, 300 bp, Homo sapiens
acaaggacaagaaagaaagtacggttgcaacggctggctcgcatgcatgccgacatgatggaggatgttgaggaagtatatgccggagacatctgtgcattgtttggcattgactgtgctagtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacact

SEQ ID NO: 3343 - DNA, 300 bp, Homo sapiens
ccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattaca

SEQ ID NO: 3344 - DNA, 300 bp, Homo sapiens
taaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaat

SEQ ID NO: 3345 - DNA, 300 bp, Homo sapiens
agcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatct

SEQ ID NO: 3346 - DNA, 300 bp, Homo sapiens
gacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacat

SEQ ID NO: 3347 - DNA, 759 bp, Homo sapiens
  misc_feature 4, 6, 7, 11, 14, 469, 489, 495, 560, 601, 675, 691, 704,727, 745: n = A,T,C or G
aggntnnttcnaanagccaggctcttgttctttttgcaggatcccatcgattcggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcangtcgggtggctgcagggaantgcttncgcctgtataccgcctgggcctatcaacacgagcttgaggaaaccacagtgcctgagatccagangaccaacttgggcaatgtcgtgttgctgctcaagaacttanggatccatgacctaatgcactttgatttcctggacccttcaccatatgagaacacttgttgctggcttttggancaacttgtatgctctnggaaccccttaancaccttggggagcttaccacgtntggtccaaaagatggcanaacttgccggtgga

SEQ ID NO: 3348 - DNA, 725 bp, Homo sapiens
  misc_feature 2, 6, 7, 8, 9, 10, 14, 15, 16, 20, 22, 40, 322, 352, 454,469, 505, 514, 523, 639, 708: n = A,T,C or G
gnaggnnnnntttnnngggntntatgcagctcttgtcttntgcaggatccctcgattcgtttgaatatggactatagtttagataatagtcttaggtaatagttaaatgtcctgggtttgattattgtggttatatgggggaatgtccttgtactcagaagacatatgctgaagtacagtatttagagataaaagtgtcatgtttgcaactaactttcaaatagttcagaaaaaaaaatatgtatatatgtgtctgtgcctgtatatgaaagagagaacacaaatgtggcaaaatattaacaattggtgggccaggtatggngggtggctcatgcctgtaatcccagccctntgggaggctgaggaggtaggattccttgagcccagcagtttgagaccagcctgggaaacatagggagacgctgtctctataaaaaataataattcaatttanaaaaaattgatgaanataggtgaagggtatatgacctttcactacactatncttgaaatntctctgaangtttgaaatttatcaaaatataaaaattgagaaaaaattttcaaactgccacagtcaataattgaatttctcagcctgcacagtggctcatgcctgtaatcccgcacttttgggangccaaggcgggcagatcacttgaggtcaggaattcaagaccagcctggccaacatggcgaaccctgctntccaaaacccaaaaatt

SEQ ID NO: 3349 - DNA, 742 bp, Homo sapiens
  misc_feature 3, 4, 624, 678, 709, 717, 733, 742: n = A,T,C or G
ttnnaatacaggctacttgttctttttgcaggatccctcgattcgctgaattgtatccttgaaaaatgctatgttggaatcttaatccccaggacctcagaatgtgaccttacttattaaaaacagggtctttacagaggtgttgcagttacagtaaggtcattagggtgggccctaatccagcatgactgatgtccttaaaagggggactttggagagaaaaacatgctcaaggaagaggatgtgaaggctacgtgaagagactggagtgatgtgtctgcaagccaaagaacaccaaaaatcgtcagccaccacctgaagctggaagaggaaaggaaagatcttccctagggccttcagagggaacacggccttgatctcagacttcccctctaagaactgtgggagaatcagcatcttttgtttaagcctcccatgttgtggtctttattgtggcagcctgagcaaacacagtggctaaggaaactaatttcaatcagagacaatattcaaaattcagcactggatattggcaggactaggcactaaccagtcagaagagatgacagctttgaactactcacacaggtgggccactgtggggcacagagatgatgtattggnaaccaggagtcacataggacgatggctcaatgacatgagaaaacagggttgganggaaggaacttaagaatgctcaataccttgnaaatgggnacaaaagaaagattanttagatccn

SEQ ID NO: 3350 - DNA, 752 bp, Homo sapiens
  misc_feature 9, 12, 30, 688, 691, 693, 735: n = A,T,C or G
gaggggggnttnaagacccttgctacttgnctttttgcaggatccctcgattcgaattcggcacgagcctgcctcccattctatgcaaagtcatccctccgtgcactgagataaatgcttatctaattgcctcctttggagaggctcatcagaaactcaaaataatgcaaccatttgactctcacctacctgtgacctggaagatccctctctgcttgagttgtcctgcttttctggatggaaccaatgttcatcttacatatattgattgatgtctcatgtctccctaaaatgtataaaaccaagctgtgccctgaccaccttgggcacatgtcgtcaggacctcctgaggctgtgccacaggcatgcagcctcaaccttggcaaaataaactttctaaattgactgagaccagtctcagatattcagggttcacagtatccaaaaatccaatcacatctgaaaccgcctttgcaaaaattatcacagtgagaaaataatggcagtgaaagaaagctgatctagccaacctccctcttgcctttagctttcaagctgcttttacttattcctgggtttaagccaagctacatgtgggagtcatttagttgatagtttaaattataataaccctttcccgaaacttaaccacccttgtaatactgagagaccaccaggctaggagganganangagcctaaattctgctaaggggtagacaaaaacaattgtgangcgtttttcaaaagccc

SEQ ID NO: 3351 - DNA, 733 bp, Homo sapiens
  misc_feature 1, 2, 3, 7, 15, 679, 725: n = A,T,C or G
nnngggnggttttanatcagctcttggctttgcggaccctcgattcgaattcggcacgagaagaggaaggtaagtagataaatagggaagtaaaccaggtttctaattcatgggtgaatccgagagaataggtatcagattagggattacaaaatgtagcatgggtactaaatatcagtacaaagcagccacaataatattgatttatggatttaagtaacccgaccaaaccttgatgtatctcatcatgttgaatttctgctccagataataaagtattgtttgatcttgtgcattggccttttatttttcagaatgattcaaaggatggctttggggattcactgtaagattttttgtcatctaaattatacttgaggtggagaggcataatttaaacaacttcataggcaaagaaaagagctatacacagcagatcctggattaggaaaataaatacgttttattattcagaacatgcttttatgaactccttttaaaaaattgcaagccttgcagtgagctgagattgcaccactgcactccacctggatgacagagaaagacttcgtctccagaaaaaaaaaatgaactccagtacagataacccccgcggggccggagatttctaccttctgccttactcccatcagaagaatcgagtttatgcatcacagtnacatgtcactggccttcagcccccggcccatccgtcaccttgctgngtcgtgag

SEQ ID NO: 3352 - DNA, 750 bp, Homo sapiens
  misc_feature 2, 5, 8, 11, 17, 21, 613, 634, 665, 680, 692: n = A,T,C or G
gnggnggnttnaaatanacangctacttggctttttgcaggatcccatcgattcgaattcggcacgagctggtcagggtttgactcaggaagctgagttccagcttgtttccttggcagcactgccaaagagttagaccaagctgcagcttttgaggtgaaaggggatggaagaaagtactgttacttttccacttagaatttttggactttgttcttaatgaataggttcattttcaatttcaaagcaaagtgttaacatttttgaaatttgtctcaattctaaaggccaaacttaaatatgtctcctcctactggggcatggagcaagttattcatcaaatacagattctcgcatggaaaagaaagctaggatagtgtgtcgctgctgctctgtggcaaagaacagctcctttctaagcaacagcctcactctactagaataggtctgagcgcgcccattcatggctgattgcaacttccactgggtgggatttcagatctagaatctgttttcagatgccttaaagagaagacatagaaacacattcttaacagtttcaggggagatagttgggatagtttgtagttttgcttaagttatatgtgtctgntttctgcttttggtggtaacngactaacccttaatttgggtggttagagaantgatgggaagacctnaagaaagctcanatgacatttggctttgctttaaatgtgtagttttctctcacaaggctagtcagaaaat

SEQ ID NO: 3353 - DNA, 745 bp, Homo sapiens
  misc_feature 2, 3, 8, 13, 15, 20, 180, 305, 306, 307, 448, 483, 728: n = A,T,C or G
gnngggtntttananccagnctctgttcttttgcaggatccctcgattcgaattcggcacgaggtggcatttgatgctgtgggttggagcccagctttggggtcagacacacctgggtttgaatcacattgctgccccttccaggctcacatcattttatttcttttttctttttctttntttttttttttttgaggcaggagaattgcttgaacccaagaggcggaggttgtggtgagccgagattgcacctttgtctccagcctgggcaacgagcaaaaaactctgtctcaaaaaaaaaaaannnaagaaaaagaaaaatggcttccaggacagagcatgctcatttgctggcggacagttccagaaacagaccctgttagtccttctacttacctgctggatttttcaagccctaaatttataactttttgaaacaaaataatgngtaattttccatttgggggcaaactctattcttgngagcattattaaaatcttggttggtaaatatattggctttctcttaatattgctctgggtcaggaagaagctgttcacggtgtgataatactctttagatgggctttcattattatagatgcatcatgtcttctgctttcacgtgtctggggatggggtcaaaaatgcatccttcagctgacagaaaaatccaggatgagatccgaaggatactggggtttctgacttttccaaaatacttggtnggtttcattaaaaaaaa

SEQ ID NO: 3354 - DNA, 745 bp, Homo sapiens
  misc_feature 507, 616, 629, 651, 658, 670, 682, 694, 716, 719, 720, 721,722, 723, 724, 726, 736: n = A,T,C or G
cttggctttttgcaggatcccatcgattcgaattcggcacgagcagagcttagacatccaaaactaatcaatgctgaggtggctaaatacctagccttttacatgtaaacctgtctgcaaaattagcttttttaaaaaaaaaaaaaattgggggggttaatttatcattcagaaatcttgcattttcaaaaattcagtgcaagcgccaggcgatttgtgtctaaggatacgattttgaaccatatgggcagtgtcaaaatatgaaacaactgtttccacacttgcacctgatcaagagcagtgcttctccatttgttttgcagagaaatgtttttcatttcccgtgtgtttccatttccttctgaaattctgattttatccattttttaaggctcctctttatctcctttcttaaggcactgttgctatggcacttttctataaccttttcattcctgtgtacagtagcttaaaattgcagtgattgagcataacctacttgtttgnataaattattgaaatccatttgcaccctgtaagaatggacttaaaagtactgctggacaggcatgtgtgctcaaaggacattgattgctcaaattttaaggaaatgggnccaatgaaccgtnggttgtggggaaggggaaagangaaaccngagcttggtcanaatgtggaaatnggatctggtggnaataaacatgtttaaaaccaanccnnnnnnanaaaaaaaagncctttttta

SEQ ID NO: 3355 - DNA, 775 bp, Homo sapiens
  misc_feature 1, 6, 11, 13, 14, 647, 656, 673, 694, 726, 755, 764: n = A,T,C or G
nggttntttananncaggctcttgtcttttgcaggatccctcgattcgaattcggcacgaggtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgtattacttaggccaaaatctggcctggatttatgctataatatatattttcatgttaagttgtatatttttcagaaattataaatattattaatttaaaatttgaatttgtgtttgactaacaacctcgatgggatcttcttcaaccttccattaagatccctgcagnaagaaaatnggaaaatattcaaatanttgcaaaggtggtaaattggngaagaccaacttaattattaataccgtggttnaaggtttcttacttgggacccccattggnaaatggganttaaagaaaaa

SEQ ID NO: 3356 - DNA, 821 bp, Homo sapiens
  misc_feature 5, 7, 19, 77, 78, 81, 85, 86, 91, 92, 96, 98, 108, 114, 115,117, 122, 124, 131, 134, 141, 149, 156, 162, 163, 171, 173,174, 181, 182, 183, 185, 191, 193, 195, 199, 201, 202, 204,210, 215, 217, 221, 223, 225, 230, 231, 235, 249: n = A,T,C or G
  misc_feature 274, 281, 285, 300, 313, 329, 368, 377, 398, 400, 427, 447,463, 468, 469, 470, 489, 504, 505, 506, 531, 533, 537, 539,562, 568, 577, 587, 589, 592, 600, 605, 619, 630, 633, 640,651, 662, 664, 665, 676, 677, 687, 690, 696, 700, 708: n = A,T,C or G
  misc_feature 717, 720, 727, 729, 734, 738, 739, 749, 759, 760, 776, 779,785, 788, 789, 794, 798, 803, 804, 814, 818, 820: n = A,T,C or G
ggtangnatggggtttttncagcacttggtagttttgcaggatcccttgattcgaattcggcacgagcctgcatgcnntgntgcnnagtgnntgangnctgaaactcnggtatnncncatangnctgtgancantgatcantagggacntaagatncatatnntgctgctngnnactgaannncntgtggngntntagngnngntgtatncctcngngganantntccanncatngtggcaggcacctntagtcccagctactcgggaggcatnaggcaanagantggcgtgaacctggnaggtggagcttgnagtgaagccaagatcntgccactgcacttcagcctgggtgcagatgagactccgncttaaaaanaaacagaaaatacgctcaatnantaatacatttctgcccaagataagagncttcccttttgtggaatggntatgaaaaatattttnaagannnttttttaattaaccaatantgtcttgattacttnnncctttcatttgcctggatcatcatntnaatngnccttgggaaatgtgatgaaaaanggtaanccctttggntatggaatantngcntagatgancattngaattttagggganaagactattgnttngggaaancttgtaacttncttttttggcntnnaaaaattgtcnnagggttttanaanaaaaantttnggattggnttccgttgngtnattactngnaaatnctannaactttcggntagggcccanntttaatgaattttttntancccctntanntttcntaanctaanncttgtcaaanaaanant

SEQ ID NO: 3357 - DNA, 821 bp, Homo sapiens; identical to SEQ ID NO: 3356
  misc_feature 5, 7, 19, 77, 78, 81, 85, 86, 91, 92, 96, 98, 108, 114, 115,117, 122, 124, 131, 134, 141, 149, 156, 162, 163, 171, 173,174, 181, 182, 183, 185, 191, 193, 195, 199, 201, 202, 204,210, 215, 217, 221, 223, 225, 230, 231, 235, 249: n = A,T,C or G
  misc_feature 274, 281, 285, 300, 313, 329, 368, 377, 398, 400, 427, 447,463, 468, 469, 470, 489, 504, 505, 506, 531, 533, 537, 539,562, 568, 577, 587, 589, 592, 600, 605, 619, 630, 633, 640,651, 662, 664, 665, 676, 677, 687, 690, 696, 700, 708: n = A,T,C or G
  misc_feature 717, 720, 727, 729, 734, 738, 739, 749, 759, 760, 776, 779,785, 788, 789, 794, 798, 803, 804, 814, 818, 820: n = A,T,C or G

SEQ ID NO: 3358 - DNA, 747 bp, Homo sapiens
  misc_feature 1, 559, 648, 730: n = A,T,C or G
nggttttagatcagctacttgttctttttgcaggatcccatcgattcgtccaaccctggcgatgtcaccagcatggtggctcaggttagagctctctgaggacccagcatagagcactggtgccagggaccaaactgagaccccaccaccgtcatcaacacttacataccataaaggtcttcagagtgccttggccctagacctcccttcattctttgtagagatggaatctaagaatgaaacatctccactcagtcctgcaaatatggaagttcttgagatacctttttttggtagatacttgtgctggtattctgagagtcactttactctgatggtttgcaagattcctaaaatcaactccagagcttacaagacaggtttgagagagggagaaaggaaaaccaacttactggcccccatgccatcttttcccgtttagccattggtaggctgggctgcacctctgtcaagtgtcctcatggtattctctctgttcctctcctcaggccatgggtgtatatggagccctcaccaaaagccccagtgccagggactncagactcactcttcagtgggagcagcagagatgtccagggtacagatgcaagtcttgatgaggaacttgatcgagtcaagatgagttantggaactgggcttggccagggagtctggggacaaggaagcagatttcctgattctggctctactttcctgccaagatttggntttaatttttaattgga

SEQ ID NO: 3359 - DNA, 746 bp, Homo sapiens
  misc_feature 2, 4, 11, 49, 52, 55, 66, 68, 73, 82, 92, 93, 98, 110, 112,115, 120, 122, 128, 147, 152, 162, 164, 194, 195, 200, 201,205, 221, 229, 236, 246, 248, 255, 264, 267, 281, 284, 290,291, 296, 313, 317, 335, 339, 340, 347, 364, 366, 375: n = A,T,C or G
  misc_feature 389, 394, 400, 415, 419, 421, 435, 441, 452, 467, 479, 518,538, 549, 550, 600, 622, 625, 629, 640, 645, 650, 658, 660,663, 665, 674, 704, 706, 716, 726, 730, 731, 744, 745: n = A,T,C or G
gntnggttaanccagctcttgtgctttgcaggatcccatcgttcgaatncgnctngagagacagantnctgantggaggggntgaaacttcnnagggncacagagctgtncnagncctgngngctgcntatgagcactgggttcccngaganaagatcctcncnactaatactgggtcttcagagctttgcaanntggcnncaantgcttttcttgcccanagaataancagcatnaactccatangngctctgngtgaagcancangagctgatgtatancangtagcnncagcnattggaatggaccatanaatnggaaacaagtttctaaanccanngtagggntaggtgggagctgttancnaacggatgntctgaattaggatnatctntgtgangctctgaattgccanaatncnctcgttattggcancaggtnatagacatgantgactaccataggangaggttcgcttnccggatcatagatagcctgtctaatacctaactgattanaagatcctatcttgggattngcattcaaaanngacactggtgattcaagagaatcttctagtatatatcttagcacatattncgatggatgaaggtgcacattnacntatntatgaatccanaagtncctanggaacaantngtngnggatcttgnctatcaagtgttttagaggatgaccaattntnccggcttggngaccatttcnaagnntccttttgaagcnng

SEQ ID NO: 3360 - DNA, 761 bp, Homo sapiens; identical to SEQ ID NO: 540
  misc_feature 2, 4, 7, 10, 14, 565, 620, 651, 655, 660, 677, 679, 690,700, 703, 716, 729, 733, 751: n = A,T,C or G

SEQ ID NO: 3361 - DNA, 750 bp, Homo sapiens
  misc_feature 1, 4, 14, 560, 565, 569, 670, 683, 732: n = A,T,C or G
nggntctatagcangctacttgttctttttgcaggatcccatcgattcgaattcggcacgagctgggggtcctgcagtgcccgccttcttagctcagggcctttgcataggctgttcctctgcctgggtgcttttcctgctacttcccgtggctgcatttgcttaacttactcttctgatttcagtctcaatgctgcttccttaggggtaagccttctctgaccctacattctgtagagatacccccattctgccattctctcttttgtggcctgggtttcacttgtaactaagtcattatccctgtatttggtttgcttagtacatgtctgtcctcaagcaggggctggcttcaggctgctgacccgtctcactgctccttctcacccgctcctggctgtggcttctcctcgaggctggtgctgcacggggcgggcagtgcatggccatgtctccttgtcagcgtcctacttacaagttgaggaagcccacagccaggaagtgacttgtccagggtcacagggaatgtggagagagaataagaaggctctggcttctanggganggangcttataactctacactttcctggccaggatcaccagggtctgttggggaacacataagtccctgcctggatggtaacccttttgccttcttccaaatgtncaatgcctggaanacggtggcctgccgggggaccaaggaccaactttttatgcaggaaaaanccccggaacttctgggcc

SEQ ID NO: 3362 - DNA, 749 bp, Homo sapiens
  misc_feature 4, 7, 10, 18, 659, 686, 726, 731: n = A,T,C or G
gggnggntcnaaagccangctcttggcttttgcaggatccctcgattcgaattcggcacgagctaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccggatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacataccgttattgtacatttgtaaaccatttactgtctgggcaatagtgactccgtttaataaaagctttccgtagtgcattggtatggattaaatgcnttaaaatattcttagactcgatgctgnataaaatattatgggaaaaaaaagaaaatccgtattttgnctctnaacttttattgaagtttt

SEQ ID NO: 3363 - DNA, 796 bp, Homo sapiens
  misc_feature 2, 7, 8, 9, 10, 11, 12, 18, 37, 507, 566, 582, 601, 666,667, 669, 688, 696, 698, 701, 703, 704, 707, 723, 726, 775,780, 785, 787: n = A,T,C or G
gngtggnnnnnntttctnaaatagcgctcttgtcttntgcaggatcccatcgattcgaattcggcacgaggaaggggtttaaaaaggaaaaggtgtggaagagatgcaggagtggtgcaggtctgaatgtcttgttgtgatagttatattgagtaattgcccatctggaggtatggtttgtgtcatcttgacttcagctgggtaatgctaggctaactgttcgaaactccccccatgcaagaggagtctgcaactccatctctgcttggtttgtttcaaaactggcccctgaaatttctaagcaagtacgtaattagataagtgaacactgttcatggacatgcctggtgggaaagggagaaactaagggtttcaaagtatgcttccaggctgaaagcaaaaaggaaaaaaaaatgttctaaattgcattttgagggttggatactcggtctatgaaaagtgatgaattagcttctctattagtaagactttataacatctatatgnttttaaaatttttacttatttattgggtaaaagaagcatttaaatgtggccaagggctnttgacaaagttcttangtaaccaatgttagggaanaatgactttttggggcaactttttgggaaaaattgaccttgcttaaaaagccaaatttggttaanncnacccccaacccttgacaangggtttcngnaantnnatngggggcccgcccaaanggnggaaaccttggggttcccaaagaaaccttcccttgggggccccttgggncttancccantnaaattgggc

SEQ ID NO: 3364 - DNA, 979 bp, Homo sapiens
  misc_feature 2, 4, 7, 8, 9, 10, 11, 14, 15, 16, 17, 19, 20, 24, 27, 28,29, 30, 31, 33, 34, 35, 37, 43, 203, 238, 342, 352, 353,354, 357, 358, 368, 372, 374, 375, 377, 382, 386, 387, 388,389, 390, 391, 394, 395, 396, 397, 398, 399, 400, 401: n = A,T,C or G
  misc_feature 402, 403, 404, 405, 406, 407, 408, 409, 410, 411, 412, 413,414, 415, 416, 417, 418, 419, 420, 421, 422, 423, 424, 425,426, 427, 428, 429, 430, 431, 432, 433, 434, 435, 436, 437,438, 439, 440, 441, 442, 443, 444, 445, 446, 447, 448: n = A,T,C or G
  misc_feature 449, 450, 451, 452, 453, 454, 455, 456, 457, 458, 459, 460,461, 462, 463, 464, 465, 466, 467, 468, 469, 470, 471, 472,473, 474, 475, 476, 477, 478, 479, 480, 481, 482, 483, 484,485, 486, 487, 488, 489, 490, 491, 492, 493, 494, 495: n = A,T,C or G
  misc_feature 496, 497, 498, 499, 500, 501, 502, 503, 504, 505, 506, 507,508, 509, 510, 511, 512, 513, 514, 516, 517, 518, 519, 520,521, 522, 523, 524, 525, 526, 527, 528, 529, 530, 531, 532,533, 534, 535, 536, 537, 538, 539, 540, 541, 542, 543: n = A,T,C or G
  misc_feature 544, 545, 546, 547, 548, 549, 550, 551, 552, 553, 554, 555,556, 557, 558, 559, 560, 561, 562, 563, 564, 565, 566, 567,568, 569, 570, 571, 572, 573, 574, 575, 576, 577, 578, 579,580, 581, 582, 583, 584, 585, 586, 587, 588, 589, 590: n = A,T,C or G
  misc_feature 591, 592, 593, 594, 595, 596, 597, 598, 599, 600, 601, 602,603, 604, 605, 606, 607, 608, 609, 610, 611, 612, 613, 614,615, 616, 617, 618, 619, 620, 621, 622, 623, 624, 625, 626,627, 628, 629, 630, 631, 632, 633, 634, 635, 636, 637: n = A,T,C or G
gngnagnnnnnttnnnngnngcgnggnnnnngnnngntttttngatcagctcttgttctttttgcaggatcccatcgattcgcacactccaggctgagaaaagagtaattaggaggcctgaggaggggcccgaggaaaggctgttggggtgtgctggggttggtacccgagcgccttcccctcacctcaaccagagaagagcntccggttgctttttaaagcttttagcctgccctancaaggacaaagcatgttagattagagatgcttctgctgatcgcaggggttcttatttgaaaacatctatgatgggggtggggtggaaggaacaggttgtggttntgcaggaaannntgnnctaaaaattntgantnngngggtnaggnnnnnnatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 3365 - DNA, 715 bp, Homo sapiens
  misc_feature 7, 26, 642, 694: n = A,T,C or G
gcggtcnatgctgctcttgttctttntgcaggatccctcgattcgaattcggcacgaggtgtgagttgcatataacatatataaaagctgtaacctgggaaaaagttattatctggaagctttagaaattaatgttattctttcttaagtatcatcaggaaattaatcaaaatggccaccttgataccaaaaataaggttttggggcataacatccttatgaattcaaatgttagtcatttcacatatcttccactttatttcattaagtccttcctagtagacactgttcaaacattattcaccatttactaatgctgttacaacattattttagaagatggatatggatagctgttctagcttttaaagttttcagtgtaaagcaccatgtgctaaacattggccaggatattctgtatgaaatggctttagttacaggcctgtctgacaacagttttcatcagaaaagtatgcttattttcctttcttttagaaaatttggctgaaagcaattttggcaaagtcagcatagccttaagtgtcacatgagaaagatggaattgaagtggctgttaggtagacctgacctgggtatggtgactgtggtgacatgagtcctttggaggacacagcgtctctncagcatctctcttctgagggtcactctcttttgtaggggcttacccccttgncaatgctacacacaaaaaaaa

SEQ ID NO: 3366 - DNA, 726 bp, Homo sapiens
  misc_feature 2, 9, 15, 98, 100, 186, 209, 210, 217, 227, 242, 253, 265,293, 298, 329, 332, 339, 357, 445, 464, 503, 513, 546, 551,574, 615, 619, 639, 666, 695, 710: n = A,T,C or G
gnggttttntcttgngcaggatccctcgattcgaattcggcacgagcccctctccacattgacctctagaagtgggcctgtccaactcctaagtccancnttcccacaccgggcagaaagctttttactggccccgttgctcccgggtgaggcctaaacacttgatgatgatgaagatgaatatgngatgatggtagccatcacacagnntttcccntgtaaccctncgaacaaccctgcanggcaaatagtntcaccatcctcntttggcaaatgaaaagctgatggctcanagaanttaaatgacttgcccaaggtgactgagccantangccacanacaggctccaaatcccantctggaccgattggatgggcattcctgggtgggccggctccctctctggcaaggctgtcatgctcccccagtgccctggcttcagctntggctggatcagtaaaganccaagtcgaagatcaagtcagggaaaactcatgttttgnggctaagaantattgctacccttaatctcttcactttctcttnagctncatgaaggagcatttaacttttngaaggagtcattttccacaaaggaaacagttcttaaaaatnctgnggggttgggctcactggctnacacctggatttccagcacttcaggangccaagatgcagatcactcgagccttaanaagttcaagaacagncccgggtaacgtggca

SEQ ID NO: 3367 - DNA, 868 bp, Homo sapiens
  misc_feature 4, 85, 91, 93, 116, 121, 124, 129, 136, 156, 162, 163, 165,170, 174, 181, 191, 197, 203, 208, 215, 221, 224, 226, 233,234, 235, 236, 238, 239, 242, 244, 246, 252, 259, 262, 265,277, 283, 285, 297, 300, 301, 304, 309, 337, 338, 341: n = A,T,C or G
  misc_feature 346, 354, 355, 357, 362, 387, 390, 393, 410, 411, 415, 422,424, 427, 434, 435, 442, 448, 464, 490, 518, 525, 526, 527,529, 532, 535, 541, 546, 547, 551, 553, 554, 559, 564, 566,569, 600, 615, 619, 621, 624, 634, 638, 657, 661, 670: n = A,T,C or G
  misc_feature 671, 673, 678, 683, 695, 704, 712, 726, 740, 746, 750, 755,762, 763, 764, 773, 775, 778, 779, 783, 784, 792, 793, 794,795, 798, 802, 803, 804, 806, 812, 816, 818, 819, 821, 823,824, 825, 826, 831, 840, 842, 848, 850, 857, 858, 861: n = A,T,C or G
ggcnggtcttgcctttttgcaggatcccatcgattcgaattcggcacgagggccagtaggtgctaaggtggacaccaccccttcntccctntncagacccatcccaccaccgtggntttgnccnttccnagctgcntaatcactggaccacctggnattacnngngtganccancacaacngtcctgtacnctatgntggatncctanttagatntcctgnctntntggatannnnannacntnancagacnatgaacngtntgnacatattatatnacatgnangatggttgtganacnnttngtacngtagaagtgtctcttctgagcccattgnntcnttccnagatatanntnggacntgattttgacttgcattcagcattntanaanacttttacagttgatgnnactnattaccnancgnactgctnnttcattncaaatnattattcagggtaccnaagggtatttttctaaaccattgtantttataaatccaaggggaaatttccccnttccctnnntnttnttngaaatnttggnngccnanngaaanttttnanaanaaaccaatgggctttaaaaaaaatggggccnttaaggattattaanccgngnttnattttccaancagnagggaataaaaactgccanatgnggcccaatnnanacccntgatnaaagggtggtangtatgcctngggtattnaggagggatttaanttccctttgttttnccaccncttnttggnaaacccnnncgggtaaananggnnttannttggggtnnnnggnttannncncttttnaacntnnantnnnnggctncttcccgtngnatcctnancttgatnngancccattc

SEQ ID NO: 3368 - DNA, 737 bp, Homo sapiens
  misc_feature 2, 5, 6, 7, 8, 9, 10, 11, 16, 17, 21, 36, 542, 609, 672: n = A,T,C or G
gnagnnnnnnnttttnnaggngcgctcttgtctttntgcaggatccctcgattcgaattcggcacgaggtttctaagcacttcctgtattgcatatcaactcatttaatcctcacagcaatgtgagatacatactatcctccccattttataattgagggaactgaagcatagacaggttacatagctggtgactggcagatgaattgacttagccgtggtcctgcaggtgatgagtggcagcactgtgctcttatcaccagctcttgagcgtgctgcatcctctcatttgtcgttggtctcccctagtgttcagtactgtgccttgcacgtgtttatactcagtagcttttgaatgacagacttacattgcaaatacaacagatttccatgtcttattagaaactgcttttcttgaattactacatgtaacttgaaggattggtgaatatttacagttgttgaaatacaaaaacaggtggctgaacttagaaaccaccaagtggcaggtgactttgcctgacatccgtgttcacagacctncacagcccctggtgaaaaccacttcttcatgtcccacgtccatctaattacatgtgttattttttgncatttgcagagtcaacggttgcaggaaagtttgaaagaaagtgaattacatcaaaatcttggnatagtatataagtcatctggtttcaaaatataactttttttgaacctcagcaactttgaatggat

SEQ ID NO: 3369 - DNA, 835 bp, Homo sapiens
  misc_feature 4, 5, 7, 11, 394, 518, 532, 547, 552, 582, 614, 622, 677,680, 699, 714, 720, 726, 739, 756, 760, 763, 783, 793, 795,804, 819: n = A,T,C or G
aggnntntganccagctctgttctttgcggatccctcgttcgaattcggcacgagaataagcttttctttaaattaattagaaattacttgtaggaaatgtatagaataacaatgatcattttttttaactaaatgatttacaatagtgagaaagttgaccttgagttacatgttgaaagaatagtatgtaagctggcaacagaaattgaaattgagacagatttcagcaccactgttggtaacaggctcttattccagaggaaacatgtcagttttttattagtgagtaaaggatttctgcgaagctttaagaatatctcatgttgagtattgacatgtattttgaatgatgattttatgaaataacacttgggattatttttcttattctgnatcccccaaattaccttaaaaacttacatcttttgttttgggagggatcctttagcaaatatgccttttgtatgggaaagatccttttatgaaaggtatacctattaaatattttagtttctanttaccaatatcacntattccgaaggatantttantaaaaaattggccaaaggtccaggacctcnttttaaaaaccaaaaccttttaattttaaaangaatattnccaagggattacccttaggaatttaattcccaaggaaaaatcctcaattttccantcnatggtttttggccattttncttctttttaaaaanccaatngggttnaatggcccttggntaatttgggtaataatngccntanctggagtggacctggtaggnccttggaaantnccggatctnggggttacctttggnatggactgggataacc

SEQ ID NO: 3370 - DNA, 740 bp, Homo sapiens
  misc_feature 2, 8, 9, 10, 11, 12, 13, 17, 32, 82, 88, 97, 226, 269, 409,416, 466, 495, 576, 591, 594, 637, 702: n = A,T,C or G
gngtgtgnnnnnntttnttaaatgcggctctngcctttttgcaggatcccatcgattcgtgcacactaacatggcacctgcntaaaanccacagacnggtaactttagggacttcacagtggactcaagcagactgatcccagattgtaggtagaagtgtgtttgcaaaggccagaggagctgttaggacataatgcgatggagacaatttgcaacaatcactgantccacgtttctgctgtttaagggtggctgaaaggatggaggtntagcttgtaatgcaaaatatacgcagaggttcatagtgaagctgaggaggagggccttcaaaagttaagtgggagatgtttaggtcagtagcaaatgggcccagtgggagagagtatgcccagagtttggagagggtcanggtgtcnggtgctgggatgagggcttcatgtttggaagacgcaaggtagagagccangagaggaggaaaggtagaacaggatgganggcaagacctgtgtaagaagaagtcttaaactgtcaacccaacacaggcatgctcataaggaaaggttaaaaaaaaaaaanaaaaaactcgacctntanactatagtgagtcgtattacgtagatccagacatgataagatncattgatgaatttggacaaccacactagaatgcagtgaaaaaaatgctttatttgtgaaatttgngatgctattgctttatttgtaacctttttaacctgcat

SEQ ID NO: 3371 - DNA, 752 bp, Homo sapiens
  misc_feature 1, 2, 3, 8, 10, 11, 13, 15, 30, 50, 188, 272, 416, 447, 558,632, 645, 677, 683, 685, 697, 704, 712, 715, 733: n = A,T,C or G
nnngaggntnnanancagctcttgttcttngggcaggatccctcgattcnaattcggcacgaggctagttcgagttttttttttttttttttttttttttttttttaaataaggggcaagtttccaaagatcagtgtggagtgctacagaaataattataggagaggaaatcataatcacagaaggtntaatgcttgtttgaggctccggaataagaactaaaaaaaaaacaaaaaacactggtttcatgcttacggggtacacactttggngcatcccgtgaacacaaattttaataccaaacaatccttgatgcttcacctggggctgccaagcagtttgtaaaacagaggaaaacatttagtgcagtctgtattatccttttccaacttttctgtttgtgcaagtttttgaanattcattggccaaacaatgaacaacaaaggntttctgagagaagacaaggtggacttttcattttgttagtaaataccagtggcactgttgaacgaaacaaatacttttatctcagtctttcaaatcagtattaatgtctgngtttccttccactgacagctcttcttctagtttcactgaaaaaagggtgttagtatttttatcttggcactctnttccaaatccttnagcagctcctcttctttatattctgccacatngacctntnaaccggaattgncctttantttgccgnggngctttgaaaaatcccgtngttcttaaaaacttgttga

SEQ ID NO: 3372 - DNA, 734 bp, Homo sapiens
  misc_feature 5, 6, 7, 8, 9, 10, 26, 639: n = A,T,C or G
ggggnnnnnnttcttaatagtgcctngtctttgcaggatccctcgattcgaattcggcacgaggcaggtattatattatgaactactagcaattcgagagcctgcatcagtttggagaaagactatcaacctggaataacctacattgtagttcagaagagacatcacactcgattattttgtgctgataggacagaaagggttggaagaagtggcaatatcccagctggaacaacagttgatacagacattacacacccatatgagttcgatttttacctctgtagccatgctggaatacagggtaccagtcgtccttcacactatcatgttttatgggatgataactgctttactgcagatgaacttcagctgctaacttaccagctctgccacacttacgtacgctgtacacgatctgtttctatacctgcaccagcgtattatgctcacctggtagcatttagagccagatatcatcttgtggacaaagaacatgacagtgctgaaggaagtcacgtttcaggacaaagcaatggggcgagatccacaagctcttgccaaggcttgtacagattcaccaagataccttacgcacaatgtacttcgcttaaatagtccaagtatattctctgagangaagtactgaaagatgaattgacatacaacgtatgtttccagtgaaagtcaattgagtaaggacaccttcagccatacagaaaccaacactgtgg

SEQ ID NO: 3373 - DNA, 682 bp, Homo sapiens
  misc_feature 2, 3, 6, 7, 9, 14, 24, 32, 45, 71, 80, 554, 559, 595, 601: n = A,T,C or G
gnnctnntnagtgncatccgttcnatcggacnaggaaaaacaagnatactaggcttgtcaggtttagcccnatgtttgcnagctagctgctggtgcagaaatacaagacataaatattatttcgtagacagttattatttccttactgtgaatttagcagaatttatagaagtcttttgggtagtaaagctttggttaaattatttgtttttaaaaaatcgcagttcatgaaacatttctacttattaaatacaatgtgaatactatatctattcttgctactgggtcataattgttagccctctcccatgcctcttctcctcccctgaatataacatgcgtattagaaggtttctttgtgttggatgctgctcatgaaccatatgttaagaggttgtcatattcatgtatttaagccccattgtgtgttgtgatttcatgacttttatatctaaaaaaaccatattgtagatgttctttagcttgaaacacgagtgctttgaaattttccctttacctttctatttgggcattcagtaaatctacacatctgntttangctctagtttaaatagatgatgtgatgcatttctgngatggnctggttgctgatttttttggtaatggttttaatagtgaaatttctgggtcatgcttacctggtgagttggtaagtcgttat

SEQ ID NO: 3374 - DNA, 714 bp, Homo sapiens
  misc_feature 4, 5, 6, 82, 198, 705: n = A,T,C or G
gggnnnttgtctaatgcaggatccctcgattcgaattcggcacgagagtttccatttagtttgattttaaaagctgcctttntgaatatctaataccaattataaaataaatatgtgtaagtaaaataaaatggtaacttgttttttataagaggggaagttggttggttttataaattaaatgaacatttatgcggncggttatttttacgtaaaaatagttgttatattctaggtaacagaaatttagaaacctatttttctgtagaagaaaggtgttgctatctgcttttgatttctcagatatttgcttctccttagaatgctatgatcagatttttattagaatgaagttttctaaaggctttgattggcattagcttcattacttatttgcttaggttaagattagcccaatagacatattatctttatggaccattgcaaatttttctaatatctaaccatttttaaccttttatatatgaataattaaggaaacattcaattataataaaatttattcctggcactatgtaggcactcaataagtatttgttaattgagtaaatgatcccagtagataggtacatacaatatacagggaatctttttctactacgtgtgtttttcctcaaaatatttttttagttccacttcatcatgaaaatacttggaaactgacacccaagagaatcatgtttngggcacagt

SEQ ID NO: 3375 - DNA, 740 bp, Homo sapiens
  misc_feature 8, 15, 110, 543, 638, 662, 671, 679, 689, 691, 705, 710: n = A,T,C or G
tggggttntttaganccagctctgttctttgcggatccctcgattcgaattcggcacgagaattttccttatatgttctttgacccttgaattacttagaaatgtatttnttaatttctaaatacttacaggtttaaaaattttgttttcaattactaatttaattctgtttcatcagaaagcacgaccatcgtggcattgaaacttgagttatagcctactatcatgatcaatttaaaaaatatatatatagggctgggtgcagtggtgcacatctgtaatcccagtgctttgggaggctgaggtgggtgaatcacctgaggtcaggagttcaagaccagcctggtcaacatgacaaaaccccatccctacaaaaaatgtaaaaattagctaggtgtggtgacacacacctatcagttacttcagggggccgatgtgggagaatcgcttgatcttgggaggtcgaggctgcagtgagctatgatcatgccactgtctccacctgggcaacaaagtaagacactgtctcaaaaggaaaaaaanaataaaatatgagaaaggttatgatacaatgttaaatgccaaaagtaaaatgtaaaatgatagctagtgtttaatctcaatcatgtaaggaaaanaaaaaaaaaaactcgagcctctanaactatagngagtcgtntacgtagatncngacatgataggatncatgntgagtttggacaacccaacttgaatgcagg

SEQ ID NO: 3376 - DNA, 745 bp, Homo sapiens
  misc_feature 3, 7, 725, 730, 739: n = A,T,C or G
ggnggtnttttaacccttgctcttgtctttgcggatccctcgattcgaaaaaaaattgtggtgattcacacctgtaatcacagcactttgggaagccgaagcgggagggtcctttgaggccaagagttcaaggccagcctgggcagtataatgagaccctgtctctacaaaaaatttttaaaagtaaagaaattttaagataactaaatactacatagtcatatattttaaatatttattacataaaggtaaaccaaatagaagaggaaataatgttatgccctacttcatatgaccaaaaactggaagatagtgtctgaaaatgaaaatgattgtattgggaaggtagaattgtggccttttttttttttttttctcagttttcttctcattacattttcaatttagtctttgtatatagattttggtttattggagaatatataatgtgctctattaatgtttaagtcataaaaatataaatttcaagtaatttaagctccaatagttatctaacctgccttctaataaatgggaaataaatatttactttttgttttgataaacatatatttgttggcaactagcacatgattttaaaagtatagtggaactatacatttatgtcttaaaattaaaactataaagttatgtgactgggaaaggaaaaataattcattcaggattatctgacatcttagtattatagtagtggtaatactacnttttngggaaatgngtatcc

SEQ ID NO: 3377 - DNA, 748 bp, Homo sapiens
  misc_feature 2, 4, 7, 13, 15, 17, 18, 437, 564, 741, 748: n = A,T,C or G
gntnggntttttnananncaggctacttgtcttttgcaggatccctcgattcgaattcggcacgagaatccttcttgggaaacatgttattgtcctcattgtccagattagaaaactgagtgtaaagtaagttaaattatagtcctaaggttgaatgctaataaagacagaatacaagtccaatatattggactcaaaagccctcacttaactatggtctccatgggcttcccttggctctctctgcctttttttattttttcttattgcttgaggccctttctggaaggtaagtctggattatctacttcacactgttttagagaagacttgtggtttccatttaccccttactccctccgctccatggcctttcagggagaacactgtgggtatcatgctgggtggcctggagggtccaagtaacaggaatctanaaggatggaccagatgtgaacaaaagaaagcctgagtaggacacaaaacagagaagtggggctgtaacatctctaagatattacagcttgctacttccactctctttgcaaatgtggtgaaacccangctggagtcataaaataatagcataggatcattaactaaagtttgtctagtgcttccttgtgttcacacattatctcattgaacctctgacgatgctaggaggaggtaaatagggtttcctcttaccttgggtgaactgagtcttctgactaagtctcaggtcctttctaccattgngctgcan

SEQ ID NO: 3378 - DNA, 737 bp, Homo sapiens
  misc_feature 2, 4, 6, 8, 9, 10, 11, 12, 18, 21, 22, 338, 339, 341, 342,343, 344, 345, 346, 347, 348, 349, 350, 351, 352, 353, 354,355, 378, 381, 491, 578, 635, 656, 673, 707, 708, 728, 733,737: n = A,T,C or G
gngngngnnnnntttttnaanncgctcttgtcttttgcaggatccatcgattcgaattcggcacgaggcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtgggtgcacctcgcctgcatctgtcactcattccactacatcaagcacccggaataaagcccgcctgccccagtcggaaaaaaaaaaannannnnnnnnnnnnnnnaaaaaaaaaaaaactcgagcctntanaactatagtgagtcgtattacgtagatccagacatgataagatacattgatgagtttggacaaaccacactagaatgcagtgaaaaaaatgctttatttgtgaaatttgngatgctattgctttatttgtaaccattataagctgcaataaacaagttaacaacaacaattgcattcattttatgtttcaggttcanggggaggtgtgggaggttttttaattccggccgcggggccaatgcattgggcccggnacccagctttggtccctttantgagggttaattgcccncttgggggaaatcatgggcataactggttcctgnnggaaaatggtatccggttanaattncacn

SEQ ID NO: 3379 - DNA, 753 bp, Homo sapiens
  misc_feature 3, 7, 8, 9, 10, 11, 12, 13, 14, 15, 18, 19, 22, 23, 24, 25,26, 27, 28, 29, 30, 32, 33, 34, 36, 37, 40, 48, 61, 68,241, 317, 551, 614, 672, 691, 709, 712, 726, 736, 742, 751,753: n = A,T,C or G
agnaggnnnnnnnnnggnnagnnnnnnnnngnnngnnttntaatcggnatttctaatgctnggctctngttctttttgcagatcccatcgattcgaattcggcacgagccttcccaccttgtgagttctcccagcagttcctggattcccctgccaaggcactggccaaatctgaagaagattacctggtcatgatcattgtccgtgggtttggttttcagataggagttaggtatgagancaagaagagagaaaacttgggctgaccctgttatagtggttatagtggtgtccctaaagggaggaaatgatttcancaaaactggttgaacagcggatgaagatatggaattcaaagctctaatggacctttttgaagaagaagttgtggcttatgtgggagttacatgggcctctgatggaagaaactaatctgttaagtatttgtgcattttactaaaatggcagcttaaagttgtgtatctgctattgtgatgccaatgcccggtgttttaagtggaaaaaaaaatgacctctttgatttgtgctgngtacacaagaatttctgggaaaagtaaagaaaaacccttttttatggctcacacacttaagantagctgctcttaaacgtgcgctcacagttgaactgctttggttaattctaaataaatngttctttgaggaaaaaaanaaaaaaaaactcgacctntanacctatgggagtcntattaccgtnatccanacttataanan

SEQ ID NO: 3380 - DNA, 779 bp, Homo sapiens
  misc_feature 4, 7, 8, 9, 10, 11, 16, 24, 25, 26, 27, 28, 29, 33, 36, 40,41, 47, 48, 60, 339, 705, 708, 743, 747: n = A,T,C or G
gagnagnnnnnttttngaaagccnnnnnnaggnagntttnnagaggnntttgaagccctnctacttgttctttttgcaggatcccatcgattcgaattcggcacgaggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcangacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaaattaaattctccagaagaaactgcttttcagacaccaaaatctagccagatgcctcggccttcaatgcccccattagttaaaacattactggtttcttcaaaattatctacaccctgatgtttgtgaaccccattttgggacccccatttggcttntantggtaatggaatcggattggcttggaatttttggntgtnaacacctggctattgggcacccgcaaaagtct

SEQ ID NO: 3381 - DNA, 769 bp, Homo sapiens
  misc_feature 4, 8, 9, 10, 11, 16, 17, 25, 26, 27, 28, 29, 30, 31, 32,35, 38, 42, 48, 461, 531, 623, 633, 634, 643, 661, 670,676, 683, 709, 714, 731, 742, 755, 764, 769: n = A,T,C or G
gagnaggnnnnttttnngaaagccnnnnnnnnggnagntttnaagagnccttgaagccattgctacttgttctttttgcaggatcccatcgattcgaattcggcacgagggggcagtaaataataatagggaggatagaaaagtcagcatggcattccagatgagaaaactgaagcaagttaaactttctacatggtaaccgtgattatgtagttgatatacaaagtaatgactgtgggccttcaagaagaggtaaaatacattcattatattaacgagtgcatcttagaaagatttctttcaaaaagtagttgaagtttttttgctttaaggagtaaatctcaatcatctggaaatttaacttctgtggaatacctctttacatcttaaaggaaatgttaatgcattatattgaggttattattgcaatggaattttcaaaaatgtgagtgtgctctttntgtttctagaatctataagacacatatctggtctaagtatagtgtctactaagacaatttcacaatccanaaaatagttggttagccaaggatatcaagttcaaccccagagactagccaaagagggaaggctatgaaataaaaagcttatagatggctagnctcatatctnnggctttatncctataaaaggatctcangaaatatgnaatcanaaatatnggtatttaatctcctccttttttggnccatngcctctttagggccaanggtttttgggngaaatcattggtnggccaattnggttn

SEQ ID NO: 3382 - DNA, 754 bp, Homo sapiens
  misc_feature 2, 3, 4, 5, 6, 7, 8, 9, 10, 12, 13, 14, 20, 21, 22, 25, 26,27, 28, 29, 40, 536, 575, 728, 729: n = A,T,C or G
gnnnnnnnnngnnnaggttnnnagnnnnntttctaatgcnaggctacttgttctttttgcaggatcccatcgattcggtggtcctcactgaagaaagaaacattcttcctaaaagactttttttcctcagagttggagcccacagcgtggtcaggaaagagaagtagccactggtggctcctggcatcctcctgctgggcagccccttctcaaagtgtgaggggtccccttgtgtacaagcaggaagctctgagaaagtcaggtttgctcctaccacaggataattccgatgaacctgaaaagcgggttttggcttgtgtgcagggactctggtggaagaaagggtgacagcacctgcctgggcatgacacaagttaggacccgtaccaagaggccctggaattgagggtgggggttgctgtggactctttctccctcttaggaaactctattgggtctccatctgtcacagaagcagtaaatgatgtaggggctgccaggtatagggtcctgtggggatgctggaacatgccgangcaggacgtgccagccaccctctgcccatatgtgcacanggccacagatgtgcttgtcggtaggagagaccaagctgtctgtgtgcccatgtcttgacacctgagacttcaggttcaccccatcctggttctgccatttccatttgcaaggtggctttcccttccttttggggactctttaacgcctttggnnctgtttaaaaaaaaaaaaaaaaaaa

SEQ ID NO: 3383 - DNA, 742 bp, Homo sapiens
  misc_feature 2, 3, 4, 5, 6, 7, 8, 9, 10, 13, 14, 15, 17, 18, 19, 20, 21,22, 23, 24, 26, 27, 28, 29, 30, 34, 38, 42, 730: n = A,T,C or G
gnnnnnnnnnggnnngnnnnnnnngnnnnntttnaatngacnggctacttgttctttttgcagggatcccatcgattcgagtgcatccatgcgttttcacttgttcttaggctacttcatccaataatatatttgagtagttctgaacaggaacacaagtaaggagaatttttttttttttttctgatacagggtcttgctgtgtcacccaggatggagtgcagtggtgtgatcttggttcactgaaacctcaacttctgtggctcaagccatcctcccgctcaagcctccgagtagctgggactacaggcttgcaccaccacgcctggctaatttttgtatttttagtagagatgggattttgccacgttggccaggctggttttgaactcctggcctcaagtgatccacctgccttggcctcccaaagtgctgggatgacaggtgtgagccactgggcccacgtgagcagcatatttttaaaagctcccctgatgattctagtggacgagaaccaccagtctatgtaattatttgtctgtttagtgtctgtctgtcccgaaggtttagaagttacacaaggggagggactgtaaatatttgttgaatgaaaaatgaatgcatgggaatgaggatatttctttgcaatactgattttatttccttatacacccataaatgggaatgctggatcatatggagctctatttttaatgttttgaggaccctncatactgcttcc

SEQ ID NO: 3384 - DNA, 892 bp, Homo sapiens; identical to SEQ ID NO: 538
  misc_feature 8, 25, 27, 28, 30, 44, 45, 46, 47, 52, 54, 57, 109, 114,115, 119, 155, 180, 207, 219, 231, 304, 308, 310, 318, 374,379, 396, 397, 402, 411, 413, 433, 441, 442, 447, 448, 452,456, 475, 479, 483, 486, 491, 493, 494, 500, 501, 505: n = A,T,C or G
  misc_feature 507, 513, 515, 517, 521, 525, 530, 531, 532, 544, 545, 551,553, 556, 557, 558, 562, 563, 566, 567, 568, 576, 584, 585,587, 588, 590, 592, 595, 597, 598, 599, 600, 601, 602, 604,606, 609, 610, 612, 614, 615, 616, 617, 622, 632, 633: n = A,T,C or G
  misc_feature 638, 641, 644, 646, 649, 662, 668, 669, 671, 675, 677, 678,688, 697, 698, 701, 703, 704, 706, 708, 712, 713, 714, 722,726, 737, 741, 743, 745, 757, 768, 773, 774, 776, 786, 789,797, 799, 802, 816, 820, 823, 824, 830, 836, 843, 847: n = A,T,C or G
  misc_feature 848, 851, 852, 854, 856, 863, 868, 871, 873, 874, 878, 886,890: n = A,T,C or G

SEQ ID NO: 3385 - DNA, 749 bp, Homo sapiens
  misc_feature 2, 4, 21, 226, 363, 385, 437, 450, 460, 497, 510, 519, 544,572, 591, 614, 635, 637, 653, 657, 665, 679, 680, 688, 692,693, 707, 726, 732, 736, 739, 740, 747: n = A,T,C or G
gnanaggtctatgtggctctngttagttgtgcaggatccctcgattcgaattcggcacgaggatctactgccttagcaaatgtcatatatatgattacaagattattaactatagtcaccatgctgtaccttggaaaagaaaacctacttttcttgcttaagtaaaacttttacccttttcaaggactgggggaccttgagtatgtgcagattttggtacacgcanggggtcctagcaccaatctcctgcgtgtaccaagggatgaccgtgtgtatagaaaatcacatgtttattacccatgtatttgttgttggatgcttagtctgtttccatatctttctattgtaaatagtgccgcagtntacatgagtgtgcagataactnttaacaatactgatttcaatccctttgtggagttgctggatcgtattaattntggggggaacctncgtctgtttnccataatggctgtaccaatttacattcccaccaacantgtacaaagatgnccatttttncatgtctcactagcactcgggtgtntttttggtaatagcccttctaacaggtntcaggtgatacccttatcnaggttttgagtcaaattttccanatgatttaagaagttgacaantnttcatatcctgtcaancgtnagcgatgntttttttttatagnnagacaggntttnntctgttgtgcagantggtttaagatggtgcgancatggntcanttnntcctttncc

SEQ ID NO: 3386 - DNA, 722 bp, Homo sapiens
  misc_feature 2, 3, 6, 7, 8, 9, 10, 11, 12, 14, 16, 17, 18, 22, 339, 357,391, 408, 415, 419, 447, 464, 517: n = A,T,C or G
gnnagnnnnnnngngnnntttnagatacagctcttgttctttttgcaggatcccatcgattcgatcagtatgaactcttaaaacatgcagaagcaactctaggaagtgggaatctgagacaagctgttatgttgcctgagggagaggatctcaatgaatggattgctgtgaacactgtggatttctttaaccagatcaacatgttatatggaactattacagaattctgcactgaagcaagctgtcccagtcatgtctgcaggtcccgagatatgaatatcactgggcagatggtctaatattaaaaagccaatcaaatgttctgcaccaaaatacatngactatttgatgacttgngttcaagatcagcttgatgatgaaactctttttncttctaagattggtgtnccatttnccanaaactttatgtctgtggcaaagactatnctaaagcgtctgttcanggtttatgcccatatttatcaccagcactttgattctgtgatgcaactgcaanaggaggcccaccttaacacctcctttaagcactttattttctttggtcaggagtttaatctgattgataggcgtgaactggcacctcttcaagaattaatagagaaacttggatcaaaagacagataaatggttcttcttagacacagttcccccttgcttcatctattgctagaactatctcattgctatctggtataactagt

SEQ ID NO: 3387 - DNA, 764 bp, Homo sapiens
  misc_feature 2, 3, 4, 6, 7, 8, 9, 10, 11, 12, 14, 15, 21, 22, 24, 28,34, 38, 39, 41, 450, 575, 586, 621, 624, 630, 644, 669,756, 762: n = A,T,C or G
gnnngnnnnnnngnnggattnnancgantttgcnaatnnanagctacttgttctttttgcaggatcccatcgattcgaattcggcacgaggcggttgcggctggacacgggaccccagagcctgtctgggaagtcgacaccccagccaccatcaggcaagacaacacccaacagcggcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctactgccccttcgccatcctagantgaggctctgtccaatacatggctctgcctccagaacttcagctctcagtgacccttcgacatcctgcttgctcctgacttccaaggccccgtagttagcaattctggaaaagttaagccatctncttcctctggncctttccttctgggaatcttcaaaatgcctgttanggnccttcnttattggccctccntccttccttggcttcgggccttccnttaaaacttgaccaaaggggccttgttgcttggcccaactggggtaaacttttttacaaggttctttcccttttccactttcccctnaaagtntt

SEQ ID NO: 3388 - DNA, 764 bp, Homo sapiens
  misc_feature 2, 3, 5, 6, 7, 8, 9, 14, 15, 23, 30, 32, 33, 44, 50, 52,57, 61, 678, 691, 705, 707, 732, 748, 750, 752: n = A,T,C or G
gnngnnnnnttttnnaagaccangcctctngnnctttttggcangcagtncntagancttngtgcaggatcccatcgattcggaaaacatgagacatagaaatcattgagattcatcaagaaaatgtttaattataatgagcatgaagttagtaaaaggtggacatttgaagaaggtattaaaagaccttactttcatgtgaaacctttggaaaaggcacaactaaaaaactggaaagaatacttagaatttgaaattgaaaatgggactcatgaacgagttgtggttctctttgaaagatgtgtcatatcatgtgccctctatgaggagttttggattaagtatgccaagtacatggaaaaccatagcattgaaggagtgaggcatgtcttcagcagagcttgtactatacatctcccaaagaaacccatggtgcatatgctttgggcagcttttgaggaacagcagggtaatattaatgaagccaggaatatcttgaaaacatttgaagaatgtgttctaggattggcaatggttcgtttacgaagagtaagtttagaacgacggcatggaaatctggaagaactgaacatttgcttcaggatgccattaagaatgccaaatcaaataatgaatcttcattttatgctgtcaactacccggcatcttttcaaaatncagaaaaaccttncaaaatcaagaaangngctttttggaagcaatcgaaagagncaaggagaacacaagntntncctcaatttact

SEQ ID NO: 3389 - DNA, 800 bp, Homo sapiens
  misc_feature 2, 5, 6, 7, 8, 9, 10, 15, 16, 19, 24, 26, 28, 29, 30, 32,33, 34, 36, 37, 41, 42, 47, 48, 49, 53, 56, 58, 59, 61,229, 252, 267, 330, 468, 506, 594, 598, 626, 663, 692, 696,707, 716, 734, 743, 747, 777, 791, 800: n = A,T,C or G
gnagnnnnnnttttnnaangtccngncnnngnnngnntttnnagagnnntttnaancnncntgttgcaggatcccatcgattcgaattcggcacgagaacatctcctcttgtcattcctaggacatagacggttagggaaactctcatctttccttcaccacctcatgagtctaaaaacaatgataaacccagggaagcttgctgaaaagcatcctccatttggttatngctctttgtctaggaaaatcagnactcagctgtgaatngtggaccaagtggtgcagaactcattactttgaacaatgcctcctcggcctgggaagcatgtnctctcttctactagcaggggcttattccaggctggctttggtcacaaggaaaatcatttagacacagttcagtggtttcttattctgtctcctccttaccctgccctgcacccctgtccttaagagggaaaaggtggnaggtgctgtctggtatcattgctgcctcgccagtaganggttgcccgctgtgcaagggtaactgcccgcctgctcccttcctgacctcccctggaccccgaagatcacttacctctggtcattcangccnttgggggtacaatcctggataaagtcgngtcaaaaactggccaaatttcaaggacttgaaaatgnggttttttaaaaaaaccaaatcccttatnaacntccactttggnacctttaanattttaaaaactgggggnaaaaatggngaanattcctttgggacccactttttttaaattnaatttaagcccttnaatggaaan

SEQ ID NO: 3390 - DNA, 852 bp, Homo sapiens
  misc_feature 2, 5, 6, 7, 8, 9, 14, 15, 22, 23, 24, 25, 26, 27, 28, 29,30, 32, 33, 34, 36, 49, 52, 591, 609, 681, 717, 718, 719,720, 722, 723, 724, 725, 726, 727, 741, 771, 784, 785, 787,798, 799, 800, 808, 811, 825, 832, 846, 848, 852: n = A,T,C or G
gnagnnnnnttttnngaaagcnnnnnnnnngnnngnttttatagatcanttnacttgctctttttgcagggatcccatcgattcgaattcggcacgagcacattttcctgttttcttccaagccctccacagtgttccaacctctgccggttacccatttccaaagtcacttccacattttcgggtatccttatagcagcaccccactctaccagtccaatttactgtattaagtccattctcatgctgctataaagaactgctcaagacttgggtaaattattaaagggaaggagggtttaaattgacccacagttcctcagggttcgcaagggcctcaggaaacctacaattatggtggaagggggaagcaaatgccctacttcacatggtggcaggaaggagaagaatgagaaccaaatgagggagaagccccttataaaaccatcagatcttgtgagaacttactatcatgagaatagcatgggggaaactgccctgtgattcaattacttccactaggtcactccaccatacatggagattataggaactacaatttaggatgagaatttgggtggggaacacagnccaaaccatatcaaggtnttaaccagcaggaatttaacccaagcctgagggaaaagacttttcaagaagcttcaaaagactgggttcttnccaaaaattccaggttaggacccaaaaaatttaaannnnannnnnnaaaaaaaaaaaacnttggaagcccctttttagaaaacttttttngtggaagttcccnnantttacccgttnnnaattcccnagnacccttggaattangggaatncccaatttgggttngnaagn

SEQ ID NO: 3391 - DNA, 852 bp, Homo sapiens; identical to SEQ ID NO: 3390
  misc_feature 2, 5, 6, 7, 8, 9, 14, 15, 22, 23, 24, 25, 26, 27, 28, 29,30, 32, 33, 34, 36, 49, 52, 591, 609, 681, 717, 718, 719,720, 722, 723, 724, 725, 726, 727, 741, 771, 784, 785, 787,798, 799, 800, 808, 811, 825, 832, 846, 848, 852: n = A,T,C or G

SEQ ID NO: 3392 - DNA, 879 bp, Homo sapiens
  misc_feature 2, 4, 6, 7, 8, 9, 10, 13, 14, 15, 16, 17, 20, 21, 22, 23,24, 25, 26, 27, 29, 30, 31, 37, 187, 215, 217, 219, 228,237, 280, 334, 349, 373, 375, 387, 422, 446, 455, 464, 493,503, 519, 531, 567, 573, 599, 616, 654, 689, 718, 842, 878: n = A,T,C or G
gngngnnnnnttnnnnnagnnnnnnnngnnnggtttngatcagctcttgtcttttgcaggatcccatcgattcgaattcggcacgaggttgtattggaaagcagtagtgtggacgaattgcgagagaacttagtggaaatcagtgggattcctttggatgatattgaatttgctaagggtagaggancatttccctgtggatattctggtccttngntnttcatccangaatttaanaactgggaattcctaaaagttttcttaccccttgaaatggtcntgggcccctctttttaataatcctggtggaatggaatgggttgcccggttccantaattttttaattangggggatttaaaaaaccaagaaangnaaattttaaatngggaaaatttggaaccaggaatggaagcccaaaangaaaaattggaaacctgggattgnaaaaaaaanggaaaaagnccagttccgaactttcccagaaaagaacntggggaccanttcgggggttaaccantaccttcaaccntcggttaaaaggaggaaaaggccaccttaaaaaaantattantcttgggattggaagccaccccaaanttaaaggaatctggacntcaaggactggacctctggataggtggtagccattttnccctggggggaagtttttggttttaattagatggntcacttccactgggtagtgccattttggnccggacatggttggggtacccatgacccacactgatggactgcctacccatcagaactcatgcccaatggccctggtttgactcggatcatgttggcctatagtcaaatgtctgtaagtgaaanggatgtgcaaaaataaaaaaaccccaaaaagctccna

SEQ ID NO: 3393 - DNA, 797 bp, Homo sapiens
  misc_feature 6, 7, 10, 17, 18, 169, 180, 203, 232, 258, 283, 322, 352,388, 395, 412, 417, 427, 462, 467, 501, 549, 559, 563, 578,587, 661, 665, 674, 687, 701, 742, 781, 793, 795: n = A,T,C or G
attttnnaanctttatnncattttgctacttgttctttttgcaggatcccatcgattcgcacactccaggctgagaaagagtaattaggaggcctgaggaggggccgaggaaaggctgttggggtgtgctggggttggtacccgagcgccttcccctcacctcaaccanagaagagcatncggttgctttttaaagcttttancctgccctagcaaggacaaagcatgttanattagagatgcttctgctgatcgcangggttcttatttgaaaacatctatnatggggtggggtgggaggagacaggttgtggttatgcangaaaatcttgtcctaaaaatatatgacttngggggtaaggggtgggatagccaagcaaaatcactnattattntaaaatgaacatatgtnttttnattaactttnagttaaatacagattttacaactaggtcagcatangcctnaatctatatagagggctaactcaggcattgtctngtttatttggtagactggattcaaaacaacctgtcctgttttgtcagntcccagcttnttcntttagaataaattanaccaaaagnaacaaactgtgctcgctcttgtatacccgcagaatgaactactgttgtaaaactggattttttcattatactangttncgaaaagcnagatgcttggtanatgtacaataccangatcctttttaaattgaatggggtgcatttaaaaatcctcncttaacatttctaagaaagaattgtttcaataaaataantggaatcttcanangg

SEQ ID NO: 3394 - DNA, 724 bp, Homo sapiens
  misc_feature 3, 6, 7, 8, 9, 10, 11, 12, 16, 17, 22, 30, 31, 46, 203, 232,233, 234, 270, 285, 295, 320, 323, 332, 335, 337, 345, 347,368, 397, 398, 402, 403, 408, 413, 441, 453, 475, 477, 516,519, 554, 560, 607, 612, 646, 659, 672, 683, 693: n = A,T,C or G
  misc_feature 696, 714: n = A,T,C or G
ggnagnnnnnnngggnntttcnacgtgaannccttgttctttttgnaggatcccatcgattcgcacagatccaggaaaaatcaaacgtattagaggaatggcgtactctgtacgtgtgtcacctcagatggcgaaccggattgtggattctgcaaggagcatcctcaacaagttcatacctgatatctatatttacacagatnacatgaaaggagtcaactctgggaagtcnnngggctttgggttgtcactggttgctgagaccaccantggcaccttctcagngctgaactgnggcttcaacccccagggccagggancancagtacttncanangaccttgncntgaactgtgcccggctgctgntggatgaaatctacaggggtggatgcgtnnactnnaccanccaangcctggcgctactactcatgacccttgnacagacgatgtntacaaagtcctgctaggccctntntctcctacacgatagaattttgcggcatttgaagagctnttnccacattatgtttaaaattgaaaccaagccatgtngtgaanaactcaaggtggggataaaagtgctgatgaccctgtgtggcattggnttctncaaccttagcaagaccctcaaagtgataaccatnacaaagataaggncccattgcctacngacaaagcaanagcttgccanggncccaatggggaccaagtncaattggttt

SEQ ID NO: 3395 - DNA, 721 bp, Homo sapiens
  misc_feature 518, 579, 643, 651, 682, 702: n = A,T,C or G
tatatatacagctcttgttctttttgcaggatcccatcgattcgaattcggcacgagctgggtctcaggcctttgaactcaaactggaactacatcactggcgctcctggtctccagcttgctgactgcagaccttgaaacttctcgggctccattaacctcttttatatatagagagagatacatacacacacacacacacaaacatacacacacacacacattggttgtatatctggagaatcctgattaatatacccgataaattcaaaacaaaacaaaacttgaaaaaaaaatttttcaggtgaatatttgttttttagcatctgagtttcagtccaaacagggaaggaaagagaggaagtgtcttcaaaaaatatagacaccccccaaaaatatattaaatcaataataatttagatccaagatgttattgatggttggagtatagaccactacccatacaaaaagcactgtaggaaatggagttcttcagagagtagaattgtggttccaanggctaggcaggaaggcagattgggaagatgtggcaaaggattcaaaatttcagttagagangagttaagtttgaagagctctattataccaaaatggtggacctatgggttaataaccaatgganttaatatncctcgaaatattgcttgaaaagtaggttttnaagtattcttggccccaaantaaaaaaaaactggggtct

SEQ ID NO: 3396 - DNA, 781 bp, Homo sapiens
  misc_feature 3, 11, 500, 600, 640, 671, 700, 712, 762, 767, 769: n = A,T,C or G
agngtttttanacccgctcttgttctttttgcaggatccctcgattcgaattcggcacgagaaacaatataactcaaatgcctttctacaggactacaaactgtctgtatcaggttatggggttaaatcataatttctggatcatgatcttaaacctttaattggttccatttctactttactctttactaacaagtatcctgatggcctgaaaatccatgttgaaatttgaagtttgaattttccagatcaaatatgaaatttattttcattttttaaagtacaaaatatcagttgtataatcatggtaaaacataaaattttgctataaaagatttttaaaggctatttgattaaacatttatttacttaaactctttgctagaattttttttagaattcagcatcggaggaggaatgtgacataataatgatcgaaagccgaaagtttaaaagttgtgatgccctcacatggttggagggttattctagcttctaanggactgaatgttgtccacaagaagtgtcatcagggtcataaattggtaaggacttaaatggcttaagaattttatggtattatacctgaaggttattggnatttgaggaatgaaatatttaatggaaccaaaaatggagnccccatttggggttaaagaagttttaggtantttaaaatttttaaggtttaaaaaccttngggaaatttttnaaaatacctttgggaagttattgttaaagccctttttcgaaaagtcctcntttgnanggccttgaaaag

SEQ ID NO: 3397 - DNA, 755 bp, Homo sapiens
  misc_feature 3, 5, 8, 15, 50, 325, 346, 563, 573, 630, 642, 645, 654,661, 671, 680, 682, 686, 689, 697, 701, 712, 715, 718, 755: n = A,T,C or G
gtngnggnttaatancagctcttgttggtggggaggatcccttgattcgnattcggcacgaggattttcgaaactcttcagctacttgcccttttttatctgaaaccatcataccttctgaaagaaaaaagcatatcttcattgacataacagaagtgagatggcccagtcttgatacagatggtaccatgatatatatggagagtggcattgtgaagataacatctttagatggtcatgcatacctctgcctgcccagatctcagcatgaatttacagtacattttttgtgtaaagttagccagaagtcagactcatctgcagngttgtcagaaacaaataatanagccccaaaagataaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggagggaagagctgccttcgcctggtacaaagcacacatgtgtatacacatgggtcaancagtgctggnctgtggctgcctgtccagaggaatggaaatatcctttggctttagcacttcattttntaataaaatcancantatgtcttnaaaaaanaatttaaaanaaaaacttnancctntanaactttangtgngtcgttttacntanatncaccttgataagaccattgatgagtttggacaacccn

SEQ ID NO: 3398 - DNA, 749 bp, Homo sapiens
  misc_feature 1, 2, 3, 5, 7, 10, 12, 14, 29, 707, 740, 749: n = A,T,C or G
nnngngnttnanancagctcttgttggtngggcggatccctcgattcgctcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcctcagtttttctacctctaaaggggtgggatggttcttcaaattgtttctaaaacaccggcactttcagcagtgttctggtggcctgagatgagagcaccgtgttcagaagtgcctgggagtggcacagtggaaactccgcttgcacggaccatggagtctgctcaggaccatgctgtaggacacacagcctcatgcgctgagaaagcaaaggaagtgctgggtgtaaagtttgcatgattccatgaagctttagttttcctttttttggtttaaaagaaagggttttatatgttctattgtaaaatatggaaattaaacagggacttcagaaagccgacagaaagatcaccttctgatggtgtgatgtgctcctgacattcnggccgaggctgtattctgaaaaagattaatggnctgtgaaan

SEQ ID NO: 3399 - DNA, 750 bp, Homo sapiens
  misc_feature 2, 11, 15, 16, 20, 21, 32, 35, 47, 48, 639, 646, 730, 750: n = A,T,C or G
gnagagggttnttcnnatannctgctggtggncangatcccattganncgctttgccattgtggctgtgcgagctcagcctcctggaaacccgccctgagcttggttaacagcattcactccaggtttagcccagctccaggttatcgcaggcaggactcccgagaacaggttcatgtttgctttttgggaggtgctgcgctaaagtggaaaaccaccctgggccgagtgggacctccccagctgggcggctgttaaccagccaggatgtctgaccctgagaagtcaccgtgcactcttgggactcattcttctcatcagcaggatggggtgatggagcgggccttactgggtgctggggatgatataaagaggtggcgtgtgcatgtgtgtgtgtctgtgtgtgggcgaacatgtttggtaagtgataggctctgcacacgtgcacggcaccatcatggttccctccctgcagcacttggcacgcagtgggggctcaaagcacaggccgactgatggcctggggttgcagccctgctccgtgtgtccctgggcacttgcttactgaccaccccacaggtgaacacgggcaggtgggtgtttggaggtgtgaggctgaagaaggtctggatcttgcaantcttgcncctggatagttatggggtctggaaggggcttttattgcgcctggtgctttctgctaaggccaaatttgggcttgcctgaccttngggttttggggccctcttan

SEQ ID NO: 3400 - DNA, 747 bp, Homo sapiens
  misc_feature 1, 546, 575, 669, 671, 695, 700, 704, 721, 747: n = A,T,C or G
ntctatagcagctcttgttctttttgcaggatccctcgattcgaattcggcacgaggccacggcgctcggcctgaattttttttaatacttaatttagatcaataacttcgactggtactgaaatttgcactcactttcagcttacagtttgggtaggactgctagacccagttcttttgtcatctcattcttagagagctcttgaaaaccaaagtatttaaaaccctgcaagtttctgtgcagatgagtgcaaatttccacccagcattggttcctgagtaattagaggaaggaagccatgcaaaagctgctattgcccaggctccagaaaaacatcatgtaaggtttgattccatactaattgttcaaagtgtaaaagaaagctgactgtggcagtttttacctccttttcttttttttccttttaaaaataatccagagacattaagcccaacagtttctctttgcttttttccctctctagcacattttcttgatgagtctaaggtgtgacctctactgaaatggctcccacccaccttctnctatggaagtggatccccagccccatctncttggacctcgtggctgtgtttagaaaattagcatcagcctaagccaggggcatcagcatggagccccctggtcattggctgattgccaccctntntctggtggaagcccgactagggantggtnggangtcaacctaaagttaangcaacctgatgaatggttattgactn

SEQ ID NO: 3401 - DNA, 751 bp, Homo sapiens
  misc_feature 2, 4, 5, 6, 7, 8, 9, 10, 11, 12, 13, 16, 17, 18, 21, 22,23, 24, 25, 26, 27, 28, 29, 30, 32, 33, 34, 35, 36, 37,38, 39, 40, 41, 42, 44, 45, 46, 47, 48, 49, 50, 51, 52,53, 54, 55, 56, 57, 58, 59, 60, 61, 67, 68, 91, 522, 530,594: n = A,T,C or G
  misc_feature 603, 630, 664, 673, 723, 751: n = A,T,C or G
gngnnnnnnnnnnttnnnagnnnnnnnnnngnnnnnnnnnnngnnnnnnnnnnnnnnnnnntttttnnatacagctattgttctttttgcngatcccatcgattcggccacatcgggggcaccaccctccatgcctttgcaggcatcggctcaggccaggctcctctagcccagtgtgtggccctggcccaaaggccaggcgtgcggcagggctggctgaactgccagcggttggtcattgacgagatctcaatggtggaggcagacctgtttgccagtggccaggcctatgtggccctttctcgggcccgcagcctgcagggcctacgtgtgctggactttgaccccatggcggttcgctgtgacccccgtgtgctgcacttctatgccaccctgcggcggggcaggagcctcagtctggagtccccagatgatgatgaggcagcctcagaccaggagaacatggacccaatcctctgagcctcacccacaaagaggagacaaagggtggcctgtggcctncccgtctnctgctcctagtggcccaaggccccagggaataactggagtaggcaggcaagtgtccccttctgnattttttanggactctaaccttctgcagggttaaanggagagtactttaaacccatatccactgtgcttnatttctctnctttgcctggtaactgctgtagggtagaagtacctttctgtgccagtganaatgacctgtgtggtactgatgtaaaan

SEQ ID NO: 3402 - DNA, 751 bp, Homo sapiens
  misc_feature 2, 3, 5, 6, 7, 8, 9, 13, 14, 21, 22, 23, 24, 25, 26, 28,29, 31, 32, 35, 38, 39, 40, 41, 42, 43, 45, 46, 47, 48,49, 50, 52, 53, 543, 646, 664, 670, 708, 749: n = A,T,C or G
gnngnnnnntttnnaagaccnnnnnngnngnnttnagnnnnnntnnnnnncnntggctctggttctttttgcaggatcccatcgattcgggaaaattgtaattctgaagtctgggtgaacctagcttgcacctacttctttcttgggatgtataaacaagctgaagcagctggatttaaagcttcaaaaagccgactccaaaaccgcctcctcttccacttggctcacaagtttaatgatgagaaaaaattgatgagctttcatcaaaatcttcaggatgtcacagaagatcaactcagtttggctcaatccactatatgcgatctcactaccaagaagctatagatatatataagcgaatactgctagataacagggaataccttgcccttaatgtttatgtggccctctgctactacaagttggattactatgatgtgtctcaagaagttttggctgtttaccttcagcaaattcctgatagtaccatcgcactcaatcttaaagcctgtaaccattttcgcctttacaatggcagagcanctgaggtattgatggaagtgtgtttttaatgtacttcattccaatttgaattactttatctttccaagttattcatgaaactctggtatctgtactcttgatnatatccctttatcattgncactgngatctataagacctaattatatgttatcaggtattctnaaaagaatgttgacttctgaattaaaaaaaaaaaaaaaaanaa

SEQ ID NO: 3403 - DNA, 765 bp, Homo sapiens
  misc_feature 2, 5, 6, 7, 8, 9, 10, 11, 12, 13, 14, 17, 20, 21, 22, 23,24, 25, 26, 27, 28, 29, 31, 32, 33, 35, 36, 37, 38, 39,40, 41, 46, 47, 48, 49, 52, 53, 54, 55, 56, 59, 67, 68,69, 70, 574, 634, 649, 737: n = A,T,C or G
gnagnnnnnnnnnnggnagnnnnnnnnnngnnngnnnnnnnagagnnnnttnnnnnccntttgtaannnnacagctacttgttctttttgcaggatcccatcgattcggtgatttactttctcattcaaaatacatattggatattgtatctaattttgtattggtaattttgggttatgaaaccccagatttgaagccccaaattgtatagggttcaatgcccataaaacccagatctgcccctgcttagaggccggcccctctaggagacagcatgtggggccacccagagatgcaggactcttctgttctgccctatcgcagcagagaggccatccctggagctggaaggtgcagactgggaattgctccttctctgaattgctagctcctgctaatgcctgcattgctgctgcaaaggatattcagaaaaagttgctcgtcagaaaaagaattcatgctagctctggccctgctgctgatgcattgtgtgaaacccttgagtgacttcacctcttggaactcagttttcccatttgtaaagtgatatcaatacttccggtgtgggctcangtttgggccctgtgaattgtaaagctctatgccatgggaggatgtatgattataagttgngttgctattacttgnattgctaaaatcttgctattattgaaaaatgcccaaaccttacatttcagtgactaaagagcaaaaccagtgttcactctgacatagnttttttaaattttcattcattcactcat

SEQ ID NO: 3404 - DNA, 763 bp, Homo sapiens
  misc_feature 2, 3, 5, 6, 7, 8, 9, 10, 13, 14, 16, 19, 20, 23, 24, 25,26, 27, 28, 30, 31, 34, 35, 36, 37, 38, 39, 43, 44, 45,46, 50, 53, 54, 55, 56, 57, 61, 63, 69, 92, 385, 461, 582,660, 671, 683, 707, 751, 760: n = A,T,C or G
gnngnnnnnnttnngnaannccnnnnnngnnagnnnnnnaagnnnntttnaannnnntttncnaatgcnaggctcttgttctttttgcaggntcccatcgattcgaattcggcacgaggtagagacggggtttcaccatgttggccaggatggtctcaatctcttgacctcgtgatctgcctgccttggcctcccaaagtgctgggattacaggtgtgagccaccacgcctggccggcttatttttatccacagtaaatcttcagcaactcattgtctccaccagatagtatttttctgtaaatgaaatgctgacttcgcctcttcctgctgtatgctcatccctgcactgagcacagatatgacaagcagtagccatgggggangtgggtgacaaagataggaccccgggagggggcgcaggtacatgctagtttcaattaccacagtattctagagacnggttgcaatgacaaggggggcaaatgaaatcaatgcaagatttcttaataatgggcagacagaaaaatgtaaaaccacacaaaacggactgctgataatattttaaaatatacttatttgncttctttttgcattgtgaaaaaacaaaataaattttgtgtgataattttgatgatgaaaggtggaaagttctacctanatttgaatgantgtttttttaangggaatgaaaatgtcatggtgctnaaccttgccaattagaagaatcattgaaaatgctgaaaaatttnacagtcttntta

SEQ ID NO: 3405 - DNA, 706 bp, Homo sapiens
  misc_feature 485, 679, 704: n = A,T,C or G
tatatatacaagctacttgttctttttgcaggatcccatcgattcgctccagcctggggcgacagagcaagactctgtctcaaatagataaataaataaaaatacaaaaaaaagaaactcaaggtacagtggtgggagtcaaaaaagcataagggagaaaaccaagactgaaaactgttattgagcttagtctgtgcctagttcagtccctagcattttacaagttttctctgagttaacaaacttgtgggggaaactgaggctttcagatgttgaataacttgtgtaagttgtagagcaggttcttttccatagttccgcattttttacctgcaatacagcaatgcggttgcccaggcccctcccaggagagttgcagcttccccggaggccacacttcttcaacaccttttgcctaaaggctctttttccctaaaggctcaactcatcccttgcaaaatacccaaagccaaatgagtctaganggtaaaccagccatgtaggatgtggacctttacaactgaaggaaactgaggtatttcaatatgatgaaatactctgtagtcattaaaatgatagatgtgaatgtgtagaaatatgaaaaagttttgggaaaaagttgcacatatctgaagaaaccaattgaaagcaatgggcatttattaatttattttggttntggtttttttttgagaacaagcccnct

SEQ ID NO: 3406 - DNA, 749 bp, Homo sapiens
  misc_feature 2, 6, 7, 8, 9, 10, 11, 12, 13, 14, 16, 17, 18, 19, 21, 22,23, 24, 25, 26, 32, 33, 34, 41, 43, 44, 49, 55, 210, 278,644: n = A,T,C or G
gnaagnnnnnnnnngnnnngnnnnnnagaggnnnttgaaancnnttgcnaatgcnaggctacttgttctttttgcaggatcccatcgattcgctgaataacaacctaactactacccctcaacctcacccccaccccaggaaaagtaagtctttttctaacgatccaccagattagggttacatttaacagtaactagaaaggttaattntaaccttaatcagaaagattaatttctgtcctttcagtcttctttctgtgctcataaataagcattgnttcttttaatcaacctgggcagtatctttctcattttaacagttgtctagagctcagttgtcccagcatttatttcactggtccctgatggatggagggtggtgttgcttcagtgtttgggcagtgcagacgatgttgagattcacattcggtctcgtctctttgttgttataggataagttctcaaaggtgggattcctagatccaaggcttctgacacacacactgctgattgaacctcagtggcagtgtttgagtgcacctgttcctcactcccatttcacctttattcacatgttgattcactcagcatttaatgagtgcctattatgtgccaggccttccttcagtgctggggcccttcancaatcaaggcagataaagattgctgttgtgagccatgtgtggtagtgtgcacctgtagtcttagctacttgggaagctgaagtgggaggattgcgtgatccccgg

SEQ ID NO: 3407 - DNA, 701 bp, Homo sapiens
  misc_feature 5, 617, 628, 666, 669, 681: n = A,T,C or G
aaatngctaggctacttgttctttttgcaggatcccatcgattcgaattcggcacgagggggccatagcctctattcctgcccagctgtggatcctcagcttgccatgttaggtacactggaccagcttgtggagccatagcccaggagctcagggacattgagtgcaggtttcttactcctacctgctggccctgtggctgtccctggtggccagcccagctgcagcaaaacctacaaagcctccagccatggtaggcgtcttggacctgccccagtcagctggggcttgggctgctaggggttttggcacacgtccatgtttggcggagggtgtgccttcaaaccctgaagggcctaatttcaccattctttctggctgcccaagggaacttccctgcttttctcccttgctgttggctggataaaactggcaatcagaaagtcaagagctacagctgatggtcatggtgttcccagagagtcaggaatatccatggaagctgagcagatgccctgttgctctcccatctcagctctttgattctgagaccatcatccgctcattgacctttgatcacaaaactttgaacttctgaattctgctccaaatccctngctcctttttnccctatccctgtgccaaccaggaagtttcttctatttncangcctcctggcanaagcaggcttccggttgttt

SEQ ID NO: 3408 - DNA, 697 bp, Homo sapiens
  misc_feature 584, 590, 648, 666, 667, 668: n = A,T,C or G
aaatagctagctcttgttctttttgcaggatccctcgattcgaattcggcacgagattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggcccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaacctttatgccacccgacacctgctgtaattggggtgcatgagctatggagtcagatagttgttggganggggangacaagaagtctattgtttggactgtgtttgctcacaatcaccacaaaataaaatgtngaaaatgaaaaaaaaaannnaaaaaaaaaactcgagcctttaaactttt

SEQ ID NO: 3409 - DNA, 757 bp, Homo sapiens
  misc_feature 2, 3, 4, 5, 6, 7, 8, 9, 10, 11, 12, 13, 14, 18, 19, 21, 24,26, 27, 28, 29, 30, 31, 38, 39, 45, 568, 630, 651, 719,722, 725, 747: n = A,T,C or G
gnnnnnnnnnnnnngagnnantcnannnnnnttttatnnatacangctacttgttctttttgcaggatcccatcgattcgaattcggcacgagctcattttattttgcatatattaaattgagtaggttcagctctaacataccttaagaaaaatgcatatcggtgcactgtatgtatttcaaaatgcctttcctatgattgtcatgtcctcctttaaggcttttccctcaaatttattacaaatttagtatttttagtacttgatgactctaattacatgaatgcacctggaatgacatttgtaacagaagacagtctgacttgctttcagtattcacaagttctttccagtttccaagtcttttcctagcagtaatttaggggagacagaggagtttcatgtaaagagcatgcagtttggagtcagaacctgggtatgactctgtggccttgatgaagcaagttacttaaactcttgagttttagctttctcctttacaatgcatgaatgcctatccccctacaaaacaaagattaaatgtgatgatgtatgccaaggggctttgnatattgtaaaagtgctatataattattaagatggtctaaattttcaagggatctaaaaccangggattggcaaaccgtttttncaggggagtaaatatttttaacgcttttgcatatattaaattaatggaaggtggttgaaaagggattnganttngaccactttgaaagtacctcanggataggggc

SEQ ID NO: 3410 - DNA, 751 bp, Homo sapiens; identical to SEQ ID NO: 539
  misc_feature 2, 3, 4, 10, 15, 28, 32, 485, 647, 651, 654, 669, 693, 750: n = A,T,C or G

SEQ ID NO: 3411 - DNA, 756 bp, Homo sapiens
  misc_feature 2, 4, 5, 7, 8, 9, 10, 11, 12, 13, 14, 15, 16, 17, 19, 20,23, 24, 25, 26, 27, 28, 29, 30, 31, 32, 34, 35, 36, 38,39, 40, 41, 42, 43, 46, 48, 49, 50, 51, 52, 53, 54, 55,56, 57, 58, 59, 60, 61, 66, 68, 69, 459, 593, 615, 653,691: n = A,T,C or G
  misc_feature 704, 722: n = A,T,C or G
gngnngnnnnnnnnnnngnnagnnnnnnnnnngnnngnnnnnnagngnnnnnnnnnnnnnnttttnannatacagctcttgttctttttgcaggatcccatcgattcgaattcggcacgagggtagaagaagaaatgattacgaaaatcctggataagccagctccctttcaaggggatcagtgtcctcagtcccccacccccacctaaaaagcaggtcccattcagcccagccagctcatccctgcagttccatccaggacctacaggtgtcgccctccgcatggcgaggcccggaagggcagctggctgcaggaggcagaggagtctggaccgctaacctgagcatgtggaaataatatatgtcttcaagtgaactgtctggtcctggagaaataaaataggacattcataagcagttcaccatctgtctttataccatcatcatcaacagcaagangaaaaatagctctttaaaatggatgaaagcccaagctgcagtaaccggaaaactgtgagctctgaataccaataaaggtagagaaatgattaaaaaacagagatgcaaactgaaaatttgtctggacagctcangcccacgatgctttgcaggcanggtgtgtttattggttccgaaagcataaagcaagctgnttaccaagagccagcctggggaaggcttggtctccggncctggaacacgtnggaaccagggcaaaatancttccgctttgaacaaaatctggtcccaccttac

SEQ ID NO: 3412 - DNA, 740 bp, Homo sapiens
  misc_feature 3, 4, 7, 8, 9, 10, 11, 12, 13, 14, 15, 16, 17, 18, 20, 23,26, 28, 32: n = A,T,C or G
ggnnggnnnnnnnnnnnntnttntananacangctacttgttctttttgcaggatcccatcgattcgccaggtctctccactgtcaagttactattattccctttataatttgcagtttaagatgaaatgcactagttttagtgcttcatctgtaaaactacttttttatgtgaatttattttttaaaaaatgtctgtcactaaagagaaaatcatcatcgcttggcatggataaaaacactaactgccaaagtcattaacttttggccaaataccaaagccagctaaagtcacagggccttggcctgtattctttgttaaaaagagattaacaactgtcgggtgataaacataagatataccagcaccaaactgaactttctcctctaaataatcataaggattgaccaaaaactgaaaagcaaattgcttgctcactatatgtgattccttgttacttagggtcacctccgtataccctctaaaattgttacttacatgctttgcagttggacatattttggtttaaatcccagctccaccaacacctcagacttcatctcctaagcctcggtttccttctctgtaaaacagggataatagtagcacctgcctaagggcttgtgcaaattagattgggatagtgaatgatgtatagttggtgcttgcttaatgaatgacgtggtcagtgtcaatggcgtgtcagaccctgaaggggctctagcccaggaagccttccc

SEQ ID NO: 3413 - DNA, 738 bp, Homo sapiens
  misc_feature 2, 3, 4, 6, 7, 8, 9, 10, 11, 12, 13, 14, 15, 17, 18, 20,21, 24, 37, 537, 569, 583, 641, 663, 671, 713, 721: n = A,T,C or G
gnnngnnnnnnnnnntnntnntgncgttctaatgctngctactcgttctttttgcaggatcccatcgattcgaattcggcacgagattacaggtgtggcgtgagccaccgtgcccggccaagctcctggccttcttattcacttgacagttttgagaatctttgatttcagggatgttgagagctgctcctgtcatctggagttgagtctcacccatgggctacagtgtacacaggagtgggaccttctgttcttgaacttaggctgtggtgtgatcacccttttctctgcatccacctgacaggctgggacttgggctatgctctggacaaggctggctggtgcaatgatgccctctagaggatggatcaggcccagtcaccacctcagattcagtgcctgctgctcttcctctttccacttggccctggtgacagacagatagaggcccagctgacgtgtctatcggaacgactttatttcagtacactgggccccaccaggcaatgtggtttgtgcgagctgtgcgagggacangcttgggctaagagaagggaggtgaagttggntaaacgcactgcantccgcgggcgctacgttgctttcacacatacctgcttcttgtggcccacacctggcangggcctttggcataggacggcntggggganaatcttgtgtgaagtctgggattggggtggggtcttggtgtncaggtganggtgccggtgaaaaaac

SEQ ID NO: 3414 - DNA, 733 bp, Homo sapiens
  misc_feature 1, 6, 16, 605, 691: n = A,T,C or G
ngaaancagctttgtncatttgcaggatccctcgattcgaattcggcacgagcccagaggccaccaatggcaatagtagccgaagcgtacctgtagttcagcttttgacatgtgtgtaaaacatgtccattaacatgtgcttaatctgttctgtgaaagtattttcagaaatgataaaaagtaatgatggttacatctgaatataagttagatcatgacactcactccttttttcagaaactaccagtggcatcacatcttactcagagtaaaaaccacagtgggcttactgtgggctgcaaggcctcgtaggatttgccccccatgactttctgacttcatctcttgtcacacatctccttattcgctccacgcgaagcacagtggctttttcactgattcttaaacatgccaggtacactggcctcagagcctttgcactggcttttccaggcactggcttttcactctgcctggaaagctctttcgccagatatttgcatggctagctccctcacattctcctggtgtttactcaaaagtcatgctctcagtgaggccttgtatcaccaccctaactaaaattatacccatttattccttgncttacatcttcctgcttatttggtcttagcattcaccattttcttatgtgcaacgtgtttgtgatggttatatcatttatttctgnctttccaattgggaatgtaagcatcaggaatcagattttgcc

SEQ ID NO: 3415 - DNA, 745 bp, Homo sapiens
  misc_feature 3, 20, 26, 30, 96, 117, 272, 551, 557, 606, 636, 642, 662,682, 705, 713, 727, 743: n = A,T,C or G
ggngatagcaggctcttgtnctttcngcangatccatcgattcgaattcggcacgagactccatctcaaagaagaagaaagaaaatgaaaaatggntgagaaaagttaagtaacgtnctgaggctggaggggccccgctcctcctcaccttggggagaaggacagcgtgaggctagcctgccctacactgggtggccccttcccctggcctgaagttgcagcacctgcaggctaaaccagcacatgcatgagggctgctgggccggggcttngggagcagccgatgcttctaaaaccctgctctgggtggactctagggatgcagtttgggtctgtgtctggggctggcagacaagcccacgtgcccacctctgcagaatgagaagtaagggtgggcaccaggccctgcccctcacgttctgctctttctctaagaactgcagaaccttggcaagccctttgcctctgcgtggggtgcccgtgtgcccctcatgaggataagcccttcgcccctgcgtggggtgcctgtgtgcccctcatgaggataagcnctttgnccctgcgtggggtgcccgtgtgcccctcatgaggataagcccttcgccntgcgtggaatgcctgtgtccccctcatgangataanccctttggctttgggtggantgcctgtgtgcccctatgangataaacccttttgccttctgcntggaatgnctgtgtgccccttnggttaagccccaatgnaa

SEQ ID NO: 3416 - DNA, 733 bp, Homo sapiens
  misc_feature 4, 5, 7, 8, 16, 19, 23, 24, 30, 502, 508, 591, 623, 626,635, 677, 695, 706, 721: n = A,T,C or G
gtgnnanncagctctngtntgtnngcgacncgatcgattcgctcagctgaaaattcttttccctatctagttttgttaaggaattcaacacatgccagttaagctgtcagaaatgaaataatctacctcgaggctgtattttaacagattattatatcgaaagaaaaaaatgaatgtttataaaataacatttctttttttttttttttgagacagggtctcacttggctcactgcagtcttgacctccaggctcaagtgatcctcccacctcagccttccgagtagctgggactacaagtgtgccaccatgcctagctaatgtttgtaattttttttttttttttttgtaaagatgtggggttttgccacgttgcccaggctggtctcaaactcctgggctcaagctatctgcctgccttggtctcccaaaatacttctgtaaatgtaagaaaaggggaataatgaagtaatagagacctctgatgattctcattacttgnctttgnaataagatcttaaaaaagaatgtgtggcaaacaaaggaaaataccagttctactaaataaatgtctgctctccctgaactctnccatcttttaaacatgaatctggattttctgnaanggtctcttnccctatccacccacttaaaaaaaaaaaaaaaactcgagcctntaaactatggggagtcgnttacgtgatcngacatgataagatcnttgatgagttcg

SEQ ID NO: 3417 - DNA, 719 bp, Homo sapiens
  misc_feature 4, 11, 632: n = A,T,C or G
ttcnaatagcnagctcttgttctttttgcaggatccctcgattcgaattcggcacgagagagggttggtgaaaattcagacagaatgtaacttgacaaagagaagacagcaacaactgtaacaattatcttatgaatatttgcgaactcaaagggatctgattggtgacctctgggctttatcaaattaacatcacaacttctagaagaaagtcaaccttcatcttttacaatagaaatcatatgttttgctaacccattcctatttaggctgaaaacaattaagagttatgggtacttaaaaaaatcattatgtttataaaattagtgatagaaggagcatagtgttcatacagtcacacacatacacttccttatttcttttatttaaactttgagtaacatagcagtctatgtttgggtcagttttcccttttttgtaattacattcagtggtttttgtaacttcattatttattgggaattaagtgatttagtcagtgggagttttgtaaaacttaagattttgggcatttttccccctcctcctggataaccagttaacccaataatggcttggcccgatggaagggtaaaatgaggacagttatattttttaaatgtcattactgncaccaaatcacacatatcattttctaagataaggaaattccaccattttttcaagttgcaaaaaagtactctggcttgcaggttata

SEQ ID NO: 3418 - DNA, 743 bp, Homo sapiens
  misc_feature 2, 3, 66, 737: n = A,T,C or G
gnngttaatcagctcttgtctttttgcaggatccctcgattcgaattcggcacgaggctcctggcntgaagaagatcaagttagacactccagaggaaaattgcacggtggagggaagaaagaaggaaaaactatccaactctggccaatattgaaaggaagaagaagttaaaacttgaaaaggagaagagaggagcagtattgacaacaacacaatatggcaagatgaaggggatgtccagacattcacaaatggcaaagatcagaagtcctggcaagaatcacaaatggaaaaacgacaattctagacagagagcagtcactggatcaggcagtcacttgtgtgatttgaagctagaaggtccaccggaggcaaatgcagatcctcttggtgttttgataaacagtgattctgagtctgataaggaggagaaaccacaacattctgtgatacccaaggaagtgacaccagccctatgctcactaatgagtagctatggcagtctttcagggtcagagagtgagccagaagaaactcccatcaagactgaagcagacgttttggcagaaaaccaggttcttgatagcagtgctcctaagagtccaagtcaagatgttaaagcaactgttagaaatttttcagaagccaagagtgagaacccgaaagaaaagctttgaaaaaacaaacccttaagaggaaaaaagattatcccactatcaaacgttattcgaccagnacacac

SEQ ID NO: 3419 - DNA, 731 bp, Homo sapiens
  misc_feature 3, 4, 7, 8, 9, 10, 11, 12, 13, 14, 15, 16, 27, 28, 51, 621,658, 690, 707, 712, 720: n = A,T,C or G
ggnnggnnnnnnnnnntttcaaatagnnagctacttgttctttttgcaggnatcccatcgattcgaattcggcacgagcaaaggtgatctcaggaaaggtctaagctagtttacagtatgcccatttcctgtgtaaaccatttaatttaaatgactctgcttgtctcactgttatgataaatttgtgtggtagatcgcagcctgttagctattactggaagttttctgcttttattacaggcctctcaaataggtaggttttaacattttattggaccccctgccccttcccaatttcaactattaaatccttaaatttgttgttttggttatgcagaagttagttatcaggttatatggttcccaatgagtgaggaaattgggaaggttttgtgttttttttgtcttgttaactagaaatgggttttgtagtttagcttaagggccccaacagcttgtttgagaagacagctatggaacttgagctgtttacatgttttttaatactgcgagtgtattaggaaaattgtacaagtccttctcttggtctttaggacttaagtgagtttaaagagatgacaacatgtgttttccccaggtaagctttctttgaggatttgnctttcttttaaaaaaagttgcttgggcacggtggctnacacctataatcccccacttttgggaactgangtgggaggatacttgancctanggagtcanaaccagcctgg

SEQ ID NO: 3420 - DNA, 745 bp, Homo sapiens
  misc_feature 2, 3, 4, 597, 677, 730, 736: n = A,T,C or G
gnnngttagatcagctcttgttctttttgcaggatccctcgattcgctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcaggtgagtcaccatgaacacaacaggacttgagggccagctgactaggacaagacatgtatccttgctgccccggggcctccatgccgagactccatgccctgactccaacaggagcatcaccaaactacacctggaggaagagccaggacagaggaaatggccccgagaggaaacaaagctaggcacagtggctcacacctgtaatttcggaggctgaggcaggtggatcacctgaggtcaggagtttgagaccaacctggccaacatgacaaaaccatgtctctactaaaaatacaaaacttagccggatgcagtgccacgtgtctgtagtcccagctactcgggaggctgaggcaggagaattgcttgaacccaggaggtggangttgcaatgagctgagatcacaccactgcacttcaacccggggcgacagagcaagactccgtctcaaaaaaaaaaaagcnaaaaaaattaccaggcgttggtgaccacacctgtagtccagcatacttgggangctgangcaggaaga

SEQ ID NO: 3421 - DNA, 731 bp, Homo sapiens
  misc_feature 4, 8, 9, 10, 11, 12, 13, 14, 15, 16, 17, 21, 29, 363, 438,613, 730: n = A,T,C or G
gtgngggnnnnnnnnnntttnaaataganagctacttgttctttttgcaggatcccatcgattcgaattcggcacgaggcagcagcagcccgaggcctgaggagaggagaccggcggcggcgggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgangtggtcatgctttctgcgcactgggagaagaaaaagacaagcctcgtggagctgcaagagcagcttcagcagctnccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattcaagaaaaataagangaaggacttgaaaccttcaaagctgaactagatgcagagcacgcccagaagtcctggaatggacacacccacaaatgaactgaaggaccgcagaagttttttgaggaaccttccacng

SEQ ID NO: 3422 - DNA, 801 bp, Homo sapiens
  misc_feature 4, 7, 8, 9, 10, 11, 12, 13, 14, 15, 16, 27, 28, 30, 542,610, 662, 687, 695, 712, 716, 727, 735, 747, 751, 765, 790: n = A,T,C or G
gtgnggnnnnnnnnnntttcaaatagnnangctacttgttctttttgcaggatcccatcgattcgaattcggcacgaggaggaaagcggtgcgtgaggcgggcggccagggcacgactttgaagattatccaatgagaattttatatgaccttcattcagaagttcagactctaaaggatgatgttaatattcttcttgataaagcaagattggaaaatcaagaagcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagccggtcatcgtatcccaagttctaccaaacccttcacangcagtgaacaacttttaagggaagagcccgtaattgtaaccccaccttaccaaaccaatcacttagtnaaaagttcctaaaaaacttccaaaaatggtgccacttaaaaaatgggattgnatttttggaaatggtggtaaacttncctaaaanttaggaaccaccttttngggnattcttctggnaattattncctaatgggggntttnaaaatggaaagaantttccccccaattgggggacctttnaaaaaaatgcc

SEQ ID NO: 3423 - DNA, 841 bp, Homo sapiens
  misc_feature 4, 8, 15, 19, 27, 31, 45, 46, 51, 52, 183, 188, 238, 243,246, 254, 260, 264, 265, 270, 302, 328, 344, 347, 371, 374,382, 384, 388, 393, 398, 406, 409, 415, 417, 426, 438, 445,484, 485, 488, 494, 500, 509, 516, 524, 528, 543, 546: n = A,T,C or G
  misc_feature 547, 564, 575, 590, 591, 593, 597, 600, 638, 641, 644, 649,651, 654, 657, 662, 669, 680, 688, 693, 695, 697, 698, 703,706, 712, 714, 716, 736, 737, 741, 745, 754, 755, 756, 767,790, 796, 811, 812, 813, 814, 816, 825, 826, 830: n = A,T,C or G
tttnttantggggtnttcnggctttcnaatngcttggctactcgnnctctnngcaggcatcccatcgattcgcgccgggctgcccagcctggctctgtctacactggccgagtctctgggtctgtctacactggccgagtctccgactgtctgtgctttcacttacactcctcttgccacccnccatncctgcttacttagacctcacccggctccggacccggtacgggcagtctgnggcancangaatgaanggcgcnccgnnccctncttcataggaggctctgggtgggggcctgctncccatacccacaagctcacccagcantctcattgctgctgtnganttcagctttaccagcctcagtgtngangcttcatncnagcncacangcctngggcttgncangggccnanctggggctnggcccctgggtnttgaganactcgctggcaccacagtgggcccctggaccccggccgnncanctggtngactgnaggggcttntgactgngcacaggngctncccaacttttgttcnacnngcaataaagaatgggcntgaccctggtnattatatacttgggnncntaanggnggctaaaggcccccccattaaaatgcgcctaaactttnaanggntttgnanggnaantaaantgcctgnataatttaatnttaaaacnttggncnannggaanttnacctcntnancgaataaaacctgggcaacnnaaanttanttggacccnnnataatttttgntaaaaccccctttataaaacttngggatntctttttgggtaaannnnanctggccctnnggantcttaaaaccg

SEQ ID NO: 3424 - DNA, 1191 bp, Homo sapiens
  misc_feature 9, 10, 13, 15, 21, 25, 28, 247, 249, 250, 253, 254, 257,261, 274, 275, 276, 280, 281, 286, 290, 291, 292, 293, 296,298, 299, 301, 303, 304, 307, 313, 315, 316, 318, 319, 320,326, 329, 330, 332, 333, 334, 336, 339, 340, 345, 346: n = A,T,C or G
  misc_feature 347, 348, 349, 351, 352, 353, 364, 365, 366, 371, 374, 375,377, 381, 382, 385, 388, 389, 392, 394, 395, 396, 402, 403,404, 405, 409, 410, 412, 415, 416, 420, 424, 425, 426, 427,429, 431, 432, 433, 435, 438, 439, 440, 442, 445, 447: n = A,T,C or G
  misc_feature 449, 452, 454, 455, 457, 460, 462, 464, 466, 467, 471, 472,473, 476, 478, 481, 483, 485, 488, 489, 490, 491, 492, 493,494, 496, 499, 500, 503, 504, 505, 509, 510, 511, 512, 513,516, 517, 518, 519, 521, 522, 525, 527, 529, 532, 533: n = A,T,C or G
  misc_feature 534, 536, 537, 538, 539, 540, 542, 543, 544, 546, 547, 550,552, 553, 554, 555, 556, 557, 558, 559, 561, 562, 563, 564,565, 567, 568, 570, 571, 572, 574, 575, 576, 577, 578, 579,580, 581, 583, 586, 587, 588, 589, 590, 591, 593, 594: n = A,T,C or G
  misc_feature 595, 596, 597, 598, 599, 600, 601, 602, 604, 605, 609, 610,612, 614, 616, 620, 621, 622, 625, 629, 631, 632, 633, 634,636, 637, 638, 639, 641, 642, 643, 645, 646, 648, 650, 651,652, 653, 654, 655, 658, 659, 660, 661, 664, 665, 667: n = A,T,C or G
  misc_feature 668, 669, 671, 673, 674, 676, 680, 681, 683, 686, 687, 688,689, 690, 692, 696, 697, 701, 702, 703, 705, 706, 708, 712,714, 716, 717, 718, 721, 724, 725, 727, 728, 729, 730, 732,735, 736, 741, 742, 743, 744, 745, 747, 750, 753, 755: n = A,T,C or G
aggtggttnngangncattcnaatnganagctacttgttctttttgcaggatcccatcgattcgaattcggcacgaggacccaccctctccaggcctcagtcttatctctgaaatggggtgggtgttgagaggtggcttctaagatctttctacttcccaaacttggaattctctttttaggagcatctgcgtgcccagatgtatgttggagcccatggtgtatgggggtggggtggggggaagggntnngtnnccnaatncactgtggccttnnntcgnngtganatannnnttnanntntnnacntcatcntnntnnngtttgnctnntnnnanacnntcttnnnnntnnnttattatggannnttctncanntntatnntanatnnacntnnnttcatnnnnattnntnggnnattntccnnnngntnnnanatnnntnaantncntangnntnctntntntnntatnnntgnanttnananatnnnnnnntntannatnnntatnnnnnttnnnntnnatntntnggnnntnnnnnannncnnttngnnnnnnnntnnnnntnntnnntnnnnnnnntnccnnnnnntnnnnnnnnnntnnctgnntntntntaannnttntgtnannnntnnnnannntnngntnnnnnnctnnnnccnntnnngntnnanattnntntannnnnangtcnntttnnncnnanactntntnnnaantgnntnnnncnaannaattnnnnntntcnaananngngncnntattntnctannntatnngnngntnttttannnnnnnnnnnnnntattntattnngtntnntttnntntatnnnnnnngntntatntttncncntnnntgntctnatncttnnngnantnnnnnanttnntatctnatntgtcnntnatnttntatnacacttntnatattnnngcnnntntaannnnnatatnnnntaatgtnctnnntnnntcncatntttcttannnntnnnnnntnttntttnncntntatcntnntgtcntnttnctntannntnanntntnnttaaannatntcntntnnnntnntntnnnantccnntnntnntnnntatnnnnntnnnantnnnntnttnncacttnntanantnacttntnnannatanntnnnnactannatnantngcncnnantntatatcccncc

SEQ ID NO: 3425 - DNA, 767 bp, Homo sapiens
  misc_feature 4, 8, 11, 19, 22, 43, 44, 48, 677, 721, 722, 723, 724, 725,726, 727, 728, 729, 730, 731, 732, 733, 734, 735, 736, 737,738, 739, 752, 764, 767: n = A,T,C or G
gggnttantancagctctngtnggtggggcaggatcccattgnnaatntcagctacttgttctttttgcaggatcccatcgattcgaattcggcacgagtgagacagagcagccccagaacacacaccggggagtacaggagcctaggccacgtacccaacattgcaggcagagaaaaaagaaagtgtattccatgtaagcaaatgttatttggacctttctctctgtctgacctaatcatggctcacagaaagtaatcatactcctaataatacatcaacttatctgatttatccacacaatcacgtagattaatgtatgcttctatttcctggtcgctttagcataatattgatcataaattgataaataggaataaaacaatataattagattaatttacaatacggtatagttgactaataacattttcacgatttacatactaagaataaatacatttttaatcaaatgtctcccctaggtggtgcattccaggccttagaataaaattaaaagggaaatcaatgaagacacatccactggtcacactctcatcttcaatgtttgaccagtggctgaactgtttggagttgcagaatggatatttctcttttatagttttagggtgcttggaaattgctcttttaatgctcatggttactcttattctgggnggcctttaactcattaaagacagttttccattgagaaaaaaaannnnnnnnnnnnnnnnnnnaaaaaaaaaaagncttttagaactnttn

SEQ ID NO: 3426 - DNA, 753 bp, Homo sapiens
  misc_feature 4, 7, 16, 17, 23, 26, 30, 31, 32, 35, 36, 37, 41, 48, 60,65, 640, 661, 691: n = A,T,C or G
tggnggnttttaaaanncaggcnctngggnnngannnttgntataganagctacttgttnctttntgcaggatcccatcgattcgaattcggcacgaggggattacaggcgtgagccaccgcgcccagcctcatatcccccatttcaaacacgctgtaaacaatgctcaattactttcctcttaagttgaaaccaccaattactggggaaaggggcagttagattttattggttgactttgtgtttttactaatccttgttgaaaagtagaggaattggtttagttgagaaaacaaaatactaaaaaatctgccactagactttttaagtcaagagtttgtataaaatgaaacatatctactatctaatctataaaatttagaatctttttaattctaaagttaacttaagtgtgatttttagtgctgttgctgaggccagtgttgcttaaagcaggaacttctacagtaattgacaaaacttgagtttttctgctctcatttatccatccttcagacccctcagatgtcatctatttcctgaaatctgacttctccagttttagtaattcttacaatttttcaggatttagatagtactgtcagtttactgctatgtatatgtctttaatacttggtgntttcagatattacactaatgnctcatctgtagtataaatcagactttctgncttctaccagttacataatttatataatggtgcagtacatgtttggtgattactaggctgga

SEQ ID NO: 3427 - DNA, 803 bp, Homo sapiens
  misc_feature 4, 9, 12, 14, 15, 16, 17, 18, 20, 21, 22, 29, 30, 31, 32,33, 34, 35, 36, 37, 40, 43, 46, 96, 501, 549, 596, 661,673, 693, 714, 715, 718, 726, 732, 760, 765, 780, 797, 803: n = A,T,C or G
gggnttaanccntnnnnntnnnagggggnnnnnnnnnttntangantcagctcttgttctttttgcaggacccatcgattcgaattcggcacgagnaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggctctaaattgaggggattaaaaagaatttaaaataattttgaacgaatttattttcccctcagtttttgagggcattaaaaaggcattaaatcaagacaaatcatgtgcttgagaaaaataaaattaatgaaacacagcacttatgttggttaactgcagcctccttggaggtagaattatttatttaaaattactggtgcatcaagaacccatagggtgtccaaaaggtctataaaatcgcattttggagncaaagagggcaggcaaatccatgtcacaagggtaaagcttccaagttnccaaattggggaacgccaggggtgtagggatttaaaaaaccccactnttggagaaacccaaaatgtaatcagggggggcttgaaaaaccttgcatggggctttttaaaacanttagccctttgngttaacaaaaatttcttggngatttggcacgatcccctaannggngcccattnggcccnaacaccaatttttggccccttatgggcnctttnaaaaattttaatttnaaaaatacccctttttnccgggn

SEQ ID NO: 3428 - DNA, 710 bp, Homo sapiens
  misc_feature 8, 15, 16, 46, 493, 611, 710: n = A,T,C or G
tgggtttngatcaanngctcttgttctttttgcaggatcccatcgnttcgaattcggcacgaggcaacacaaactgaatttccttattgctgatagctgcctgtagaggggtggtcaaagagactctacctggaaaactcttacagaaaaacattattgaataccctcttagtttcagagtttccagtctcatttctccttaaatctattcaccaaaacaccaccagtttcccctaccacaaacacacacataagtacacactcacctattttcaccttctcttccacttccacctttgtgttgaacctgattaaactctgatacttttaactccaaaatatgctatgctcttattaacaactggatcttagtagtttgcaaatgtttatttctcgtttatatgcagttcattgtgagcaggtggatgttctgctccatacccactgcagtccgagatctagacagaaaagtagcttttctctagaatattgngggttccataccagacaggaaaaatgaaattacacagtggcttatataatttttgcttgtactttcacccacatttcattgcaaaagcaagtcacatagccaaggttattgggtttangaggggtctctgaaaatggccagtaggggagacaaaggggatatttgtgaacaatattgcaatctatcctatatgtcattctttaaggtttaacacagn

SEQ ID NO: 3429 - DNA, 781 bp, Homo sapiens
  misc_feature 6, 11, 16, 604, 673, 708, 712, 728, 729, 730, 731, 732, 733,734, 735, 736, 737, 738, 749, 758: n = A,T,C or G
agttangtcgnatcgngttctttttgcggatccctcgattcgaattcggcacgaggaagaagctgcagaagaaatgaagaaagtgatgatgatttagattttgatattgatttagaagacacaggaggagaccatcaaatgaattaatatcactgtattaaaagtctgccgggcacagtggctcacgcctgtaatcccaacactttgggaggccaaggagggtggatcacctgaggtcaggagttcgagaccagcctggccaacatggcggaaccccatctccactaaaagtacaaaaaattagctgggcgtggtggctcatgcctgtaatcccagctactcaggaggctgaggcaggaggattgcttgaaccctggaggcggagattgaagtgagctgagttcgtgccattacactccagcctgggtgacagagtgagactctgtctcaaaaaaaataaaataaaaagtcaatttagaatgtgaaattctgaccaccttttggctttgagtattttccaaaagatatttgaaatcctaatgaggaaatcagaaaaagctatggaaaaatagacaaatttcataccttgaacaatataaattgngtatattaccttaacatcaaaactaaaccaaggattcaagaattgatggttggattaaagaacctagcntcatgttaaaaattaaaattaacctttaattaccnttgncctcaaaaaaaaaaannnnnnnnnnnaaaaaaccttngaagccaangggccctttttggaggccctttt

SEQ ID NO: 3430 - DNA, 760 bp, Homo sapiens
  misc_feature 1, 2, 3, 4, 9, 11, 28, 713, 747, 753: n = A,T,C or G
nnnngttanancagctccttgttctttntgcaggatcccatcgattcgctcgagttttggatttggagagaaatattttaatttttaaatgcagttacaaattataatgtattcatatttgtactttctgttaaaatgcatgattgcagaattgtttagattttgtgtttattcttgatgaaaagctttgtttgttcttgtttttaagtttgcactcaaatcttaagaaataaatccacccatgttatcaaaaaaaaaaaaaaaaaaactcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaattcgcggccgcggcgccaatgcattgggcccggtcccagcttttgttccctttagtgagggttaattgcgcgcttggcgtaatcatggtcatagctgtttcctgtgtgaaattgttatcccgctcacaattccacacaacatacgagccgggagcattaaagtgtaaaagccctgggggtgccctaatgagtgaacctaacttcacattnaattgcgttgccgctcactggcccgcttttccantccggnaaaccct

SEQ ID NO: 3431 - DNA, 736 bp, Homo sapiens
  misc_feature 1, 644, 659, 711: n = A,T,C or G
ngtaaatcagctacttgttctttttgcaggatcccatcgattcgaattcggcacgaggcgtgtgtgtgcacaaagcccctaaggtttcatgtgtacacaccggtgctaagtgttttttacacccttgtgcatctctcggcctggggctcctgtgcaggttgccctgagagttgggtttttagttcaaaaagaaggaacacagatgactactctgctggcgacacggccactctgctggcacgcacatagcatggcgcctccttttttgggggactctccttggtggcatctctggcaggctgtgtcctctccagctgcagttctggaccctgtctgggttggggaggggcatttggtcctcaggctgagcccacctggattccccaggcccttggtgagcgccactctggctgcaactccccttgcctggcccgtcctgaggcccctctctcgtcctcagtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgcaagangactggggaagggangggagactatgtgtgaactttttttaaatagaaggattgactcggatttgantgacattaaggctgagtctgttctt

SEQ ID NO: 3432 - DNA, 711 bp, Homo sapiens
  misc_feature 6, 7, 8, 9, 10, 13, 14, 15, 17, 23, 627, 656, 700, 704: n = A,T,C or G
gttttnnnnnttnnnantctctngttctttttgcaggatccctcgattcgaattcggcacgagcacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcaagcacagagcatggtaacaagagactggatgctgcttatcgtccatgaacgggaaaggccccgtttacttacttttcagtgtcaacggcatggacacttctgtggcgtggcagaaatgaaatctgctgnggactcacacatgtgcaggtgtgttggtnccaggacaaatggaagggccgttttgatgtcaggtggattttgngaangacgttc

SEQ ID NO: 3433 - DNA, 774 bp, Homo sapiens
  misc_feature 6, 12, 15, 50, 119, 120, 121, 368, 421, 440, 453, 507, 525,530, 531, 533, 537, 542, 547, 548, 568, 586, 594, 598, 599,606, 616, 625, 629, 637, 643, 646, 652, 653, 667, 677, 681,688, 697, 701, 702, 704, 709, 713, 718, 719, 720, 721: n = A,T,C or G
  misc_feature 722, 726, 732, 734, 736, 738, 739, 743, 747, 755, 759, 760,763, 764, 765, 772: n = A,T,C or G
tgggtnttatgnatncagctcttgttctttttgcaggatcccatcgattngctgaaattgaagatgttggttctgatgaggaagaagaaaagaaggatggtgacaagaaaaagaagaannngaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagatnaatttttaattatacctttacattcactgatgcctacagttaaccagacacangtgtttaaaagaacccctnctggtgttcgganaatagtaattgctaccaacattgccggagactagcattaccatagatgatgtcncttatgtgatagatggcngaaanntngaanagacncattnngatactcagaaccaatatcntttacaatgtccctcttnagtggggntagnnaaaagcnttaatgcccnaaaccatantaanaagggtcnctcctnggnaaaaannttcaacccttgggnccaattcgcntatncaatctnggcttaacngggnncntttangacnccaannnnntttnccttangntngnncctnttcnaacctggncccnnaannntttttcncg

SEQ ID NO: 3434 - DNA, 852 bp, Homo sapiens
  misc_feature 3, 4, 6, 17, 23, 468, 472, 473, 474, 475, 476, 477, 478,480, 481, 483, 484, 485, 486, 487, 488, 491, 492, 493, 494,495, 497, 498, 499, 500, 501, 502, 503, 504, 505, 506, 507,508, 509, 510, 511, 512, 513, 514, 515, 516, 517, 518: n = A,T,C or G
  misc_feature 519, 520, 521, 522, 523, 524, 525, 526, 527, 528, 529, 530,531, 532, 533, 534, 535, 536, 537, 538, 539, 540, 541, 542,543, 544, 545, 546, 547, 548, 549, 550, 551, 552, 553, 554,555, 556, 557, 558, 559, 560, 561, 562, 563, 564, 565: n = A,T,C or G
  misc_feature 566, 567, 568, 569, 570, 571, 572, 573, 574, 575, 576, 577,578, 579, 580, 581, 582, 583, 584, 585, 586, 587, 588, 589,590, 591, 592, 593, 594, 595, 596, 597, 598, 599, 600, 601,602, 603, 604, 605, 606, 607, 608, 609, 610, 611, 612: n = A,T,C or G
  misc_feature 613, 614, 615, 616, 617, 618, 619, 620, 621, 622, 623, 624,625, 626, 627, 628, 629, 630, 631, 632, 633, 634, 635, 636,637, 638, 639, 640, 641, 642, 643, 644, 645, 646, 647, 648,649, 650, 651, 652, 653, 654, 655, 656, 657, 658, 659: n = A,T,C or G
  misc_feature 660, 661, 662, 663, 664, 665, 666, 667, 668, 669, 670, 671,672, 673, 674, 675, 676, 677, 678, 679, 680, 681, 682, 683,684, 685, 686, 687, 688, 689, 690, 691, 692, 693, 694, 695,696, 697, 698, 699, 700, 701, 702, 703, 704, 705, 706: n = A,T,C or G
  misc_feature 707, 708, 709, 710, 711, 712, 713, 714, 715, 716, 717, 718,719, 720, 721, 722, 723, 724, 725, 726, 727, 728, 729, 730,731, 732, 733, 734, 735, 736, 737, 738, 739, 740, 741, 742,743, 744, 745, 746, 747, 748, 749, 750, 751, 752, 753: n = A,T,C or G
ggnnanagcagctcttntctttntgcaggatccctcgattcggagaggtaatgcttcattttgcatagttgggaatcaagataatctgtttttaataatacaagaaacaaaagcataactatattatttatattacaaaagcaatctttagaaaaactaaaaggggtatataagtattgagaggagaggaaaaggaatgatatggtatcatgaggtaatttttgatcaattatagtaggaaatagacaatatctaaaatggataaagggaaaatggcaatattatctttttattttatattattttaattttttaagacaagtgctcgctctgtcgcccatgctggagtgcaggggtacaatcacagctcactggagccttgacctcctgggctcaagtgatcctcccaccacagcctcccgagtacctggtactacaggcatgccaccacacccggctaatttttgnattnnnnnnnanncnnnnnnttnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncc

SEQ ID NO: 3435 - DNA, 715 bp, Homo sapiens
  misc_feature 3, 6, 15, 589, 646, 669, 692: n = A,T,C or G
ggnttnaaatatcangctacttgttctttttgcaggatcccatcgattcgaattcggcacgagaataaaaggttccaatttgagtttcatctgctcagctgccagcagcagtgattccccaatgacttttgcttggaaaaaagacaatgaactactgcatgatgctgaaatggaaaattatgcacacctccgggcccaaggtggcgaggtgatggagtataccaccatccttcggctgcgcgaggtggaatttgccagtgaggggaaatatcagtgtgtcatctccaatcactttggttcatcctactctgtcaaagccaagcttacagtaaatagtatgtgatctgacttttcctttagcatttaaagataccttttagaaatagaaagcacctgtttttctctcttaatcttaaccctgtcttttcttctcacagttccccacctgactcttcctttccctacctttcattccacaaaattaagattcttggttatttgtatctaaacctgcaattatgttgaagacgacaccgtactcagtgtggtgagtaacacagagatgaaccagacatgtttttgctctttnttttttctttttcttttttttttttgagacggaatcttgcacttgtcaccccaaggnttggatgacatcctgggttgcantgagctgaaaatggtgccaatgnacttccaacctgggtgacaaaat

SEQ ID NO: 3436 - DNA, 762 bp, Homo sapiens
  misc_feature 1, 3, 9, 10, 18, 20, 21, 28, 42, 48, 510, 540, 557, 577,662, 665, 732, 748: n = A,T,C or G
ntnaggggnnttgaaggncnntttctanatgctaggctactngttctntctgcaggatcccatcgattcgaattcggcacgaggtcatgatcaactcagtataggttttcttaaaaaattttttcttaaaatgttttttgaacttcaaataagtttggttggtgctacagatttaaatcgacttgtttgtgaggataatagaattctttttgctatgaacttatcagtcagcccagcgtctgtgagacggtgcctgcttgcatggtgcagtccagagtgtattttgcaaacgtctagcactgcctttatgtaggacgcgtgcttcgttttattggtctaaaatttcccatgtcataacactttgatcatgccttagagaagtcttacagcttattcagagcactttggagacattaacacccagcgtgcaaatgcgtcttcttgcttaggcgtcttgtgccttgtgttcagcatcagtctctaggcccgcttggtgtggttctggaccanagaaagtgctggtgagaagatattcctcancagtgttgggagagcangcgatggaccctgggtttgnttcgatgtggttcacgtgcggtactgtttctcaaaagtggtcatttggagtacttgatgtacctggatttttgctaacccttgtncanctttgctgttctttatgtaaaatatattcattttcaaaggaaatggttgggccggacacagtggctnacgcctattatcccancactttggggaggc

SEQ ID NO: 3437 - DNA, 702 bp, Homo sapiens
  misc_feature 3, 4, 5, 8, 12, 46, 530, 581, 591, 702: n = A,T,C or G
agnnntanatcngctctcttgttctttttgcaggatccctcgattngaattcggcacgagaagaaaccagtagctagctgctatttatatggtgagggggtgctgcctggtaacagaatagctccacaccacagcttgagattttgtttagtttcactgtgtgagctttcataaagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtgcactgtgcccagcatggtgtttcttatatcaggtgttttagggagctcgcttgcttattccattctttaatccttacagtgtgccacacgtataaagtttataacgtattaatgatctcattacccaaaaccagaacataatttcacaagggttcctacttctgtattgntttattatctcaaaaatttaaataacatgttctgctgtttattggtcttgntatccactgnattagcaccttccctgatgtgctttggaggttgatcaatgaattctgagactttctgctggaattactttaagggtgcttattagatgatgaaaaagttggctgagacccn

SEQ ID NO: 3438 - DNA, 708 bp, Homo sapiens
  misc_feature 1, 2, 339, 476, 479, 606, 609, 626, 660, 662: n = A,T,C or G
nntttagatcagctctcttgttctttttgcaggatccctcgattcgaattcggcacgaggctttatctctaaattagaatcacaaatgcgtaatcttttcagggtaaaaatgtgtcatctttaaagtctgtttcagatatattttaaattactattttaaatgaattcatatggaaaagtcgtgggagcttaaggccttgtttaaaagggaaaaaacaactgagtctttttagattaatcaaaaactatcctcttcctttggagaggagagagtgtttgtcacacgcggaatgaagtgccatgttctttgaggcacgatttgtatgccatttggagganggagtccgttcaagagaatggattccctgacaagctacgtttgccagaatattccaagacatgttttagaagctacctatggcattaacatcataacgcctagagaggatgaagatccccaccgacctccaacatcngangaactgttgacagcttatggatacatgcgaggattcatgacagcgcatggacagccagaccagcctcgatctgcgcgctacatcctgaaggactatgtcagtggtaagctgctgtactgccatcctnctnctggaagagatcctgtncttttcagcatcaacaccagcgactcctagagancnaaatgaacagtgatgaaataaaaatgcagctaggcagaaataaaaa

SEQ ID NO: 3439 - DNA, 710 bp, Homo sapiens
  misc_feature 5, 6, 11: n = A,T,C or G
ggttnntagcngctcttgttctttttgcaggatcccatcgattcgaattcggcacgaggtttagggtcagatccatgtatttgtagcttggaggtgagcccaggggttcatacacaactttgctccctactgtctgtgatccctctgccactttctggttccttggagctccctttcatgatcctcctgtcagaataccagggctttaatttgcccactctctgccatgcacttctcatgactgcatctgcatccagggccaagcggtaggaggacagagggagcctaaataaacaataggatttgtttcacagtcttgaagctacagcttctctggtcagagaaaagaattcaaagccctcagagttttaggtacctgctcaaattctacctctgttgcctaaggttagagagaacaaaataagaaagaaaaaaaaagcaggagatttcccttattttctctgaacttttggcattcctttttctgttctttggaccagaaaatgagttgaagttcctctgttcacacctggtgtttactttcatgtttcaagctgctcttaagtctagaccaggtaatatctgagggggaaaaaatgggacactcactactggcttggtggtagtttaaaccctggctctttcccggtgtgctcattatcatttactttcagagtttccagaaagctgctccatgcattctatctaga

SEQ ID NO: 3440 - DNA, 775 bp, Homo sapiens
  misc_feature 5, 13, 121, 123, 173, 384, 428, 462, 464, 466, 491, 493,511, 519, 523, 528, 534, 536, 537, 540, 541, 542, 543, 544,545, 550, 552, 556, 558, 563, 568, 569, 571, 575, 580, 583,586, 588, 593, 594, 597, 601, 602, 603, 604, 609, 612: n = A,T,C or G
  misc_feature 614, 627, 638, 648, 650, 655, 659, 660, 661, 662, 668, 672,677, 679, 685, 688, 689, 692, 693, 696, 699, 700, 701, 715,716, 718, 719, 720, 721, 722, 725, 728, 730, 734, 735, 737,742, 747, 749, 750, 752, 754, 757, 758, 765, 766, 769: n = A,T,C or G
  misc_feature 773, 775: n = A,T,C or G
tgttnctaatgcnaggctcttgttctttttgcaggatcccatcgattcgaattcggcacgaggcttagaaaattaacctttttctattaggctggtgcaaaagtaattgcggtttttttgncnttaaaagtaatggcataaaccattacttctattaataaaaccctcaattntcattttcatagcctttcagaatgggagtaagctttgcaatcaacctgctccttcatcttatctgtacacttgataaatctgattcagtggttggaacggaatctgcttttcctgtattggttacaagcaagcactttgcctgggtgagtgtagctgcagtatagcatagaattaagactacagtttcatagtcagcgcagcttgaaatgntggctctatcatttactagctgtgtgatcttgcacaaaatcctnaacttctctgcgcctgtttcctcacttaaatggnantnacattgttatctacctcatggagtngntatgaagattaaataacntgcatagnaacntgcanaagctncnnacnnnnnnatatnancctnanaccanctctnncncctncctcnctnctnanctaannaanaccnnnnggtgnggngnaaatttcttctanaaagaaaaatntccttgaaancnttttnaaannnnactaantttnctcantnaatctngtnnatnncanggnnnaacctaaaatccanncnnnnnganacntncccnntntattntatantnngncntannagggcanntancctncn

SEQ ID NO: 3441 - DNA, 710 bp, Homo sapiens
  misc_feature 2, 8, 28, 430, 562, 641, 675, 697, 707, 709: n = A,T,C or G
gnttttanatacagctacttgttctttntgcaggatcccatcgattcgccccgaccccgggccacctgggcccccgggttccgccggcactctcgccaccaccgcgtgggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctncccgtgttcctgctatcgcccgctctgccgcctcaacttcggcctcaatgtcgtggagaacctcgcgttgctagtgctcacttatgtctcctcctccgaggacttcaccatccacgaaaatgctttcattgngttcattgcctcatccctcgggcacatgctcctcacctgcattctctggcggttgaccaagaagcacacagtaagtcangaggatcgcaagtcctacagctggaaacagcggntcttcatcatcaacttcatctncttcttcttngng

SEQ ID NO: 3442 - DNA, 722 bp, Homo sapiens
  misc_feature 11, 26, 350, 607, 683, 700, 705: n = A,T,C or G
gttcaatgctnggctcttgttctttntgcaggatccctcgattcgtttggtcagttgcaccttctgggtcactggtagccgcgggagccgggtggggcctaggcgatgatccggcattaaggagctgggatcatcctccgtctcaggtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttncgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgataccgagaatacagtaatggacaggcgggtgcgatagaacatgtgagaaactacatttgtttgcattttctcctacccaccttttttggggaatgaantgttttggggaatggggcttgtgaactaaaaggaaaaaaaccattggtgaaagtgcttttagaattttaaaactgnatttaattattttatangtttnaaagtttaaggttagct

SEQ ID NO: 3443 - DNA, 792 bp, Homo sapiens
  misc_feature 11, 13, 14, 126, 135, 171, 216, 226, 244, 250, 251, 272,277, 279, 290, 293, 299, 300, 312, 318, 327, 338, 342, 343,345, 346, 350, 351, 353, 368, 372, 375, 377, 392, 399, 409,410, 411, 412, 413, 414, 435, 444, 445, 455, 460, 462: n = A,T,C or G
  misc_feature 467, 470, 471, 473, 475, 477, 480, 483, 484, 486, 493, 499,503, 505, 507, 510, 516, 519, 529, 532, 533, 534, 538, 539,545, 546, 559, 562, 563, 566, 568, 573, 577, 578, 583, 585,588, 590, 594, 597, 600, 601, 605, 610, 612, 613, 621: n = A,T,C or G
  misc_feature 627, 629, 633, 641, 642, 643, 649, 651, 653, 654, 656, 659,674, 678, 681, 690, 691, 694, 701, 715, 716, 719, 722, 728,729, 739, 740, 741, 742, 747, 750, 753, 755, 761, 763, 776,777, 778, 783, 788, 791: n = A,T,C or G
agtgcttctantnnattgctacttgttctttttgcaggatcccatcgattgcgaattcggcacgaggttgatctctcatcagtgtttgacagttaatcactttttcctccttgaaataccgggggntgaggcttncaagacaccacacacaactggtttacctctctctgnctctctcttttttgtttcctttgctgactctttctcagcatttcngctagggttnagtccatggcatttcttnacattnntggctacctttctcccttaangtacntntctagacttcnaantccatnnattcctagtttnaagatntccctttancaacttaattncatnnanntttnnanacacagtccttgaanattnccnanagccaaaacacggantcgtacntgaacccctnnnnnntctcatatcacatacacggtntgtcatcanntcatgatatncttcncnctttnttnnanantnttnccnntntcttatnaattcntttngnanctnttcctnccncaatccaaangannnttanntgcttnnattaaactatatntannggngnttttnttcnntctcngngananaaanatnttnnaaancccgntnncttaaatncaattntntgcncctttctnnnaaatgncnanngnccnttaatcatccaactnggtnggntccaggggnncanatggctntaccaatccttgcnnaanccntcacgnnctttttggcnnnnggccnttntantncggccnanatctaccctcgtnnnggaangccanttnc

SEQ ID NO: 3444 - DNA, 712 bp, Homo sapiens
  misc_feature 4, 6, 8, 13, 587, 655, 665, 677: n = A,T,C or G
ggcngntntatgnagctcttgttcttttgcaggatccctcgattcgcaaagccactttgaattctggaaagttgacctgatggagaagaaccaggaaaaccaagaccagcatttgaggaaagctggttttgtcaacaacaaaatactgatggaagacagaaatagtgttttaggagaaacatttaatataaattcaaaccttgttccaatgagaaaaatacctgataaatatgacttatgtataatgaacgtgaattatatttcagaattaattgttagtaatagaaactcctttggaaggaagcttgatgagctcagtgcacatgcgaaattgctccttcatatgacatgagcatccttatgccagagagaaacattttgagtgtgatagaaatgagaaagccatctgttagaatgaggacttatttcagcatcaggatattcaaactctgaagcaaatttttgaataccttgagtgtgggaaagcttttcatgaggaggcagccttcagtacccataagagagtgtgcttcttgggagaaaccttgtgaatataatgaacaacttaagagccttttctgacaatncaaaccttcttggtcatcagagtactcacagaagggaaaatcactacgagtttaattgctggtgggangaagtctgtngtgagaaatctntaattaacaccatggaggaatcatggggaaaaata

SEQ ID NO: 3445 - DNA, 733 bp, Homo sapiens
  misc_feature 3, 5, 6, 20, 575, 586, 600, 605, 622, 692, 716, 728, 730: n = A,T,C or G
ggngnnttttatagatacangctacttgttctttttgcaggatcccatcgattcgaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagntttagtgcagncctcaacgcaccantaganaaagactgactttcggnatcttcaggatgtaactgggaataaaaggatgttttctgttggacatgtactggaaaattaacacatgtngtagccttaaaaattttagacttnttctaacatgangnttg

SEQ ID NO: 3446 - DNA, 722 bp, Homo sapiens
  misc_feature 1, 3, 6, 7, 722: n = A,T,C or G
ngnggnnttttagatcagctcttgttctttttgcaggatcccatcgattcgaattcgtcacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagtgcagaatttttggaacagcattatgatagatttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaaccgacgagaagacctatttagttaaacagatcagggn

SEQ ID NO: 3447 - DNA, 761 bp, Homo sapiens
  misc_feature 3, 17, 18, 19, 34, 507, 514, 517, 527, 548, 588, 620, 624,634, 649, 664, 671, 682, 685, 691, 704, 718, 723, 726, 734: n = A,T,C or G
ggngggtttctaatagnnngctacttgttctttntgcaggatcccatcgattcgaattcggcacgagaaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacaccctcactgagaacgtggcccggatcctcaacaagaagctgctggaacatgccttaaaggaggagaggaggcaggctgcccacgggcccccgggtctccacagtgacagccactcgctgggggacacagccgagccagggcccatggaggaactaccttgttctgcactagctccatccctagagccctgcttcttcaggcccgagagaccagcaaacccgtcgcccttcgtcccgttgggccccacattcccccactgcttacaggcttagtcaccccggagacccgacgtncttggangancatggtggcnaagagcccgccccaggagcanccacaccgagatgcaaacttgcattggattatcacaagtntaaattcacttggaattttgcattaacccccncccnttacccttgnaacaaaaatttttgnccaacagggaggaanatcttantttttttcaanggncaaaanaaatgtttttttnaaaaaccccaaaancttgnttnaaatgttnaaaccttgggaaaacttgggaattttt

SEQ ID NO: 3448 - DNA, 799 bp, Homo sapiens
  misc_feature 5, 11, 132, 138, 139, 143, 145, 160, 161, 165, 176, 177,181, 184, 193, 200, 201, 272, 277, 278, 294, 320, 325, 326,347, 349, 351, 369, 373, 378, 381, 387, 422, 425, 444, 474,515, 516, 523, 524, 526, 537, 543, 553, 562, 568, 570: n = A,T,C or G
  misc_feature 577, 581, 588, 592, 598, 612, 613, 623, 625, 631, 632, 642,643, 644, 650, 652, 655, 656, 664, 667, 669, 670, 671, 674,677, 678, 679, 680, 681, 690, 707, 716, 719, 734, 738, 745,758, 760, 761, 762, 763, 778, 790, 792, 794, 795, 797: n = A,T,C or G
ggggntttttnaccacgctcttgttctttttgcaggatcccatcgattcgaattcggcacgagaacggtgtctggtggagaagagctgagcttccctggccccttctgaaatggggtcaggaaggggatcangagggnnattntncatggtgttcctgcnnatangtatttctttnnctcnctnatctctctnagtcatnnctcagtcaaccacatatattaagacctatgcacagaacaattctattcctataaaattctataaaatgcanactannccataatgacaaaaanaatattactggtttcctagggatggnatgtnngcaaagagagacgacagatgnangnattaccaatgagcacagngganacttntgnatgcanggatatgctcattgtccttgactgctgatggtttnacnaggtgggcccaaaactatntcaaacttttcacttcatctatatgaccanctgtcatatgccaattatacctcaattaatcctgattaaanncatttanngntatctctactngtaaantttaaaaccnctttttacnttaccncncctgtantcantcatgtngccnttcctnaaaaacttcccaanngtatttctancnataaannaggctttctnnntaaccnanttnnaccttccnttngnnnatnctnnnnnaccttattncttaattcttctgaaanaattcaacntantattatacctatttnaaanccttctnccaacttctttantnnnngcacctttcttctcnttataatcccancnanncncg

SEQ ID NO: 3449 - DNA, 729 bp, Homo sapiens
  misc_feature 7, 16, 512, 637, 668, 676, 678, 699, 714: n = A,T,C or G
gggggtntctaatgcnggctacttgttctttttgcaggatcccatcgattcgccgtcttcgccaaggccccgcccgagcctagttgttctccccctgaatgtgtagaaccttcctttgaaatttcttaatcggtgcattgaggtttccacatctttttccaagcagtgccccacttcatggatttatagctatagtctatgcagtcgttacctctttttttttttttaagaaaattgaagattggggtggtggaggcagtagggagatgggattgggcacctcccccgtgctggggcctggatttttgtaaataaatttcccaagcgtttctttccacctggagggaaagggggggacgcccccagtgagattcaaatcacgcatctctactcctctgcgtgagtgcgtgtgtacatgtgcactccccaccctgctcccttcccagagggattgctgtgaaatttttttggtggcaaataaagataaatttcattctgttcaaaaaaaaaanaaaaaaaaactcgagcctctagaactatagtgagtccgtattacgtagatccagacatgataagatcattgatgaagtttggacaaaccacaactagaatgcagtgaaaaaaatgctttatttgngaaaattggggatgctattgctttaatttgnaacccttntnagctggaattaaccaagttancaccaaccaattgcnttcatttttatggtt

SEQ ID NO: 3450 - DNA, 763 bp, Homo sapiens
  misc_feature 1, 2, 3, 6, 9, 12, 13, 15, 17, 18, 19, 20, 21, 22, 23, 29,34, 762: n = A,T,C or G
nnnagnggnggnnantnnnnnnnttttgnaaagncgttgctacttgttctttatgcaggatcccatcgattcgaattcggcacgagggtgaacaaaaatggcccagattcttattcagaaaccaattcacattttaaaaatatatactgtacactaccccatcctcttcctaatagctaaagtgatctaccctaaaacaccaagcagtccttcttacagtttgttccctcctgacagttcattgattacaatgtgaaagcaccaacctgagctaaaatgaaatgagaagcctgatgtttcaggcaccaagtactttaaaaatgtctactggctgtcctgcagcattttacttaatcattttttagaggagggatgaggactggttgggtaaaggaaatcatcaaatggagccttaaataactgattacaaaagctttttgtaaaatcacacaaatatttcaagaataaatgcattccagagatacaaatcaggccaaaagaaacaaaaatcaatgaaattggcattacacttgtaaaaggccaaatggacacaagccctcgagcctctagaactatagtgagtcgtattacgtagatccagacatgataagatacattgatgagtttggacaaaccacaactagaatgcagtggaaaaaaatgctttatttgtgaaattgtgatgctattgctttatttggaccattataagctgcaataaacaaggttaacaacaccaatggcttcatttatgtttcaggnt

SEQ ID NO: 3451 - DNA, 740 bp, Homo sapiens
  misc_feature 6, 7, 8, 9, 10, 11, 15, 17, 25, 29, 31, 32, 38, 572, 615,625, 649, 652, 696, 708: n = A,T,C or G
aggggnnnnnntttntnagggcagntttntnnatacangctacttgttctttttgcaggatcccatcgattcgaattcggcacgaggctgtttgtgcaaataccttgaaaactttgaaacttgaccccggacaggcctggtgccaggtcctttccgacttttgtgttttctttccacctttcactactgactttgcctctttcctaccaggaatggacagggccgatggaggtgaagcggacagcagctgcactgccctgtagagattcccaggccctgcccacttcaaagcacacaagcccacctcttcctcatcacatttccctttgcaacccagggaggcactcaccaggatgctgccaagaaggaaacattttattaacatgtttctttgtttccgatgcacttaaaacacttgggcctcttgaccaagtctagttttaggacttcaaaggggcgttgaaagccacattttgatgactttggtgtaaaatgagtagggcatatcgggatttaatttcccttgaaagttgcacagacttaaaaattagcagaataggctagcagaatangccggatgccgtggctcatatctgtaatccagcactttgggangccgaggcangcggatcacctaaggcaacagttncanaccaagcctggccaacatggtgaaaccccctcttactaaagatngaaaaaattaanctgggccgttgtggtgcaacctgtaatcttac

SEQ ID NO: 3452 - DNA, 718 bp, Homo sapiens
  misc_feature 5, 6, 7, 8, 15, 19, 21, 35, 547, 599, 638, 708, 710, 714: n = A,T,C or G
gcggnnnntcttcanatgncngctcttgttctttntgcaggatcccatcgattcgaattcggcacgagttcatttttaaaaagcttctccttattatgttgttgtttaacaacttaaacgctatctctagaccaggaataattatttgctatatattacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctggcatagtttaaaagactgaaaatattaagtgtgtgggaatgtagagcaactggaaatggcctacatctttcatagaaatgtaaaacaatacaaatactttgcaaaactctgtccaacattttctacccattcaccaagcaactccatccctagctatagatacccaggaaaataagtatgtatcttcacagaaataattgnatgagaatattcatagttcttatgcacagtagttatcaagtaaacctgtctnccatcagaaaaatggatatcaaatggggtgataatcatncaatcaataggatattacttggccaaaccaaatgaaacaagggaaaaccacatcaaccaaattagtggcntntttncccc

SEQ ID NO: 3453 - DNA, 715 bp, Homo sapiens
  misc_feature 17, 18, 657, 675, 713: n = A,T,C or G
ggcagctctctaatgcnngctacttgttctttttgcaggatcccatcgattcgaattcggcacgagcaaagtactgggattacaggcatgagtcactgagcccagcctaataaagaactttctgacagtgaaaatggtctgtgcatggtgtgggtggggtgagggtgaggccgggcgtggatggagcagcagggaggttgtagacaatgtccagacatcagagagagggctgggctctgatcctgtgccaccctgaaaggctttgatcctatggtttggtcagaaacagagcctgtaaaacccatgtatgcagctgttgctaagggcaaccacaagatgctcaaaggaccttaaagatgtagatgcagttagttacctgaagaagtgaaagtagaagtgaagtcttttctaaaagaaaaaccacagacacaatggcaatctggggagaaagagagcctgggattgggagaagatatccaggcatttagctctctcttccccccatatttagtgtgacatatttattgtgactttataaattctttttttaattttaatttttattttaatgtttgtgggtatgcagtaggtgtatatatttatgggacacatgagatattttggtacagcaggtgtttatcttgaccgacgtcttgnctctactgcctgtcccgntcttaacatccttctctttctactccccttaccccgtntt

SEQ ID NO: 3454 - DNA, 723 bp, Homo sapiens
  misc_feature 5, 6, 9, 10, 20: n = A,T,C or G
gcggnnttnnttctaatgcnggctcttgttctttttgcaggatcccatcgattcgaattcggcacgagatttaaatagtctgtctttaagagtagctctgagatttttttctggtaaatcactatttaacctctctgatttgtttagtttttctcatctataaaattgaaatgataaaatgaaggttaaattagaaaatgtagaaaatgcctagaacagagtcttgcatatggttggtactaaagtgttttgttccccatggatagtatcttctcttaaagatcctttgaaagggctttaaagtgaaccttgtaggatggtaatttttgttcattttaatttttttagtaagttttgattgagatcttgaatttcatttagaaaatttctgctaagcaagaagcagtggaaaaattacaggaaaagctgtctagacttgactacatagaaattataaatgtttgcatatcacattgtcaaaaaacaaaattaaaagatattgacatgaaaatatttgtatgtgggcagaaaaaagtttaatattcttaatattaatgagctcttagaaatcttaaaaataattaaacatttgatagaataatgaacaaaggacatgaataggtggttcataaaagaaatataaatagctaataagcatatgaaaatggtgtttagcctaggataatcaaagaaactcaaatccatcttttggttggcaaattg

SEQ ID NO: 3455 - DNA, 815 bp, Homo sapiens
  misc_feature 15, 37, 46, 50, 54, 55, 57, 63, 65, 69, 72, 73, 77, 80, 89,97, 99, 109, 116, 123, 124, 131, 132, 135, 137, 143, 151,154, 157, 158, 162, 163, 176, 181, 183, 192, 195, 215, 231,311, 318, 321, 322, 346, 352, 392, 402, 413, 461, 462: n = A,T,C or G
  misc_feature 473, 503, 506, 518, 519, 531, 534, 543, 546, 549, 554, 557,558, 559, 573, 575, 587, 588, 592, 598, 603, 605, 619, 641,647, 659, 676, 704, 706, 710, 724, 727, 740, 741, 747, 759,772, 775, 777, 780, 790, 797, 806, 809, 815: n = A,T,C or G
ggggactctgttctnacagctacttgttctttagganccaatccangagnaatnngncccgancncagnccnnaatnctnttttccgcncctgggtncntcacttcctngcggaanagacagnnattttcnnggntncattcntatgaaancanggnntggnntgaaaatgtcttnccagntncaacaggcnatnaacacatgcctaaaagatcntgtaaggggtttcagnacacgacgagtcctctagcgctttgtgttcacacctttactccatgatccgtggaaaccggccaacacagacgagccttncttattnctnntactcagcctctttgatgacacancagaancagacgtgactatgctctcgtatatatgcagacaatctangcctgttttncataccagacncaggaagaagcccgttgttataatgcatcatatatacattacactctnnagtttcttggnagtcacctactgcagtcatttcaagggagnctnatgggtaaaggnncataaaggaaangangaggaaaantantcncctantannnggaaaattgagtcnangctgacaggtgnnatangaaaanttttncnaggcctttgggaangtcaccgggaaaaccgtggttngatttncagaatttccanaatttccggaatttcangaatgaaccgatttttaaaattccagtngnttgnaaaatggtttttgnccnggaaaaaatttannttcccnttttaaatccgnaatttttcaaaantgntnttncccaaggggncattttnaaataaccnttnctcaan

SEQ ID NO: 3456 - DNA, 742 bp, Homo sapiens
  misc_feature 2, 6, 7, 8, 9, 10, 11, 12, 17, 18, 20, 21, 26, 33, 126, 460,713, 741: n = A,T,C or G
gngggnnnnnnnttttnnanngcgtntatagcnggctcttgttctttttgcaggatcccatcgattcgaattcggcacgaggccagcttgacctggttgtgggcccgttgggcgagaatgaagctncactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgaggtgcgtgaagtgggcaggccctgtcagtctcgcgttcttcttggaagccgagacgcgggccaccctcggtcctcatgctcccggctgctccctaggcgaaagcccgccttgggggttcctgaactcccagccttgagacctaccatcagcccgaccccanggtcctgtgcgtcttcctacggacccgaaagaagaaagctttgagagtgtaccttttcgctatttttcctcccacttttacgactttgaatttacagtgttgctatttagtagtggatggcaatcccgcctgtttcaagtttctgaaattttgcgtgaaacaagcgcaaatgaagcaacttgtccagttggggaacagtaaaataactgcagttcttgttcaatgaaaaaaaaaaaaaaaaaactcgagcctntagaactatagtgagtcgtattacgtana

SEQ ID NO: 3457 - DNA, 721 bp, Homo sapiens
  misc_feature 3, 20, 557, 600, 629, 649, 669, 680, 683, 694: n = A,T,C or G
ggngcgtctatgttgctctngttcttttgcaggatcccatcgattcgctggatccagtccaggccagagcctcctctgcagagaaggtactaggtgcccatgcacagggtgactgccagcctcgtggagtgggggcagtggtgtccctgcgggcgggcttggtcttctgaggccatgtcagtgccaccccagggccgccctccatggcagtgtggggccaacaagcctgtcttcccatttttctgagagaggctggaaatcctgttctttttatatataaagtgtttccttttcaaaatattggcaactaagtaaatccaaacaaagtatgggccaaatcatggcacactcctgccccacaggtggccctccagctaagagtcatgtttacaattttagaggtttggtgggctccagtgggaccacgcctgggggtggagtggctgtgggtgaaccgtgtctccactcccacacctcgccactgagaagacagagcacgggatcgtgacagccgagctccaccgccttcactagtcactgtggcctgcaggggctgncagcctctgattcaagagccagtgggccgccgaggacacactnccttccttccctgcctggggtcctgtgcntttgagctgaaactgttctnggccttttctgaaaaggatngtagaacgccngantggcattttantggtgaatgggcctttgcaggaacact

SEQ ID NO: 3458 - DNA, 741 bp, Homo sapiens
  misc_feature 3, 14, 92, 93, 95, 100, 102, 107, 109, 113, 123, 135, 558,565, 594, 650, 705, 708, 711, 715, 716, 717, 719, 720, 721,722, 723, 724, 725, 726, 727, 728, 729, 730, 731, 732, 733,734, 735, 736, 737, 738, 739, 740, 741: n = A,T,C or G
ggngttttatagcngctcttgttctttttgcaggatccctcgattcgaattcggcacgagcctaggctttaccctcaatactgcttctggcnngnccaancngtctntntccngtggctctgngtgatgtgactngtcctcttctccaaggcagtattactcataaattcttctttagcggtactgatctatctgtgtcatcgctcagtcaaccacatatattaagacctaggcacagaacaattctatttctataaaattctagaaaatgcaaactaaaccataatgacaaaaagaatattagtgggtttcctagggatgggatgtgggcaaagagagacgaaagaaggagggattaccaaggagcacagggaaagttcgggatggagggatatgctcattgtcttgactggtgatggttttacaggtgggccaaactaatcaaactttacacttcatctatatgaccagctatcatatgtcaattatacctcaataaagctgtttaaaaacatttaagggtatatctactggaaagtaaaactgcttttaattacnagactgnatcatcatgtgcatagaaaaaatccaaanggattcttccaaaaaaagctactaagaaccactggccttcatcgagatgccaggtncaaaggtttaatattggaaaatcaactattatttcctatttcaaaagccaaccanaanaanaaannnannnnnnnnnnnnnnnnnnnnnnn

SEQ ID NO: 3459 - DNA, 753 bp, Homo sapiens
  misc_feature 2, 7, 8, 9, 10, 11, 12, 18, 19, 20, 22, 26, 35, 41, 395,633, 642, 650, 663, 665, 668, 678, 690, 691, 716, 734, 749: n = A,T,C or G
gnttggnnnnnntttttnnnancgcntttttatanatacangctacttgttctttttgcaggatcccatcgattcgaattcggcacgagggggcccccacgcaaactcaaattccctgagcctcaagaggtggtggaagagttgaagaagtacctgtcgtagggagatttgggtagaagccctcatgctgagctttgtgtccctggtgatgttggaacattaatgatggaacatggccaaacttcagtcatgatcctgaaaccatggcttcaggatcatgactgaagtcatggtttcttccctgccagaaatgaaggttcagttatgaggcaaccctctagtaaggcattgtaaaagttactggatttggtttaataaaagttgaaataaagtanaaaaaaaaaaaaaaaaaaactcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataaagctgcaataaacaagttaacaacacaattgcattcattttatgtttcaaggttcaagggggangtgtggganggtttttnaattcgccgggcncngcngccaatgccnttgggccccggnncccagcttttggttcctttaatgangggttaaatgcccccttnggcgtaatcatgggnaata

SEQ ID NO: 3460 - DNA, 722 bp, Homo sapiens
  misc_feature 2, 7, 8, 9, 17, 18, 19, 617, 633, 650, 656, 664, 668: n = A,T,C or G
gnggggnnnttctaatnnnaggctacttgttctttttgcaggatcccatcgattcgaattcggcacgagggtaagtaacctgtgcagagcacagaactaggattcagacctacagacccacaagtcagcctctaaggcccacttataactgctcttctgcttgcaaggccctatggatgaaatccagttataacctccttttgctataactagacacagagggaggcgtttctccctaatctgtatttatccagacaagctgtccagcaagatttctgagtgaggggctttaaggaagcaatctgcgggtgtgtagccttttctccctcagcaaatacagaaggagcttatagcccgggctcaccctgcttcagaacaagggccaacatctgtccatacccctgttatagtgagatgggaaaccttgtagatgttggcactgtgtggctcttttcttttatatactgggctttagggtcaatcccatttaaccaaagggttcaatagctataaaaaggcgttgaaattgtatggttatttgagttatagctcagtaaaggcattaaatcttcagcctagatgaccctattccttcccactctaaccagctgtgactncagatggagacattgncctgcatcctctacgtncccatncccacatnccanccagaaacaaatgtgtgaagtttcataccaacaagaatgggggggtaggaatca

SEQ ID NO: 3461 - DNA, 742 bp, Homo sapiens
  misc_feature 2, 3, 6, 7, 8, 9, 10, 11, 12, 13, 14, 15, 17, 18, 19, 21,25, 26, 31, 735: n = A,T,C or G
gnnagnnnnnnnnnngnnngntttnnaagancagctacttgttctttttgcaggatcccatcgattcgaattcggcacgagggaacccccaccattaagctaaagtaaaacccttttgagggaagagggagactggggagaagggaaaagagagaaggcagggagagtagggagagaaaaccttccagcagcccagtaaactgcgggcgaagagatctacccgtctccctccctcccacagttaccattggccttgtcatcgcaagcatttgacaaagacttgcttgtcttgggcctgtcacctcctgaaaggctgctttagctgtggatgcccttgattaagggagagagcgcctaggagctgcctgccccagctggggtgacggctgtagggctgggtctatgttgcaagccctatatcctagcatgcagtggaaagtgcttagctctctccctcctgacctctgggcagccagtcatcaaagcagagagacgtggcggcatgtgggcagcatgcccaggttccttgctgactcagcacttatttctgtagttttaaaaaagaatttaatgtttttggttgtatttttttgggggggtgagggtgggcaaaaacatgggggtagttctgagttgttagaaatgtttcttgaatcaaagtttgtttgaagacacctgtgcctttgtacccattataagatggtcattaagacccaagaaactgataactttggnttttttt

SEQ ID NO: 3462 - DNA, 753 bp, Homo sapiens
  misc_feature 4, 10, 11, 12, 14, 15, 19, 21, 24, 25, 28, 29, 729: n = A,T,C or G
gggntttaannncnntttncnaannagnnagctacttgttctttttgcaggatcccatcgattcgaattcggcacgaggagaactccaaatagcccaagagggtggtgcacccccaacttcataggggtagaggctcctgagattaggagaaccctttttaggctttactctatgtacctcttcatttgagtgttcatttgcgtcctttataaccagtaaaacaaagtacgctgttttcttgagttttgtgagccctgtagcaaattatcaaacctgagtagggcagtgggaactcggaatttatcaccattcagaactgcaggttgtccttgtgagtggcatctgatgtgggggaagtcttggactgagccccttaacttgtggagtctgcactaatttagactgcactaactaacttgcactgcactaacttggactgcactaacttgtggagtctgcactaacttggagaagttagtgtcagaattgaattatagaacacccagttgttcagaattgaattgtagaacacccaattggtgtgggagaattagagaatttatttgtgtcagaaaatactccagaacaaccaccccatattatgattagctcttttcctttctttggctctgagcttaattgtacattaagcaaacttaagtagaaaagaaactgaatatgttaaatatattaacaacatatttggacttgcttaacttaagattatngagatgatcagttataaaaccccc

SEQ ID NO: 3463 - DNA, 757 bp, Homo sapiens
  misc_feature 3, 6, 10, 13, 14, 16, 20, 21, 26, 37, 491, 500, 557, 733: n = A,T,C or G
ggnggntttntanntncttnnctaantaggagctctngttctttttgcaggatcccatcgattcgaattcggcacgagatgcagtgtaactggcaggaggggagtgagaactacttgggtagatgatcaggagatactctgcaagaggaaacatacagaaggagcctgacatgagaaaactggggcagcagttttccaggaagagggaccagcacaggtccaagttgaaactcagaatggaattttaggaaattatattcttcatgatggttagatcctgtgggctatcatcactgcagttcaacaatgtggtgcctagtaggaagagttctcccaggaaccctccacgtgtgctatgggatttctgagaaaaccagttctgagttctaggcagtggactcacagttgaacttggagggaaccaagaattgcttccatcatagccttactaagaaatgaccatggcatggcctgagtgcttcggcatggangaccagaangggaagccctaatttgccagttgcagactcttgagccttgtgactctaatgacgacnaaaattaggagattttctaggactcacgtttgcgattttgagagtagtgctgctggggttcctggtttgggttctattgattgtttcattggttctgtgtgcaagttacccttttctaagcttaattttaattaatattatattaagtgaggtaattagattatatgaaccctaangcttccttttattcttaaccctta

SEQ ID NO: 3464 - DNA, 750 bp, Homo sapiens
  misc_feature 1, 11, 12, 13, 14, 15, 16, 17, 18, 22, 24, 26, 30, 31, 32,498, 573, 659, 704: n = A,T,C or G
nggaggtattnnnnnnnntttncnantagnnngctcttgttctttttgcaggatcccatcgattcgaattcggcacgaggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtanggccactggcaacatactcctcttggcccttcccatatctactcttctgtgattgggagactgcaaggcactgangagtatcaaagaagcaaatattttcactttgaaagaaaactgccattttgtatttaaaaaaaaaaaaaaaaaaaaactcgagcctntaaactatagtgagtcgattacgtagatccagacatgataagatncattgatgagtttgacaaaccacactagaatgcatggaaaaaatgc

SEQ ID NO: 3465 - DNA, 791 bp, Homo sapiens
  misc_feature 2, 3, 4, 6, 7, 8, 9, 10, 11, 14, 20, 26, 27, 28, 33, 34,39, 54, 130, 147, 159, 178, 183, 185, 189, 193, 198, 205,206, 212, 217, 219, 221, 227, 229, 232, 236, 238, 239, 249,251, 253, 259, 263, 265, 266, 270, 271, 275, 277, 285, 287: n = A,T,C or G
  misc_feature 288, 294, 301, 305, 310, 314, 319, 320, 330, 335, 342, 347,385, 399, 425, 431, 436, 437, 460, 464, 523, 542, 554, 589,592, 600, 616, 638, 645, 663, 667, 675, 681, 692, 702, 709,720, 727, 731, 732, 734, 743, 746, 747, 756, 770, 771: n = A,T,C or G
  misc_feature 775, 780, 781, 782, 789: n = A,T,C or G
gnnngnnnnnntangtggtnttaagnnnttttnnaatgnagctcttgttctttntgcaggatcccatcgattcgaattcggcacgaggggactacagctgtgtaccaccacaccggcctctcctggcttnttaaccacttacattanaattgagagganaaaggcagttgacaggggntgtantnaatnactngaacncattcanngagganttttntncntggccntnatnagtncnnctattcatcnantntaatgntgancnntacnnttgntncaaagccntnncaatcntaaacgncatncttanatangtatnntcctactgcngcatngagcagntcatnacatcagatacagattctcagcatggaaaacaaagctnggatactgtgtcantgctgctctgtggcaaagaacacctncctttntaagnnacagcctcactctactagaatangtcngagcgcgcccattcatggctgattgcaacttccactggctgggatccagatctagaatntgtgttcagatgccttacntaggaatacatnctaacacattcttaacaggtttcaaggggagatanttngcgatagnacgtagtttatgcttnagttatatgtgtctgcatctgnttttganggtaaacggcttaacccnttanttagggtngtttanagaattgatgngtaaataacnttgatgnaaaagtttcanatggacntttnnantttgccttnaanngtggatatnggtctattgcccanngggntaatnnngaaatancg

SEQ ID NO: 3466 - DNA, 765 bp, Homo sapiens
  misc_feature 1, 4, 8, 10, 11, 12, 13, 14, 15, 16, 17, 18, 24, 454, 552,671, 707, 744, 764: n = A,T,C or G
nggngggntnnnnnnnnnttttcnaatgctagctcttgttctttttgcaggatcccatcgattcgaattcggcacgaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccanagatagaagaagcttatgaaaagttttgtttggaatcagagcgtaagcgaaaacagtaaagttaaatttcagcatatcagttttataaagcagtttangtatggtgatttagcagaacacaagaagagcaagaaaatgtgtcacatctataccaaattgaggatgttgagttatggtactaatgtatgcaactttaattttgtttaacactatctgncaaaattaaactttattccctataactttaaaatgngtatatatatattaatagtttatttatgtacaggttnaattctactgggttttggcng

SEQ ID NO: 3467 - DNA, 747 bp, Homo sapiens
  misc_feature 1, 3, 6, 7, 8, 9, 10, 11, 15, 16, 17, 18, 21, 48, 711, 739,740, 747: n = A,T,C or G
ntnggnnnnnntttnnnngtnggtttttagatcagctcttgttctttntgcaggatcccatcgattcgaattcggcacgaggattcatttttgtactagttaatatcaactctttctcagaagtagtcaaaatataaataaaagttcttcaaaagtaacccaggagcaacagctgagcagtgccagagttgtgaggtaaacatcaatcatttcacaaatgttctgacttgttgagcagtgttcatttccaggtttcaaacttaaagtatctattaagcaatcttaaaagaaagaacaccgccttaggaaaaaagagatttgccaaactcttcatacttccttcaataactgcttagcaaacactcttgagtgtcttctatgggcaatggtctgtatccatagggatacagagatgaatgaacatgaacttggaaaaaattattatacaacacaaagtaggaaaacggtgcacaaagcataaagaaattagcggagggagggattgtttgatggaaggtcttagggagtaggtgggatttgaatttgggtcttggatgggtaaagtaaggtagggcagcagggtgggcggcaaaaagtgggaggttacagtaagtagaatggtcaatagcctattttgactgaagtaagggttaaggcttgttgggagcctgatgatagatggggatgctgtaaactcactgggatgttttncaaaagagaaccctttaaaaactgcgtnnaggagcn

SEQ ID NO: 3468 - DNA, 774 bp, Homo sapiens
  misc_feature 3, 6, 7, 10, 16, 23, 549, 561, 587, 634, 680, 694, 704, 732,734, 738, 742, 743: n = A,T,C or G
ggnggnnttntttatntatacangctacttgttctttttgcaggatcccatcgattcgaattcggcacgagagagcgagtctctctttgttgcttaggtttgtcttgaaatcctgggttcaagcaatcctccctcctcagcctcccaaaatgctgggattacaggtgtgagccaccacacctggcctctactttcttatatttccttaaatagatttcctttctttttggattaagaaaaaataaacagaaaattaaaatttgaacatattataaaaatgaaagataattgtaaaatcttggtttggagagtgtctctctgagcccagaaatcatccagaaaaatggacagatttgactgcatcacatttaaaaactttacaatgatgaaaaatacaagtgaagctattcatacaatagattaggaccaagtatttttaacatgtattatagacaaaaaattaccatccaaaatatagaattgtacaaaaattttaaaaacatggttaaaaaatgggcatagggatataacccggataattcacagganggaaaaaaaatncaaatggcccaataaaccatgaaaanggtggttggtaaggctggggttgaaggtgggcttcacttcctattanttttccaaccacttttggggaaagcccaagggaaaaaagggattgnactttggggatcanggcttcgaanccttttagaaccttttggtggagtccgnanttancgtnngatcccggaccttggataaggatcccattgg

SEQ ID NO: 3469 - DNA, 746 bp, Homo sapiens
  misc_feature 2, 8, 9, 10, 11, 16, 17, 27, 29, 37, 38, 39, 459, 460, 490,494, 510, 511, 535, 543, 550, 551, 553, 558, 565, 566, 582,590, 595, 597, 602, 603, 605, 613, 615, 616, 617, 618, 619,622, 623, 627, 630, 632, 633, 634, 636, 638, 640, 641: n = A,T,C or G
  misc_feature 642, 643, 644, 646, 648, 649, 650, 651, 652, 654, 656, 657,659, 660, 661, 662, 665, 668, 669, 670, 671, 672, 675, 677,678, 679, 680, 681, 682, 688, 689, 691, 692, 694, 695, 696,704, 709, 710, 711, 712, 714, 715, 716, 717, 719, 720: n = A,T,C or G
  misc_feature 723, 726, 727, 731, 735, 738, 742, 743: n = A,T,C or G
gngggggnnnnttttnnaaggcgcgcntnttctaatnnnagctctctttttgcaggatcccatcgattcggaaaatggtatctttcagatttctagaagttcaagtgtcatacaacaaaacaggaaccccctttactcttatggacctcatttcaatatactgtttacagtttgatggaattgtataatttaatatttctcttgtactgtagtttatatttatttacagatttttttgtactgtgtgatttgaactttttgttccttgctatgatcaatgtttatgtagtagagcacttatgatcacaaattaagttttttggtttgattgcactacattaaattttttaatgcagttctgatttttgactggactaaaactgtgtcttaatgtatgtgatgagtacttaaaattttaatccatgtggtcccccccctttttttttttgcattgtatgnnaaaagcgcttggtctttcgtgcatgtgtantatntaatggtacccattgnntagttgaccatgacatttttgganaaacattncagctgnnangttgngtatggnngctcactggatgctanactttttnaaatncnaattnntntaaataanannnnnttnngaantantnnntntntnnnnncncnnnnnancnntnnnnccnttnnnnnttntnnnnnngaactnntnncnnnttccctgntttannnntnnnntnnatngcnntttntacnccncttnntcc

SEQ ID NO: 3470 - DNA, 728 bp, Homo sapiens
  misc_feature 2, 5, 6, 7, 8, 9, 16, 421, 422, 423, 424, 425, 426, 427,428, 429, 430, 431, 432, 434, 456, 503, 569, 597, 656, 686: n = A,T,C or G
gnggnnnnntttatanatacagctacttgttctttttgcaggatcccatcgattcgaattcggcacgaggctgggagtataggctgagttaggaagattgcttgagcccggaaggcagaagttgcagtgagccaagatcgcgccactgcactcccaactggacgacaaagcgagatactgggagtataggcattcgccaccctgggcaacatagcaagaccctgtgtctacaaaaaatttaaaaaaaattagcctgtagccctagctatgcaggaggtggaggtgggagaattgcttgaacccaggagtttgaggttacagcgagctgtgatagcaccactgcactccagcctgggccacagagcaagatcgtacctcttaaaaaaaaaaagaaaaacacaagcaaccaaaaaaaaaaaannnnnnnnnnnnanaaaaaaaaaaaactcgagcctntagaactatagtgagtcgtattacgtagatccagacatgataagatncattgatgagtttggacaaaccacactagaatgcagtgaaaaaaatgctttatttgtgaaatttgngatgctattgctttatttgtaaccattntaagctgcaataaacaagttaacaacaccaattgcattcattttatgtttcaggttcangggggaggttttggaaggttttttaattcncgggccgcggggccaatgcattgggcccggtacccaattttt

SEQ ID NO: 3471 - DNA, 728 bp, Homo sapiens
  misc_feature 3, 5, 7, 8, 9, 10, 11, 16, 23, 635, 642, 685, 711: n = A,T,C or G
ggngngnnnnnttctnaatagcnaggctacttgttctttttgcaggatcccatcgattcgaattcggcacgagcagaagcacaggcaaggatcaatgcccggcttcagcagtatcgtgccaaagcagaactagctcgatctaccagaccccaggcctgggttccaagggaaaaattgcccagaccactcaccagcagtgcttcagctattcgtaaacttatgcggaaagcagaactcatggggatcagtacagatatctttccagtggacaattcagatactagttctagtgtggatggaaggagaaaacataagcaaccagctctcactgcagattttgtgaattattattttgagagaaatatgcgcatgattcaaattcaggaaaatatggctgaacaaaagaatataaaagataaattagagaatgaacaagaaaagcttcatgtagaatataataagctatgtgaatctttagaagaactacaaaacctgaatggaaaacttcgaagtgaaggacaaggaatatgggctttactaggcagaatcacagggcagctttgaagatgctttatgtgaaaagaatgtgtgtggcttggatcctaaagaatgttttaaaaggtgagaattagtantcgcctntgggaggatcagcctttggtcctgttaatagaagttgaatatnccggcaattttgcgagcccccaaggnggagaaaaccaagttaa

SEQ ID NO: 3472 - DNA, 731 bp, Homo sapiens
  misc_feature 2, 4, 6, 11, 17, 19, 638, 647, 658, 659, 660, 661, 662, 663,664, 665, 666, 667, 677, 679, 686, 690, 696, 698, 700, 707,717, 718, 724, 725, 729: n = A,T,C or G
gngngnccttnaaatcncnggctacttgttctttttgcaggatcccatcgattcgaattcggcacgaggaggattagccatgctggggtctcttggacaaaaggctggtactgattgaaaaattccctgagtatgtctagaagtgtcaggctcctctggaatcagttacagtgggattggctgcttaggtataatctttataagattaaaaattatagattatttggcagcttgtttgaaagtgttggtcccaagaaaaagttctgctgtgtgttatggcagaattattaaaaaaaatacattcttaagttgaggtttctaagtaggcttttgtaaaaacaggcaattacttgctggaggcagttaattgcatgcacagatgggtacttgtgttacaaattcctcatttgcacttgtgattacccatttgcaataattcatgaaacctagggaattcttaggtacaaggaaaggttttaggcatttaaaaaacgtatcactaccatcagaggagatggagaaaacaaagagctaagtataaagccttattccaaatgctaagttcagagaatattttctgaagctcgcggttgttgaaggtaagaggtttacttaagctattggttccatggactctnttcactttnaaaaaaaaaannnnnnnnnnaaaaaaaacntngagcccnttanaacttntngnggagtcntatttccgtnnaatccnnaacntg

SEQ ID NO: 3473 - DNA, 727 bp, Homo sapiens
  misc_feature 2, 6, 7, 8, 13, 21, 726: n = A,T,C or G
gngtgnnnttttnagatacangctacttgttctttttgcaggatcccatcgattcgaattcggcacgagggggtatcccttgagaccaccttgggaccagtgcttgcaagcagcgagatatttccccagcaaaaccaggcagctgctaattaaatgcttagaaccaatgaaagctggctgtggtcctgcctgtgagctgcctactgctgccttctgaatgcatatatctgctactgtagccccgggttgtcaaactatggcctgtgggccaaatccagccacagtcggttctttaaagttttatcgaaacacaagcaatggaaatgcccatttccattgttgtctccagttgctctgctccgagggcagtgttaagttgtgcagcagaggcccctccatgcaaagctgaatatgtttactatttgaactttttcagaagttctgcttaaggacaaaataaagcctaaatccaagaacacttttaaaaatgaggaaatagtgaacacaatagacggaagtctggaagtttctacccatgccaagaaaagcattttatgtttggtcacatatgttgtgcaattcaaatttttttccctatattctctgactagacacttgtactgagtcaattggcgagtgtgtctgtctaaaagcccaatttcaaaatatcactttaaaggcatctttacatagtggggtttaagaaaaaagttgttattcagcaana

SEQ ID NO: 3474 - DNA, 731 bp, Homo sapiens
  misc_feature 3, 6, 7, 10, 11, 15, 21, 539, 581, 634, 648, 649, 665, 715,729, 730: n = A,T,C or G
ggnggnngtnnttcnaatgcnaggctacttgttctttttgcaggatcccatcgattcgcttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccggagagagtgccagggtgccctggtctgagctggcatccccatgtcttctgtgtccgagggcagcatggtttctcgtgcagtgctcaagacacagcctgccctagtcctaccagctcacagcagcacctgctctccttggcagctatggccatgacaaccccagagaagcagcttcagggaccgagtcagattctgttttggctacatgcctctgccgggtgccggtattgaggcacccaaggagctgntactggcgtggaaataggtgatgctgctacctctgctggttnactcacaagccacacttgatacacgatgacaccttgcttggttgggaaacatnttaaacatctagtnnatgacttgcaggctgntggctaccagtttcctgtcttgaaggggtaatatggttaactttcgggancaggttggaatgtnng

SEQ ID NO: 3475 - DNA, 757 bp, Homo sapiens
  misc_feature 10, 11, 12, 13, 14, 15, 16, 17, 28, 540, 646, 693, 754: n = A,T,C or G
ggtgttatannnnnnnnttttcaaaganacagctcttgttctttttgcaggatcccatcgattcgaattcggcacgagattatttaaagcttattcaatttaaaagactacttgtaattccggacttattctttgaatagttggtattaaggtttcttttgtaaaataagaggtggtagtatttttcaatgcccttaattaacaaaattaaaagtttgaaaaccatatgttgattctccctcattttaaaaaattttgtaattccactggtccacaaaaatcccaattgaggagagctctgggaagagcacattctgtcaatgggtctcaacattttggtctcaggaccactttacattcttatttaggaaatgacctaaatgtctttcaactagtgaacgaataaactggtacatctgtgtaatggaatactacttcacaatcaaaaggaatgtactattgatacacacagctacatgggtgaagctcaaatgtattatgctgaatgaaagaagccagactcaaaaagctgcttactgntatgttctatttatatgacattcttgaaatgacactacttagggatggataatagattagtggttgccaggagttggggtagtggaaggggtttactacaatggantggcataagggaaattatttggggtgttgaaactcttaattggtggntacataattctatgcatttggcaaaattcatggagctgcacacccaaaagagtgaattttntcc

SEQ ID NO: 3476 - DNA, 761 bp, Homo sapiens
  misc_feature 3, 4, 5, 6, 7, 8, 14, 15, 20, 23, 24, 25, 26, 28, 31, 36,37, 630, 633, 640, 655, 706, 715, 737, 748: n = A,T,C or G
tgnnnnnntttttnnaaggngcnnnncnttnaaatnnctggctacttgttctttttgcaggatcccatcgattcgctaaagccggctatgggaagccatgtcatacttggctaccttcctatgttccttctcacagcaaaactcttggactgatcatttgaagtcacccctctgtgtcttcttgtgaaatggcttgggcgtctctgggctctgacttgctcatctgggaagagatggggtagagggagttggattataaatcatgcttcactcagtcaacagaatgctactcaggcactaaaaatgatggcgtagccctacgtattctgacatgggaagatggccacaatatcttattatgtggaaaaaactagttgcataggatttatggtttgattacattttagtaaaataaattcatttatggtggtatatgcaaagaaaaaataatgccgggcgcagtggctcacgcctgtaatcccagcactttgggaggctgaggcaggtggatcacttgaggccaggaggttgagaccagcctggccaacatggtaaaaccccatttccattaaaaatacaaaaattagcaccaagccgtggtggcacgtgcctgtagtcccagctactcangangcttaanatgggaaaacttgcnttgaacctggaaaggtggaaggtttgcggtgaagcccaagaatcacgccanttggacttncggcctgggcttacaagcccanacttttgcttnaaaaaaaaaaaaa

SEQ ID NO: 3477 - DNA, 764 bp, Homo sapiens
  misc_feature 1, 5, 8, 15, 24, 32, 33, 48, 112, 611, 649, 650, 651, 652,653, 654, 655, 656, 657, 658, 659, 660, 661, 662, 663, 664,665, 666, 667, 668, 669, 670, 671, 672, 673, 674, 675, 676,677, 678, 679, 680, 681, 682, 683, 684, 685, 686, 687: n = A,T,C or G
  misc_feature 688, 689, 690, 692, 693, 694, 695, 696, 697, 701, 702, 703,704, 705, 707, 708, 709, 710, 711, 712, 713, 715, 716, 717,718, 719, 720, 721, 722, 723, 724, 725, 726, 727, 729, 730,731, 732, 733, 734, 735, 736, 737, 738, 739, 740, 741: n = A,T,C or G
  misc_feature 742, 743, 744, 745, 746, 747, 749, 750, 751, 752, 753, 754,755, 756, 757, 759, 760, 761, 762, 764: n = A,T,C or G
naatngcnagctctngttcttttncggattannaagccttagcaggcngggaagatgaaaggtagccggatcgagctgggagatgtgacaccacacaatattaaacagtttnaaagattgaatcaggtcatctttccagtcagctacaatgacaagtctacaaggatgtgctggaggttggcgagctagcaaaacttgcctatttcaatgatattgctgtaggtgcagtatgctgtagggtggatcattcacagaatcagaagagactttacatcatgacactaggatgtctggcaccttacccgaaggctaggaataggaactaaaatgttaaatcatgtcttaaacatctgtgaaaaagatggtcttttgacaacatttatctgcatgtccagatcagcaatgagtcggcaattgacttctacaggaagtttggctttgagattattgagacaaagaagaactactataagaggatagacccgcagatgctcatgtgctgcagaaaaacctcaaagttccttctggcagaatgcagatgtgcaaaagacagacactgacaaattacaaatgaactttcttgcacttgcttgtcgcccaataaaagagangcccattgattcttccccaccccaaaaaaaaaaaaaannnnnnnnnnnnnnnnnnnnnnnnnnnnnnnnnnnnnnnnnnannnnnncccnnnnnannnnnnncnnnnnnnnnnnnnannnnnnnnnnnnnnnnnnncnnnnnnnnngnnnnan

SEQ ID NO: 3478 - DNA, 717 bp, Homo sapiens
  misc_feature 11, 609, 628, 687, 698, 709: n = A,T,C or G
aatcagcctgntcttttgcaggatccctcgattcgcttgagcccaggagttcaagtccaacttgggcaacatgacaagacccttgtctctttaaaaaagcaactcaaaccatgtcttgaaaagctatttaatggtcagacacgatggctcacgcctgtaatcccagcactttgggaggccgaggcaggcggatcacttgaggtcaggagttcaagaccagcctggccaacatggcaaaacccagtctctactgaatgaaaatacaaaaattagctggcctagcagttggtggtggcaggtgcctgtagtcccagctacttgggaggctgaggcaggagaatcgcttgaatttgggaggcggaggttacagtgaacccacatggcgccactgcactccagcttgggtgatagagtgagactctatctcaaaaaaaaaaaaaaaaaaactcgagcctctagaactatagtgagtcgtattacgtagatccagacatgataagatacattgatgagtttggacaaaccacaactagaatgcagtgaaaaaaatgctttatttggtgaaatttgtgatgctattgctttatttgtaaccattataagctgcantaaacaagttaacaaccancaattgcattcattttatgtttcaaggttcaagggggaaggttttgggaaggttttttnaattcgcgggnccgcggcgccnatgcattg

SEQ ID NO: 3479 - DNA, 769 bp, Homo sapiens; identical to SEQ ID NO: 527
  misc_feature 6, 109, 114, 117, 127, 145, 147, 148, 162, 172, 185, 190,259, 350, 403, 435, 531, 599, 641, 685, 715, 731, 756, 769: n = A,T,C or G

SEQ ID NO: 3480 - DNA, 769 bp, Homo sapiens; identical to SEQ ID NO: 527
  misc_feature 6, 109, 114, 117, 127, 145, 147, 148, 162, 172, 185, 190,259, 350, 403, 435, 531, 599, 641, 685, 715, 731, 756, 769: n = A,T,C or G

SEQ ID NO: 3481 - DNA, 777 bp, Homo sapiens
  misc_feature 4, 6, 9, 222, 486, 522, 539, 547, 651, 694: n = A,T,C or G
taananatncagctacttgttctttttgcaggatcccatcgattcgaattcggcacgaggccaagcctcggcctccactgcacctgctgcggagtggcacctttgcctgcaaggcccttctaccccatggcccaatgtcatcttaacaaggtctttggccacttcaagaaggccttgtggtgggttgctcaatctggcctttccttcatgaaaaactactgnttatgtccacagaccaagaaggaactgtcacgctggtaccacaagtctgacttgggctatcaacagccagaaaaactagaggaatcttatagattccagaactcaggatacctcaaggataggtcacaagcaagagtacaaaggaatcttcagtactgaacaaaacagaacccttcatgatttgacaaaggtcactttctggttgcctggaccaagctactccagatcatctgaccaactcttaaaaatcacgggcaggcacantggctcatgcctgtaatccagcactttgggaagcanaagtggcaggatcattncagcccangagttcaagaccagctgggcaacacagtgagtgagaccctgtctctatttaagaaaaaattattaagaaattttattaaaaaagaagaatcaggaaaccaagtncaacccaacttaacctaaatgaaccaacccctacacagatgangggatttgggactgataactctgggctgggtccatggcccgtcattatcaaggttgaactttgtaaaggggctttttttatgt

SEQ ID NO: 3482 - DNA, 777 bp, Homo sapiens; identical to SEQ ID NO: 3481
  misc_feature 4, 6, 9, 222, 486, 522, 539, 547, 651, 694: n = A,T,C or G

SEQ ID NO: 3483 - DNA, 779 bp, Homo sapiens
  misc_feature 1, 2, 3, 4, 5, 6, 7, 8, 9, 10, 11, 12, 13, 14, 15, 17, 30,41, 142, 200, 207, 218, 238, 301, 494, 504, 558, 610, 628,646, 665, 670, 683, 721, 723, 749, 755, 760, 762, 763, 776: n = A,T,C or G
nnnnnnnnnnnnnnntntgaaacccttttnaagccttttgnaggaccctcgatcgaattcggcacgaggaacagacaagttctgtcccagcctctgttacctctaaccccatggcattctatccttttctacactgggcttncatttcttacccaacaatggactggtctttcaaggtgctggcatttaaattcccaaanacttggncctcttctganttggggacctccttcaaagntgaattgcagtgagtgacaataaactgggctaaatacttatcttgccagaagactcaaagggnttaaggcttttactaactgaactctatgctagaaggtaaggataaaagggtaacaggacacaagtcttgcttaacttgctatgggctgtcaagccttatcaaactaaccctatctctcttcacctcttatctttatcacccgtagattccttggtggccactgggttctttcaagccttaattagccctttgncactacctgnctacacatgctggttttccgtctcattccatcttgacattggctattttgaganctcaacttaattgcagaagaactggcttcccatctggcaacccattatatgnggcaaaagaccatgttgnaccatagagctagaccangtgccatggtggggcttgnaaagnattcaccaacttncaaaggttacctaaatccctttactcaagaagcctaantntactggacagtgggaaaaataacccntttggnataangnncccaaaaaaaagnaag

SEQ ID NO: 3484 - DNA, 757 bp, Homo sapiens
  misc_feature 5, 39, 660, 707, 733, 740: n = A,T,C or G
taaanatcagctcttgttctttgcggacttatcgatccnaattcggcacgagggtatttgttcttgaaccacacccgttcgatcctagagttctcttttctgctggtcatgatggaaacgtgatagtgtgggatctggcaagaggagtcaaaatacgatcttatttcaatatgattgaaggccaaggacatggcgcagtatttgactgcaaatgctctcctgatggtcagcattttgcatgcacagactctcatggacatcttttaatttttggctttgggtccagtagcaaatatgacaagatagcagatcagatgttctttcatagtgattatcggccacttattcgtgatgccaacaattttgtattagatgaacagactcagcaagcacctcatcttatgccttccccttttttggttgatgttgatggtaaccctcatccatcaagatatcaaagattagttcctggccgtgaaaattgcagggaggagcaactcatcctcaaatgggagtacttcctcaggactgaatcaagttttaagtcagcaagcaaaccaggagatcagcccactggacagcatgattcaaagactacaacaggacaagacctgagacgttcttggtgaagcaggtttaataatccaccgttaagtagangctccataagtctacctcaaaggtcattcccaccaacgtaggcttanacgtatggacaaattgaagtgtccgnaaatgcncagaacgcccaagaaat

SEQ ID NO: 3485 - DNA, 779 bp, Homo sapiens; identical to SEQ ID NO: 3483
  misc_feature 1, 2, 3, 4, 5, 6, 7, 8, 9, 10, 11, 12, 13, 14, 15, 17, 30,41, 142, 200, 207, 218, 238, 301, 494, 504, 558, 610, 628,646, 665, 670, 683, 721, 723, 749, 755, 760, 762, 763, 776: n = A,T,C or G

SEQ ID NO: 3486 - DNA, 764 bp, Homo sapiens; identical to SEQ ID NO: 3477
  misc_feature 1, 5, 8, 15, 24, 32, 33, 48, 112, 611, 649, 650, 651, 652,653, 654, 655, 656, 657, 658, 659, 660, 661, 662, 663, 664,665, 666, 667, 668, 669, 670, 671, 672, 673, 674, 675, 676,677, 678, 679, 680, 681, 682, 683, 684, 685, 686, 687: n = A,T,C or G
  misc_feature 688, 689, 690, 692, 693, 694, 695, 696, 697, 701, 702, 703,704, 705, 707, 708, 709, 710, 711, 712, 713, 715, 716, 717,718, 719, 720, 721, 722, 723, 724, 725, 726, 727, 729, 730,731, 732, 733, 734, 735, 736, 737, 738, 739, 740, 741: n = A,T,C or G
  misc_feature 742, 743, 744, 745, 746, 747, 749, 750, 751, 752, 753, 754,755, 756, 757, 759, 760, 761, 762, 764: n = A,T,C or G

SEQ ID NO: 3487 - DNA, 788 bp, Homo sapiens
  misc_feature 2, 3, 21, 37, 98, 485, 526, 664, 695, 723, 750, 765, 788: n = A,T,C or G
gnntttgataccctttttgantgccttttgcaggacnctcgttcgaattcggcacgagggaacgcagctgctcaccagcaacggaacaaagctggacngagaatgactttgaagagctgagagaagggcttcagaccgatcaaattactctgagcttacggggagggccattcaaaccaaagggcaaagaaagtttgaaaactttgaaaaaaataaatggtcattaattaaacgtggaaatctggtgaacaagtaacaaactttggtgaaatttcaggaccatagccattgaagtggatgagggaacctatatcatgcactcaacaatggtctttttaccctgggagcttcacacaaagaagaatcgccctgaaacctggctatggaaaataccttagtataaattcagatgaacttgttgttggcgttcagatgcaattggccaagagaacaatgggaaccagtctttcaaaatgatggccatncagtaatgagaatgaacagtcttcaactaaaggcaacaatntagatgaatctcggaaacatgatattgaccaagacagaaaagattcacttacataaacttcaaaagaagataaaactgatctatgacattaatagtcagaatattcattatccttgagggaactaaactgggaagccncatgatagggcattttggaagctagtaatgncctctttcttgatctggtacattggtgnggttatttcattagatttattgagctntacatttaccaccgngtccttggctctggatatgtttn

SEQ ID NO: 3488 - DNA, 800 bp, Homo sapiens
  misc_feature 1, 2, 3, 8, 9, 10, 12, 15, 184, 209, 235, 253, 275, 281,309, 513, 529, 539, 682, 734, 737, 743, 760, 768, 781: n = A,T,C or G
nnnttttnnnanatncagctcttgttctttttgcggatcctatcgattcgaattcggcacgagttcaccaatgacatgatcttatagcgattctataaaaacagaattattaaccaaattcagcaaagttggtcaaattccaaaattaacccccagaaatcaggtgctttctattatagtactngccaggtggaaccacttcatggaanggaaattagccaggttcatttaaatngcattcaaaaaggaattnaaattccttagggaattaaccnaggganggtgaaagacttggtccccagaaaactnccaaaatattggttggaagaaattaaagaagacataattaaatggaaagacatcctggtgttcaattatatccatttaaagacacaattaaatgggaagacatctgtgttggaaagtttaatattggtcacatgtcagtctacccaaagtggcatcagaggcaatgcaatcctattaacatccacagtgtttttttaggaaatnttaaaacctatcacangccaggttcngttggtcatgcctgtaatcccaatattttgccaagcctaggagttcaagaccagcctgggcaacatacgagaccctagctttacaacacaccaccaaaagcccggtgtggtagcacatgtctgtagtcacaggtcctttagangttgaggcaggaggatcacttgagccccaagaatttgaggcacagtgggctnttntcaggnttcttaactccagtctnggtgacanggggaaaacctgnggctaggtttaaaaaaaaa

SEQ ID NO: 3489 - DNA, 804 bp, Homo sapiens
  misc_feature 2, 3, 4, 8, 13, 14, 15, 17, 32, 160, 272, 318, 319, 322,323, 324, 327, 328, 329, 330, 332, 333, 334, 335, 337, 338,340, 341, 342, 343, 344, 345, 347, 348, 349, 351, 352, 353,355, 358, 359, 360, 362, 364, 365, 369, 373, 375, 376: n = A,T,C or G
  misc_feature 377, 378, 380, 381, 382, 384, 386, 387, 388, 389, 392, 393,394, 395, 396, 397, 398, 399, 402, 403, 404, 405, 407, 408,412, 414, 417, 420, 421, 422, 423, 424, 425, 426, 427, 428,429, 439, 440, 441, 443, 447, 450, 456, 458, 459, 460: n = A,T,C or G
  misc_feature 461, 462, 464, 466, 467, 471, 472, 473, 474, 475, 476, 478,479, 480, 482, 483, 484, 485, 487, 488, 489, 490, 491, 492,493, 497, 498, 499, 500, 501, 502, 503, 505, 507, 510, 511,512, 513, 514, 515, 516, 517, 519, 520, 522, 523, 524: n = A,T,C or G
  misc_feature 533, 542, 543, 547, 548, 549, 550, 551, 554, 555, 556, 559,560, 561, 562, 563, 567, 569, 570, 574, 575, 579, 580, 581,582, 583, 585, 586, 587, 588, 591, 594, 595, 596, 597, 598,599, 601, 604, 606, 607, 612, 613, 614, 623, 624, 625: n = A,T,C or G
  misc_feature 626, 627, 628, 629, 630, 631, 632, 633, 634, 641, 642, 645,651, 653, 658, 659, 661, 662, 663, 664, 666, 667, 672, 673,675, 677, 679, 680, 681, 682, 685, 692, 693, 694, 695, 698,699, 707, 708, 712, 713, 719, 722, 723, 724, 725, 728: n = A,T,C or G
  misc_feature 729, 730, 735, 736, 737, 738, 739, 740, 741, 745, 746, 747,749, 750, 751, 752, 754, 755, 756, 757, 758, 759, 761, 762,763, 764, 768, 773, 774, 776, 777, 778, 779, 780, 781, 782,783, 784, 787, 789, 790, 791, 792, 793, 794, 795, 796: n = A,T,C or G
gnnntttnaaaannncnagtttactttgttantttttgcaggatcttatcgatccgaattcggcacgagcatggtaatcctgctcagtacgagaaggaaccgcaggttcagacatttggtgtatgtgcttggcttgaggaagccaatggggcgaaacctncatctggtggggaaggaaaggaaggcagggctggtgggtggggactggggtaggggtattagtatcactcctggaagtttccactggcttcttagaaatctaacccagaaantagaaacctaattttttaaagggtgactgggcaaaaaaaaaaaaannaannnatnnnnannnnannannnnnnannnannnanacnnncnannatgnaccntnnnnannntncnnnngannnnnnnncannnnanncatngnaanttnnnnnnnnnntgaaaaactnnngncctnaanaaaatngnnnnntntnnaatnnnnnncnnntnnnntnnnnnnnttgnnnnnnnancnccnnnnnnnnanngnnnaaaaaaaanttttttttnnaaannnnnaannnttnnnnntaantnnacanntttnnnnngnnnnaanaannnnnncncanannattgnnnttttttttnnnnnnnnnnnnggggggnnggngggaantnttttnnannnngnnccccnngncntnnnnttngggcccnnnnccnntttttttnncccnnttgggnggnnnnttnnnccccnnnnnnnaaannngnnnnannnnnntnnnnaaanaaaanntnnnnnnnnnaantnnnnnnnngnggggnc

SEQ ID NO: 3490 - DNA, 779 bp, Homo sapiens
  misc_feature 2, 3, 8, 11, 12, 13, 14, 15, 16, 21, 26, 29, 122, 134, 144,154, 156, 157, 171, 175, 177, 181, 195, 200, 202, 205, 212,218, 223, 226, 227, 233, 235, 237, 254, 256, 259, 260, 262,267, 271, 274, 276, 284, 301, 379, 396, 404, 420, 426: n = A,T,C or G
  misc_feature 483, 493, 500, 510, 526, 553, 596, 648, 709, 746, 757, 760,771, 778: n = A,T,C or G
gnnttttnaannnnnncagtntactngtngtttttgcaggatcctatcgattcgaattcggcacgagcgagttttttttttttttttttcttcctctctttctctcttccttcctccttccnttcctccgttcntccccccccntttttttggnannagggtttttttttngtgncnaggnctggagtcaagggnccaantnccngttaatngaaccntgacntcnngggccnangnaatccttttaacttaancntcnngnaaacngggnccncnggcccatncaacaaaaccaagttangattttttttttttaaaatttttgagcaacagggggatctcctggggtggcccaaatgggcttaaaactcctggcttnaaatggatcctccggcntaagcctnccaaaggctaggattntaagcntaagccaccacacccagcccattctttataattactttatggttcaaagcagcttanggttactggnaaattgngaagaaattnccgagttccacatctnccaactttgcatttttacatgactggntttctctattctataacctaataagcatgcttttcctaccttnctactgaactttttactaatatattatctaattgaaatgagcatacccagtncatttactagaattagatgtgggactcagaaataaatctgcaggttggtttggaccaactntgggaaaagctacctcaaatttgtggagggccaaagnttgcatttgcnctntactggaacanggggagna

SEQ ID NO: 3491 - DNA, 793 bp, Homo sapiens
  misc_feature 38, 39, 55, 157, 169, 237, 428, 591, 624, 626, 658, 661,665, 669, 672, 679, 705, 733, 749, 777, 788, 790: n = A,T,C or G
agctcttgttcttttgcaggatcctatcgattcgcatnnggcacgagaaatattntgatactgtacccgttgctgctgccatgtgtgtgcttaaaacagggttcctttttgtagcatcaagaatttgggaaaaccattctttatatcaaaattggcncatctttgggangaatgaatgaatgaaagaaccctggagttttcaatcaacccatgccctcttggaaagaagggagaacncatttctttttttcaacccaaagaaccactttaaaaaccttggtgctgggttgatgaagttgggacaagcctcttctcccattctggtttgccagatagctgatctggccaatgaagatctccacagttgtatgtggcctgtggtaggggaccccgatcatctctgagaagtcctaagacatggacttgangtgtcagaaatggctggttctgagctacctggtaccccaacgcttgtctggacagtgcgtcgacacattgaagatgagtttgatgcctacatcattgggtctttcgtgaatgccaccctaatgttgtccattggagaaactgtagaagaagtgactgactctnggttcctggggaccaccccgacttggcctgctncntattaggagatgatgccttggtgcaggctatncanatgnattnggnacatacnagccgacaagaaagtcaatgaatggnaaaaccctggaagaaaacaattgtgaantgtgcaatggaaccancgaccagtggtgaatggccttacaggangaaaactggtntnttt

SEQ ID NO: 3492 - DNA, 843 bp, Homo sapiens
  misc_feature 4, 5, 6, 9, 113, 136, 139, 142, 145, 148, 151, 154, 159,246, 247, 261, 271, 363, 442, 460, 477, 517, 542, 580, 701,712, 718, 752, 754, 779, 805, 813, 818: n = A,T,C or G
tatnnnatncagctcttgttctttttgcggatccctcgattcgaattcggcacgaggaaagaccgagatagagagagagacagagacagagagcgagacccgtggttccgggncagagaaaggaggaacccccccnganganganganganganggganccgtgattcaccagtcccttccaccaaagtgtttttcaaccagccgattgaaagaaccgattccaggattccaggggaattttgccnngaaaaggaaggttnttgaaccgtnaccaagaagcaaagttcgaggaaaaaaaggaaagaaccgaccatttgaggaaaaggaccgaccaccaggggagaaagaaggaaacccagacnttaagtcttcttcgaaagttattagtagacgtcgccatgaaagttgaagaaaggagattgtcacaggagaccaaacccnaaaaatctaaaagaagcnaagaagggaaagaagcnggcagtgagccttgcccttgacaggagagccccgaaactncaccttgcagaatagcatgggtttngccttttgtgtatattagtaccagaagtagatactatnaatcttggtatttttctggataatgtttaagaaatttaccttaaatcttggtctggtttggtagtatgaaaagttaacttttttttccaaattaaagagtgaatttttcattgttaagttnaaaatctttgncttgtnctatttcaaaaattaaaagaccgcaatgactttntnttccaaaaaaaaaaaaaaaaaactngggcctttaaacttttgtgagtcgtnttacgtanatccngacttgttaggatccttggttgagt

SEQ ID NO: 3493 - DNA, 775 bp, Homo sapiens
  misc_feature 3, 7, 772: n = A,T,C or G
tanacancagctcttgttctttttgcaggatcccatcgattcgaattcggcacgagggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttagagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagcttccaaagtggatgaagatgaagaacactaaagcagttggctgaatgggtatcctgataaatctgggcttgtcttncta

SEQ ID NO: 3494 - DNA, 879 bp, Homo sapiens; identical to SEQ ID NO: 3392
  misc_feature 2, 4, 6, 7, 8, 9, 10, 13, 14, 15, 16, 17, 20, 21, 22, 23,24, 25, 26, 27, 29, 30, 31, 37, 187, 215, 217, 219, 228,237, 280, 334, 349, 373, 375, 387, 422, 446, 455, 464, 493,503, 519, 531, 567, 573, 599, 616, 654, 689, 718, 842, 878: n = A,T,C or G

SEQ ID NO: 3495 - DNA, 705 bp, Homo sapiens
  misc_feature 11, 442, 602, 672, 705: n = A,T,C or G
cagctcttgcntttatgccgatccctcgattcgaattcggcacgaggagacgtcgtctctacaaaaaataaaattagccaggcatgatggcctgtacctgtagtcccagctactcaggaggttgataggggaggatcacctgagcctgcgaggtcgaggttgcagcaagccaagatcatgccactgtacttcagcctgggcgatagagaccctgactcaaaacaaagaagacccagtacaagttcagtgttgagtgctaaagacttaaaagagttataaagctgaacccttaatcttaagaggtttataagtgagaacaagaatctccaaatcctgtactgtttaatatcagcatgagactaaaccactgtcctaagaagacaaccttaatttgaatcaagttattttagagtgatgtgttttctgaggcagctctcagaangttattgtctggtgttaaaatagtgaaattgagtaataacaaggttaaaatcggtggacattaaatacacacaagacttcaattgctgggtcctccattgattaatgaaaaaatgattgtttttggaatttgagtgaaacacttcttaatggctgagtanggtggcttacgcctgtaatcccaccactttgggatcactttgaggccgggacttttgagaccagcttggncaacatgaggaaagcacgtctttctaaaaatcn

SEQ ID NO: 3496 - DNA, 709 bp, Homo sapiens
  misc_feature 3, 21, 24, 27, 30, 548, 549, 550, 551, 552, 553, 555, 556,557, 558, 559, 560, 561, 562, 563, 564, 565, 566, 567, 568,569, 570, 571, 572, 573, 574, 575, 576, 578, 579, 580, 581,582, 583, 584, 585, 586, 587, 588, 589, 590, 591, 604: n = A,T,C or G
  misc_feature 606, 607, 611, 629, 658, 666, 667, 680, 689, 693, 696, 709: n = A,T,C or G
ttnaatcatgctcttgtttcnaancgntgncatcgattcgaattcgcacgaggtggtcttcagtctgtcgtgcaccgatgagaactctccttattgctgtgaagggcagacaatgcatggctgatctactctgttaccaatggctttactagtgacacgtcccccggtctaggatcgaaatgttaacaccgggagctctccaggccacccacccggagagacgtcgcgctgtggcctgaagtggcgcaagcttgctttgtaaatatctgtggtcccgatgtagtgcccagaacgtttgtgcgaggcagctctgcgcccgggttccagcccgagcctcgccgggtcgcgtcttcggagtgcttgtgacagtccttgcccagtatctagtccccgtcgccccgtgcaggagacgtaggtaggacgtcgtgtcagctgtgcactgacggccagtctccgagctgtgcgtttgtatcgccactgtatttgtgtactttaacaatcgtgtaaataataaattcataatgacttctacctttaaaaaaaaaaannnnnntnnnnnnnnnnnnnnnnnnnnnngnnnnnnnnnnnnnnaaaaaaaaacctngnnaacnggatgccaccctgggccnacgaattttcctgccaatgttgctcactngggggacnncctggaaggactnttttggggncccncanaattaaaccttgn

SEQ ID NO: 3497 - DNA, 740 bp, Homo sapiens
  misc_feature 3, 6, 10, 29, 33, 35, 37, 39, 40, 43, 544, 671, 699, 716,737: n = A,T,C or G
tgnttntttnaattatgctctcgccttcnaatngntngnntcnattcgaattcggcacgaggagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccccagcatgggcaggaagaagaggaacaggacaaaggctaaggtcccagcccaggcaaacgggacgccaaccaccaagagtccagcccctggcgcccccacccggagccccagcacccctgccaaatccccaaaacttgcagaagaaaaaccagaagccgtnccaggtgaatggtgctcccgggtcccccacggaaccttgcaggccaaaagcagcatcagaaggctcttcccaaaaagggggtctttgggcaaatcaccacttgtcccgcgcttggcaccggaaaaanggcaagggcttgtcttttggtcattcanggagttccagccctgcnttcaaaaatgggggcccaaanaat

SEQ ID NO: 3498 - DNA, 780 bp, Homo sapiens
  misc_feature 5, 27, 561, 748, 752, 753, 775: n = A,T,C or G
ttttncaacagctggctactcgttctntttgcaggatcccatcgattcgaattcggcacgaggacagtacctttcccccccctttcatggcccattttattgtctgcctttcagtactaagtatgaccgttcctatctcagatcttaataaaaagaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttanaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaaatcccttgtgattggatgtttactatcngccnngaaactggtactcaagatgttngaacg

SEQ ID NO: 3499 - DNA, 742 bp, Homo sapiens
  misc_feature 1, 24, 98, 131, 139, 144, 151, 153, 164, 177, 184, 194, 195,197, 207, 210, 212, 224, 256, 260, 266, 274, 275, 286, 295,298, 410, 424, 428, 525, 540, 554, 572, 581, 593, 606, 608,620, 640, 652, 670, 672, 742: n = A,T,C or G
ntttgaaaccctttgttacttgtnctttttgcaggatccctcgattcgtttcagccctttgccgccagggccaaaggtggaaagtgatttggaagagnaagagcttttcgtccaccagaaaaattggtccnaaattaancttgnaagggangnaatttgggaanttgccgcaaggcnaaaagcnttacttttanngntttaatcaantangnttggcccttccngaaagtaaattttaatggcttaaaggggttancagncccaanaaagggtnnggggaagcaantcccagccncanccagggccagttaaggcctttggtgaactgtgctattagggcccagcttccggtaccctgtaggttcccaaggcctggcttaagcagatccttgatcgatataccttgagancagaaggtgctccnaatnacaccgtccaataggggatctaggacaatcttggagatccatgccttgctgtgttgctgattcttactggggactgtagatgaaaggtggaaagatnacttagcacatcttnaaactatgggaagncattctttctgcttgtangatttgtcntgttttggaaanctttaaacgtggntnaaccctatgttnggaattatctgctttatggnagcaataccctnttttaagaatttgaattnancccgaaagttatggccggtaacttaaattggttaaacctgggcttataaccccaaggcccgggttcaacn

SEQ ID NO: 3500 - DNA, 786 bp, Homo sapiens
  misc_feature 5, 7, 10, 26, 28, 758, 786: n = A,T,C or G
ttgcnancgntgccctactcgttctntntgcaggcatcccatcgattcgaattcggcacgaggttagctcgaggggcaaataaagagcacaggaatgtttctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactgaagtggttagtcttctgcttgatagaaaagcaaatgttgaacacagagctaagactggtctcacaccactaatggaagctgcctctggtggatatgcggaggtgggccgagttcttttggataaaggtgctgatgttaatgcccctccagttccctcctcaagagatacagctttaaccatagcagcagataaagggcattacaaattctgtgagcttcttattggcaggggagctcatattgatgtacgtaacaagaaggggaacactccattgtggctagcagcaaatggtggacacctcgatgtggttcagttactggtgcaaagcaggtgcagatgtggatgcagcagataaccgcaagataactcctcttatggcagcatttagaaagggtcatgttgaangtgggtgcgcctactttagtcaaagaan

SEQ ID NO: 3501 - DNA, 807 bp, Homo sapiens
  misc_feature 3, 7, 32, 60, 67, 74, 82, 87, 98, 113, 121, 127, 137, 163,177, 179, 185, 187, 205, 217, 218, 219, 220, 227, 236, 239,240, 246, 260, 267, 270, 283, 285, 291, 293, 297, 334, 336,337, 345, 346, 359, 393, 401, 433, 446, 456, 461, 476: n = A,T,C or G
  misc_feature 495, 500, 507, 530, 537, 583, 586, 589, 590, 591, 592, 593,595, 602, 614, 615, 623, 648, 656, 658, 660, 662, 680, 681,695, 704, 706, 716, 717, 718, 720, 721, 722, 724, 725, 732,742, 768, 769, 770, 784, 807: n = A,T,C or G
ttnaaantatcgaaactctttggacttttcgnacgctttgcaggatcccatcgattcggnccacttncggcgtngccatggnggcgnaacactactanttcccgtcgcagctnctgccgtnagagcntgtggacaantgtataggatcaagaattcacatccngatgaacagtgatnangaaatngntggtactctcctacgatntgatgactttgnnnntatggtnctggaagangtnnctgagnttgaaatcacaccncatgaanaangatgctaaattanancacatntngctnaatggaaataatataacaatgctggttcctggaggananngacctganntgtgaatgagttnccttgacttacactagattttgttttggcttatnatgacaanaaaatgggattttttttcccactttctaatgnttaaatcccatanagctaagttncccgnttaagggaagtgctntgaagatgtgtacccatcnttgtnagttaancatgattatcctggaaaaagaanaaaatancttcttctttgcagatgaaaataaaggtgtttttggttaactgtcnaanaannnnnantgccctnaaaaagagttgnnggggggcntgactcttataaaatggatttaatnaaactgtncnanangcctcccccccttaaaanntttggggcgtgttnttcccttangncccccaaaannntnnnannccctttntgggattttnggcccaaacccccccctttgaaaggnnngggaaaaaaacttntttttttttgggaaaatttgtgn

SEQ ID NO: 3502 - DNA, 777 bp, Homo sapiens
  misc_feature 2, 723: n = A,T,C or G
tntacatacaggctacttgttctttttgcaggatcccatcgattcgtggctggtattataggtgcacaccaccacacccaactagttttttgtgtttttagtagagatggggtttcatgatgttggccaagctggtctcgagctcctgaccccaggtgatccacccacctcggcctcccagggtgctggaattataggcgtgagccactgcgcacggcctggggaggttttatttcttgacaaaggtatttgatactcgtgcagaccctggagggtctcactggagagacaacatttaggctgagatctgattaacaggaggcagctgcagtgcagaggtcaaaagggagggtgttccaggcagagaaaacagcctgtgcaaaggccctgaggcagaaacaaactctacttgaggtcagcctggttagaaaacccaactcaaaatagaaagtattacatgataaggtctgagatcagaacccaagtctgcacttcctagtcacgttctccctgtagtgctaagcccagagacctgagctgttaacctagaacagtgtgcttcctaagccttaatgtgcatacccatcgcctggagctcgccttaagatgtaggctctgcctgaagcccaagttcatttagtatgtcatggttaattcagagtaaaatcaagagttagtacttgatttatgcttggtatataaagaaagagacaacttcactgnatgatcattttgtcacttttcaaaagcatttaattccattcaattggaaatgtg

SEQ ID NO: 3503 - DNA, 774 bp, Homo sapiens
  misc_feature 1, 7, 8, 717, 722, 770: n = A,T,C or G
naaaccnncagctacttgttctttttgcaggatcccatcgattcgccgaagaaatataacacattttggacctacaactcttagatcaactcttgcctatgggatgctcaggctctgtgatcctctaccttatgatataatagtcgatccaatgtgtggaactggggcaataccaatagagggggccactgaatggtctgactgcttccatattgctggtgataataatccactggctgtgaatagagcagcaaataacattgcatctttattgaccaagagccaaattaaagaaggcaaaccctcctggggcttgcccatagatgctgttcagtgggatatctgcaatctgccattgagaactggctctgtggatattattgtaacagatttgccatttggaaaaaggatgggatccaagaaaagaaactggaacctttatccagcttgcctacgggagatgagccgtgtctgcacacctaccacaggccgagctgtactacttactcaagacacaaaatgctttaccaaggcgttatctggaatgcgacacgtatggcgaaaggtggatacagtctgggtgaacgttggtggtcttcgtgctgcagtttacgttctgatacgtacacctcaagcttttgttcatccttcagaacaagacggagaaagaggaactctttggcaatgcaaagaatgaagatgactaatagtacttgnacttnccaccactggaaatgttagcataaaagaacttggagaggaaaaaagtnttac

SEQ ID NO: 3504 - DNA, 815 bp, Homo sapiens
  misc_feature 8, 259, 286, 292, 300, 302, 304, 305, 309, 311, 312, 319,332, 335, 336, 338, 343, 344, 350, 355, 356, 357, 358, 364,378, 381, 397, 408, 430, 438, 463, 512, 521, 539, 556, 558,568, 578, 592, 605, 626, 635, 637, 653, 655, 664, 678: n = A,T,C or G
  misc_feature 700, 701, 702, 703, 704, 705, 706, 707, 708, 709, 710, 711,712, 713, 714, 715, 716, 717, 718, 719, 720, 721, 722, 723,724, 725, 726, 727, 728, 751, 754, 766, 769, 780, 783, 784,785, 791, 800, 804, 809, 812: n = A,T,C or G
taaacctncagctacttgttctttttgcaggatcccatcgattcgaattcggcacgaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaagtgaagcctaaaagaacatcaagttcaaggaaaatgaagacnaaaagtgatatgatggaagaaaacatngattcnagtgcccnancnnttgntnnaacccanccagaagccattngtnnanaaganntccatngaaannnntaaaantggagaagccaaanttncagaggcaccagcttntgaaaaagaanttgtggaagtaaaagaggaaantattgaanatgccacagaaaagggaggagaaangaaagaagcagtggcagcagaagtaaaaaatgaagaagaagatcagaangaagatgangaagatcaaaacgaaganaagggaaactctggaananaacacagatntgaaaagggngaaaaatatggaanagggtttaaatgnggatgtgaaaagggaaaatangcaagagananagaatttggaaaaaangngtgaacccnggaaaggggatttnggaaaattttggaaaaaaaaannnnnnnnnnnnnnnnnnnnnnnnnnnnnaaaaaaaaaacgcccttttaaanacnttttgggggggntcnttttttcccgnaannnccccanacctttgantaangaatnccnttc

SEQ ID NO: 3505 - DNA, 815 bp, Homo sapiens; identical to SEQ ID NO: 3504
  misc_feature 8, 259, 286, 292, 300, 302, 304, 305, 309, 311, 312, 319,332, 335, 336, 338, 343, 344, 350, 355, 356, 357, 358, 364,378, 381, 397, 408, 430, 438, 463, 512, 521, 539, 556, 558,568, 578, 592, 605, 626, 635, 637, 653, 655, 664, 678: n = A,T,C or G
  misc_feature 700, 701, 702, 703, 704, 705, 706, 707, 708, 709, 710, 711,712, 713, 714, 715, 716, 717, 718, 719, 720, 721, 722, 723,724, 725, 726, 727, 728, 751, 754, 766, 769, 780, 783, 784,785, 791, 800, 804, 809, 812: n = A,T,C or G

SEQ ID NO: 3506 - DNA, 805 bp, Homo sapiens
  misc_feature 3, 7, 9, 10, 11, 12, 13, 19, 25, 27, 28, 344, 418, 440, 441,534, 545, 612, 618, 642, 672, 696, 713, 720, 721, 744, 760,762, 767, 776, 780: n = A,T,C or G
gtngggntnnnnnttttgnaaaccntnngctattgttctttttgcaggatcccatcgattcgaattcggcacgagggtgactggaatcgcttgaacccgggaggcggaggttgtagtgagctgagatcgtgccactgcaccccagcttgggcaacagagcaaaactctgtctttaaaaaaaaaaaacaaaaaaaccaaacaaacaaacaaaaaaaaccttatatgggctgggctgggcgtggtgccttatgcccacaatcccagcattttgggaggccaggatgggaggatcacttgagcccagaagtttgagaccagcctgggctacagagtaaggccccatntctacaaaaaaaccttaaaaattagccaggtgtggtggcacgcactgtggtcccagctgtaccagaggctgaancaggaggatcccttgagcccannaggtcaaggctgcagtgagccatatctacaccactgcactccagcctgggcaacagcctgtctcaaaaactaaactaaaaaccttatatgttnttgttagaatnaaattagatatacaaaaagaggggccgggcagggtggctcacgcctgtaatcccagcactttgggangctgangcaggtgaattacttgaggtcatngagttccgagaccagcctgaccaacatggngaaaaccctgtctatactaaaatntacaaaaatcagtctancgttggnnggtgggcgccttgtaattcccanctattctggcaggctnangcaangataattgnttcnatcccgggaaggcaataggtttccc

SEQ ID NO: 3507 - DNA, 778 bp, Homo sapiens
  misc_feature 20, 23, 25, 566, 652, 705, 710, 717, 723, 726, 737, 754,770, 772, 776: n = A,T,C or G
tcaacagctggctactcgtnctntntgcaggcatcccatcgattcgaattcggcacgagagttttcctgtgattagtgtttttggtgttgttttattttttttcttacaggaactcttgcaagaagaaaggactatgagttcaactttagagggagccatggggactaaacaaaattctgaggccccctcaaccatctaaatggacttccttctgggccaggacactcgaaaattaaacctgaaagactggttcaggccatgatgggaagtgggagtcgaacatgcctcatcataccctccagcattaacatcaacacagaccttaaggctgataagaagcatttacaatctattctctctgaagtcttctacctggaggcttcatctgcatgataaaactttggtctccacaacctcttacaacccaggcattcctttctatcgataattactctttcaaccaattgccaatcagaaaattgttatatctacctataatctagaagcccccacatcaagttgttttgcctttctggacaggaccaatgtatatcttaaatgtatntgattgatctctcatgtctccctaaaatgtataaaaccacgctgttccccgaccacctggagcacatgttctcagggtctcctganggctgtgcacaggccatgttcacttacatttggctcagaataaatctcttcanataanaaaaaancccccnccnccccccccccnacccacaaaaaacctcngccctttaaaactttngngggncg

SEQ ID NO: 3508 - DNA, 961 bp, Homo sapiens
  misc_feature 2, 18, 214, 215, 217, 220, 234, 237, 238, 239, 244, 246,249, 251, 252, 264, 265, 267, 270, 271, 272, 273, 274, 276,279, 281, 284, 289, 292, 294, 295, 298, 299, 301, 309, 310,311, 313, 314, 315, 316, 322, 323, 325, 327, 329, 331: n = A,T,C or G
  misc_feature 332, 338, 339, 340, 341, 343, 344, 345, 346, 348, 349, 353,354, 355, 361, 362, 364, 366, 367, 368, 369, 372, 373, 375,377, 378, 379, 382, 383, 385, 386, 387, 390, 391, 394, 395,397, 400, 405, 406, 407, 408, 410, 413, 415, 417, 418: n = A,T,C or G
  misc_feature 419, 420, 421, 424, 425, 426, 427, 428, 429, 433, 434, 435,436, 437, 438, 439, 443, 444, 446, 447, 448, 449, 452, 456,457, 458, 459, 460, 463, 467, 468, 470, 471, 473, 474, 475,476, 477, 478, 479, 481, 482, 483, 485, 487, 488, 489: n = A,T,C or G
  misc_feature 490, 491, 492, 493, 496, 497, 498, 499, 500, 501, 502, 504,505, 506, 507, 510, 511, 512, 513, 514, 515, 516, 517, 518,519, 520, 521, 522, 525, 526, 527, 528, 529, 530, 531, 532,533, 535, 537, 538, 539, 540, 541, 543, 544, 546, 547: n = A,T,C or G
  misc_feature 548, 549, 550, 552, 553, 554, 556, 557, 558, 560, 561, 563,564, 565, 566, 567, 568, 571, 572, 574, 576, 577, 578, 579,580, 582, 583, 584, 585, 586, 588, 589, 590, 591, 592, 593,594, 595, 596, 597, 598, 599, 600, 601, 602, 603, 604: n = A,T,C or G
  misc_feature 605, 608, 609, 610, 611, 613, 614, 615, 616, 617, 618, 619,620, 621, 622, 623, 624, 625, 626, 627, 628, 629, 630, 631,633, 634, 635, 636, 637, 639, 641, 642, 643, 644, 646, 647,648, 649, 650, 654, 656, 657, 658, 659, 660, 661, 662: n = A,T,C or G
gnattccgtaaacgtacngtgttctttttgcaggatcccatcgattcgtttttaatagtcattccaaatatgagatgcattgttacaggaagtcccttgccatcctaaaagccaccccacttctctctaaggagaatggcccagtcctctcccaagtccacacaggggaggtgatagcattacataatttacacgaaagcaatgctatcacctnncnagngtggacttgggagnggnnngcttngnttncnnttgagtgatganncntcnnnnncnccntnccntcttnttngnnccnnancttgcatnnntnnnngcttcnncntncntnngaccgnnnngnnnncnncccnnncttccnntncnnnnttnntncnnnccnntnnnacnnacnncnccncttannnncnccncncnnnnnccnnnnnncccnnnnnnncccnncnnnnctncctnnnnnccntctnncnnannnnnnntnnntncnnnnnnnctnnnnnnncnnnntcnnnnnnnnnnnnnccnnnnnnnnncncnnnnncnntnnnnncnnncnnncnncnnnnnntcnncncnnnnncnnnnncnnnnnnnnnnnnnnnnnntcnnnncnnnnnnnnnnnnnnnnnnnannnnncntnnnncnnnnncccncnnnnnnnnnnnnnnnnntcnnnnnnnnnnnnnnnnncnnnnnnnnncnnnnnncnnctcnnnnnnnannnnnnnnnnnnnnnnncnnnncnnntnnntncncnnnnncnnnnnnnnncncccnnntnnntcnnnnnnnncncncnnnctnnnntcnntntnntccncttcctnttnccncncnnntctnttcntnnnncnntctncnnncccnnctatccnatnntncntcntnnccntcnncccncnnnntnnnctccnncatcntccncnatctnncctccnnannttnccntnttnccccccg

SEQ ID NO: 3509 - DNA, 790 bp, Homo sapiens
  misc_feature 560, 641, 689, 697, 705, 707, 782: n = A,T,C or G
aattttcaagctcttgttttttatgcaggatcccatcgattcgctggtctccaacctggtctcctgggctcaagcgatccgcccgcctcggcctcccacagtgctgggattccaggcgtgagctaccgcgcccggcctatttacttttcttactaagctggggatcaccgtcgccctcggcttggcaggaaggcgggggtgcaagaagaaaagaggtacagaacacccagaggtgccctcgattccgtcttgcacttgcccttctcccaccgtccagcaataaagcgagagaaacaagtgcaggaaactggccggcagtcatgggagaagccaaaaagacaggagttcagtggcatgaccagggctcactgcaaccttgatctgggctcaagtgatcctcctacctcaacttcctgagtagctaggaccacaggtgtgcaccaaccacacccgactaatttttgtagagatgagatcccactatgttacccaggctggtcttgaactcctgggctcaagtgatcatcctgccttggctttccaaagtactgggattatangcttgagccacccgtgcctggcctgtgatcaaaattctcatttttttagtcactaaaaatgctggggggcactccattctncattatgtgattagttcacattgcatgcttgtatcaaaacattatatnttcccccncaaatttntnccaaaaacttttaaattttaagtatttaattggttcaggaaaaaaataaaatgctgggggggctgaaatctcaangggcccat

SEQ ID NO: 3510 - DNA, 779 bp, Homo sapiens
  misc_feature 7, 18, 100, 293, 568, 582, 584, 627, 672, 692, 700, 746,755, 775, 779: n = A,T,C or G
tttaaanctttcatttanagccttttgcaggatcccatcgattcgaattcggcacgaggtttgtgcatcacttggtcaccattgggcttatctccttctnctacatcaacaatatggttcgagtgggaactctgatcatgtgtctacatgatgtctcagatttcttgctggaggcagccaaactggccaattatgccaagtatcagcggctctgtgacaccctttttgtgatcttcagtgctgtttttatggttacacgactaggaatctatccattctggattctgaacacnaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcaaaggaagaagatgtgaccacctgcacaaaaagtccctgtgacagtagctccagcaatggtgccaatcgggtgaatggtcacatgggaggcanctactgggctgaanantaaggtggttgctatagggacttcagcacacatggacttgtanggccctggcaacatactcctcttggcccttccatatctactcttntgtgaatgggagactgcaangcactganggagtatcaaaagaagcaaattttttcacttttgaaagaaaactgncattttgtntttaatagcctccaagttcntttn

SEQ ID NO: 3511 - DNA, 750 bp, Homo sapiens
  misc_feature 4, 5, 346, 570, 588, 593, 595, 599, 601, 602, 603, 604, 605,606, 608, 643, 653, 672, 691, 715, 722, 726, 728: n = A,T,C or G
tatnntatcaagctcttgttcttttgcaggatccctcgattcgagaaaatgtgggatcaagaaaaggaccatttgaaaaagttcaatgagttgatggttatgttcagggtccggccaacagttctgatgcccttgtggaacgtgctggggtttgcactgggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcagctgataaagaaatttcgggatgaagagcttgagcaccatgacatangcctcgaccatgatgcagaattggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattatnagggttggtttttttttnaaaanangaanannnnnnangaaaactcgagcctctaaaactatagtgagtcgtntacgtaatcngacatgataaaaacattgntgatttggcaaccacactngaatgcatgaaaaatgcttatttngaattgngatntntgttattgaccatatactgata

SEQ ID NO: 3512 - DNA, 820 bp, Homo sapiens
  misc_feature 2, 3, 4, 5, 6, 7, 8, 9, 10, 11, 19, 26, 384, 534, 686, 713,733, 792, 798, 805, 809, 820: n = A,T,C or G
gnnnnnnnnnntttaatanttatcanctcttgttctttttgcaggatcccatcgattcgaattcggcacgagaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccanagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggangccatcgcagtggccaatgcaagcactatgcactgagatgccttggccatggcacaaagagaaaccagccaggaaaaaccagacagactttcacactaaagaagaagccctccattttttttttttcttttttttattggggggagtttacnaaacctttcaaggttgctttttgtttnaaaatattaaaaagaaaacntttaaaaaaaaaaaaaaaaaaaaacttggagcccttttaaaactattagtggggtcgtnttaccntaaaatnccanacttgataaan

SEQ ID NO: 3513 - DNA, 789 bp, Homo sapiens
  misc_feature 4, 159, 268, 355, 384, 418, 437, 446, 616, 633, 639, 644,645, 649, 653, 654, 655, 665, 666, 674, 676, 678, 679, 680,686, 689, 694, 702, 705, 714, 723, 725, 736, 752, 758, 761,777, 780, 788: n = A,T,C or G
tatntatacagctacttgttctttttgcaggatcccatcgattcgtggaggtctcctttcgccccagcccaggtggccaagcccatcctggcctcagaacatgctgagcacattttgtagggtggcacctttttatccaagttactagctacacatcantgtttaaagagaaaaaagtgacctttcatttttttttcttgaaacttgaggaaacaagatacatactactgattttttttttcttaaaactaaatgcatgactgcaganggtagaggtgtatatttttcatactgtggggcaaagtatttgtgctgctttttggagatggactggaacgtctggtttctgtccccnggcccggcagctacgtctattttctgtanaaggtgccacagtgagacctggagccaccccttnctgccctggcgccgtttanagctgggancccgtggactcccggcctgtttctaccttctattcaaccactctgacgtggggagacaaaaacaaataaaactttttgatagtgtggtaaaaacattgatttgaactattttagtaaaaggagtgacaaacaagaatgtgatagtgtctactttgagctaaataataaangcctctttgtgaacctnctgggntttanngcanggcnnnaaagtttttnnaaaaatgngnannnaaactnganccttnaaaaactntanggaggcgtnttcccttantncccgacatganaaaaaacctttgatgnggtttnggncaaacccccaacttanaangccgtggna

SEQ ID NO: 3514 - DNA, 780 bp, Homo sapiens
  misc_feature 4, 267, 322, 442, 660, 716, 740, 768: n = A,T,C or G
tatnctatcagctcttgttctttttgcaggatcccatcgattcgagaaagatcactgctgtttacagcgccttgtgcagccttagattttaatattcttttgtcattgttacatctcatagagtaaagctcttattaccttgatcctgagtcagaaatcccacctgaaatcaccttttttcccccttgatcaaacatcccatccttcagctaccatactgttgctacagggattttgtggactgtggcccctgtcccgaggttggcnccttcagttcagcacagcctgagcagtgagaaggtctgaaaggagagtatatagntaagatccttgagaaagggctgcctgaggaactgacctcttaaagatctcaggatctttaagacaacaagttaggttcctactggagttacctgccagaatggcctcttaattaactcangtaatgaagagctaactgtgttataatcatcttgcttttgcctgaatttggagaaagtattataattaaagttcccagtatcagaaatgtccttacataagattaaaatatcttggtgactaataccattctatgagaaagagtagttatttgcccagactgtattaatttactttagaaactaatgtttgaagtaatggaaaaaattttaaattatnaagctaagggcaataacatttgctacttatttatagaattatttgaaaaaatttgntttgaagtaatgctttaaggagtntaagatattcaagataaattatactatnaaatgatttatt

SEQ ID NO: 3515 - DNA, 749 bp, Homo sapiens
  misc_feature 7, 9, 10, 11, 12, 16, 52, 53, 67, 81, 82, 83, 88, 91, 343,525, 619, 655, 658, 660, 666, 671, 700, 714, 720, 725, 743: n = A,T,C or G
tcaaatntnnnntaancctttttaagatcagcacttgttcttttgcggatcnntccatgggtagaanggatgctcgtaccnnnaagancantaccgagacgtgcagctgtccaaggctctgtcctatgccctgcgccatggggccttgaagctggggcttcccatgggagctgatggcttcgtgcccctgggcaccctcctgcagttgccccagttccgcggcttctctgctgaagatgtgcagcgcgtggtggacaccaataggaagcagcggttcgccctgcagctgggggatcccagcactggccttctcatccgggccaaccagggccattccctgcangtacctaagttggagctgatgcccctggagacaccgcaggccctgccccgatgctagtccatggtacattctggaagcactggccatccatcctactcaaaggcctgtcctgccagggaaggacgcacattcacctggccccaggactgcctggagccccggtatcatcagtggcatgcggncccattgtgaaatagctgtgtcatcgatggaccctggctctggcagatggaatacccttcttccgttctgccaatggggtgattctgactccanggaatactgatggcttcctccttccaagtccttaangangncctgancttcnccttaccgaaagccctttccttggctggngatgaaaaaacaantgtcanaatanccccaagcacagttccanaaaaag

SEQ ID NO: 3516 - DNA, 782 bp, Homo sapiens
  misc_feature 3, 4, 5, 8, 19, 20, 21, 34, 37, 58, 60, 115, 117, 453, 512,528, 632, 639, 650, 684, 686, 713, 757, 774: n = A,T,C or G
ttnnntantaaaccccttnnntactcgtttttangcncgttcccatcgactcgaattntncacgaggaccagggctcactgcaaccttgatctgggctcaagtgatcctcctacntnagcttcctgagtagctaggaccacaggtgtgcaccaaccacacccgactaatttttggtagagatgagatcccactatgttacccaggctggtcttgaactcctgggctcaggtgatcatcctgccttggcttccaaagtactgggattataggcttgagccaccgtgcctggcctgtgatcagaattctcatttttttagtcactaaaaatgctgggggggcactccattctccattatgtgattaagttcacattgcatgcttgtatcaaaacatcatatataccccacaaatatatacaaaaaactttaaaattttaagtattaattgctcangaaaaaattaaaatgctggggtgctgaaatctcaagggccccattacaaaactccttangaacctcgccctcttntgctgtaaggactggttccagaatgagagaattaaaagacattcccgccaaaatgtcataatgtcaccccggaaacctgcgaatatgttatattacatgaccanggagaantaagggtgcanatggcagtaagggtgctaatgggctgaccttaananaaggagatgatcctggattatctgggnggacccaatgtaatcacaagggtccttactggggaaaatgaggnggctgatcaaaagcaantgatcatg

SEQ ID NO: 3517 - DNA, 769 bp, Homo sapiens
  misc_feature 7, 10, 104, 354, 495, 544, 615, 643, 691, 757, 768: n = A,T,C or G
tatacanctnttgttctttttgcaggatccctcgattcgcgacaatcagtgattttgctgtatttctcacaatagtaataatggttacaattgactaccttgtnggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatgggtggcgttatgntgggagtttgctctgtcatgggacttccatggtttgtggctgcaacagtgttgcaataagtcatgtcaacagcttaaaagttgaatctgaatgttctgctccaagggaacaacccaagtttttgggaattcttgaacagcnggttacaaggctaatgatttttattctaatgggcctctctgtgttcatnacttcagtcctaaagattattccaatgcctgttctgtatggggtttcctttatatgggagtttcctcattnaaaggaatccagttatttgacccgtatnaaatatttggaatgcctgcttaagcatcagcctgatttgatatacctncgttatgtgccgctctggaaggccatattttacagtcattcagcttacttgtttggtccttttatnggtgataaaang

SEQ ID NO: 3518 - DNA, 790 bp, Homo sapiens; identical to SEQ ID NO: 3509
  misc_feature 560, 641, 689, 697, 705, 707, 782: n = A,T,C or G

SEQ ID NO: 3519 - DNA, 784 bp, Homo sapiens
  misc_feature 181, 197, 199, 251, 270, 279, 284, 314, 358, 363, 393, 426,518, 537, 605, 686, 714, 738, 751, 760, 765, 772: n = A,T,C or G
tatactatcagctacttgttctttttgcaggatcccatcgattcgctggtctccaacctggtctcctgggctcaagcgatccgcccgcctcggcctcccacagtgctgggattccaggcgtgagctaccgcgcccggcctatttacttttcttactaagctggggatcaccgtcgccctcngcttggcaggaaggcngnggtgcaagaagaaaagaggtacagaacacccagaggtgccctcgattccgtnttgcacttgcccttctccnaccgtccancaatnaagcgagagaaacaagtgcaggaaactggncggcagtcatgggagaaccaaaaagacaggagttcagtggcatnaccanggctcactgcaaccttgatctgggctcaantgatcctcctacctcagcttcctgagtagctangaccacaggtgtgcaccaaccacacccgactaatttttgtagagatgagatcccactatgttacccaagctggcttgaactcctgggctcangtgatcatctgcttggctnccaaagtactgggattataggcttgagccaccgtgcctggcctgtgatcacaattctcatttttttantcactaaaaatgctggggggcactccattcttcattatgtgattagatcacattgcatgcttgtatcaaaacatcatattntaccccacaaatatatacaaaaaacttnaaattttaagtattaattgctcangaaaaaaataaangcttggggngctgnaaacttnaagggccccatt

SEQ ID NO: 3520 - DNA, 784 bp, Homo sapiens; identical to SEQ ID NO: 3519
  misc_feature 181, 197, 199, 251, 270, 279, 284, 314, 358, 363, 393, 426,518, 537, 605, 686, 714, 738, 751, 760, 765, 772: n = A,T,C or G

SEQ ID NO: 3521 - DNA, 818 bp, Homo sapiens
  misc_feature 260, 470, 579, 628, 629, 632, 640, 664, 711, 715, 739, 741,746, 753, 778, 791, 804, 806: n = A,T,C or G
atcagctcttgtctttttgcaggatccctcgattcgaattcggcacgaggctgcccaacacgctgtttggggatgtggccatggtggtggaattcttgagctgttattctgggctacttttaccagatgctcagtatcctattactgctgtgtcccttatggaagccttgagtgcagataagggtggctttttataccttaacagggtgttggtcatcctcttacagaccctcctacaagatgagatagcagaagactanggtgaattgggaatgaagctgtcagaaatccccttgactctgcattctgtttcagagctggtgcggctctgcttgcgcagatctgatgttcaagaggaaagcgagggctcaaacacagatgacaataaagattcactgcatttgaggataatgaggtacaagatgagttcctagaaaagctggagacctctgaattttttgagctgacgncagaggagaagctacagatcttgacagcactgtgccaccggatcctcatgacatactcagtgcaagaccacatggagacccacagcaaatgtctgcacagttgtggaangaaccgcttgctgtgtttgaaaggaagaaaatgattaagaagaagagcnngantaaaccgnaaaccgggaaagaaaatgggaagnccaaaaaaaaaaaaaaaaaaaaaactcgaaccctcttaaaaactatnagtngaggtccgtattaccgtttgaatncnggacnttgaatnagaaaccattggatggagttttggnccaaaaccccaancttagaaatggcngnggaaaaaaaatg

SEQ ID NO: 3522 - DNA, 875 bp, Homo sapiens
  misc_feature 3, 5, 6, 7, 8, 364, 505, 625, 648, 660, 674, 681, 701, 702,703, 704, 705, 706, 707, 708, 710, 713, 714, 715, 716, 717,718, 719, 720, 721, 722, 723, 724, 725, 726, 727, 728, 729,730, 731, 732, 733, 734, 735, 736, 737, 738, 739, 742: n = A,T,C or G
  misc_feature 743, 785, 787, 796, 797, 801, 804, 810, 849, 853, 862: n = A,T,C or G
ttnannnntatacaactacttgttctttttgcaggatcccatcgattcgaattcggcacgagggcacgaggcactaagcaggctagtgctctcagcttcccggcctccccttccaggccgctgccgcctgaccctgtgtccaagagactccaggctgagctggctgaccgacccaatccccctacccgccctctgcccgctgacccggtggtgagaagcccgaagtctcaggggccagccaagcccccacccccaaggaagccactgcctgccgacccccagggccggtgcccatcgggtgacctgccggcccaggggctggaatcccgcccctagtggtaccctccagaccaagcgccaccgncttcgacagtgtcctcgctctacctctgacctctccggaggttccgctgctccaagccggacttaaggcttcaagaggcgggcgtgccctctggagtcccctaccatgactgaaggcgccagagactggcggtgtcttaanacttcgggcaccgccacgcgctgtcaagcaacaactctgcggaccttcccggcgtaatttgcaaccgggggcttgggggaaggggcttgggggtttggaaccgggattgaaggaaaggtnccgcacaaacctggtctttttgnttcaaatttgcnaataaaaacgttgnacaattntttgggggaagccggttttnnnnnnnnanaannnnnnnnnnnnnnnnnnnnnnnnnnnaanncccttcgaagccctttttaaaaaactttttaggggaggtcgnanttaacgttnnaatnccnaaaacnttgattaaagaataccatttggttgaaattttggggacnaaanccccaaaanttagaaatggcgg

SEQ ID NO: 3523 - DNA, 772 bp, Homo sapiens
  misc_feature 1, 2, 3, 4, 5, 6, 7, 11, 12, 13, 14, 17, 18, 19, 21, 22,23, 27, 33, 34, 35, 36, 37, 41, 48, 50, 55, 58, 64, 559,596, 650, 664, 686, 687, 720, 721, 727, 731, 732, 734, 736,741, 750, 751, 767: n = A,T,C or G
nnnnnnncccnnnnggnnngnnnaggnggggtnnnnntttntactaangntgtgnganctcgtnctctccgcaacagcccggcgggtcgaattcggcacgagtccaagaggagaagcatgttccaaaacccttaactttgggaatttagaactagcttttttactatcttctgcacagcataacttcagtctccctttactaattcaaggaaatctcagtgaacaaattgtataagggtagatgagctaaaagctcactgagtcattaatttgtcataactcatctaaatacaatgattaggcttgtgtaggtgtccctagtttctctttctaaatcatgtcttagtagggacagagcaataatggtggatcgtggcaacgggaaggaagatgatgtgtcagttatctattgctgtatgacagtcacaaaaccttagtacttactacagaaacaatgatttgtcacattttgtgggttgtctggatggttgttttgcttatatggtgcaggctgagattactcatgcagcttcacagttcttttgcttatatggtgcangctgagattacacatgcagaggaaagatgggctctgntcctcattcgtatgcctggggccttggtgcgggttgtggcaatggcgtcttggntctccatgtgccgnctctccagcaggataacctgtnnttttctcacaccatgacactggggttccaggannatcaanccannancngctanacccattannaactaggccccaaaanttgct

SEQ ID NO: 3524 - DNA, 768 bp, Homo sapiens
  misc_feature 3, 10, 498, 502, 512, 622, 634, 661, 664, 689, 705, 757,760, 764: n = A,T,C or G
ttntatcagntcttgtttttgcggatccctcgattcgaattcggcacgagagatgggttaaaacttaaatgtcacatctgaaacagtaaaaatcctagaagaaatcctaggaaaaactcttctggacattggcctaggcaaagaatttatgatgaagacctcaaaagcaaacataacaaaaccaaaaatagacaaatgagatttaattagaaaaacttctgcacagtaaaagtaataatcaacagttaatagacaacctatggaatgggagaaaatatatgtaaattatacatctgacaaagaactaatatccagaatctacaaagaactcacaagaaaaaaaccaaccccacaagcgggcaaaggacatgaacagacatttcccaaaagaagacatacaagcaacctaaaataatctaaaataatttttaaaaagaaaaaatgcttgacagagttttgatagtacttagtaaaaagttatatctagtggctttttgnttgnttggttttgntttggttttaagaggtagtctctgtttcccagctggagtgcagtggcgcaatctttggctcgctgcggcctcgaactcctgggctcaagcgatccttcagcctcagcctnccaagtagctgntataggcatgccccccccttccgactnatnatctgctatcaatacataatggttncctttggcttatttangaaataacacttttatgcttttgaaaaaaaaaaaaaaaaaaactcgagcctntanactntgtg

SEQ ID NO: 3525 - DNA, 790 bp, Homo sapiens
  misc_feature 4, 5, 6, 7, 362, 587, 589, 712, 726, 769, 781, 786: n = A,T,C or G
tttnnnnttttaaattatcagcttttgttctttttgcaggatcccatcgattcgtggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttccattgtcaaagaaagcaaaatttgattcataataatggcaacggcctangatcagtacctgttgaaaaaaactggttctccacccctcccccatacaaaatccacaaaaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttntnagggaaggaaatggaaacaaaaagccaacagggcaggggttttgtaaagtggaactcttggattgactggtcagttgctacaatcaaaatatgctttcttggaccatgtttgagactcaaaanaatgggccttctgncataattctttacttagtcaagaatgccacagtttcttttgtntaaaaaacctgnctttnaaat

SEQ ID NO: 3526 - DNA, 709 bp, Homo sapiens
  misc_feature 5: n = A,T,C or G
cagcncttgctctttgtgcaggatccctcgattcgcccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccggaaagttcggttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtaagtatcacgctggtatggagggattc

SEQ ID NO: 3527 - DNA, 780 bp, Homo sapiens
  misc_feature 13, 590, 653, 680, 763, 768: n = A,T,C or G
tatatttatacanctcttgttctttttgcaggatcccatcgattcgatacactgcatttgctggtgctgtttttatatagtgaagcaacagctgtcagcaaaataataaaatactcacttcttcgttaaaaaaaaaaaaatttacttcttacaattctggaggccaggaagaccatgatcaggtgccagcatctgggaagggccttcttgctgtcctcccatggcagaagatggaagggcaagggagagctaacatgctcccgcaaaccctttttataatggcatcaatcaaatatgaggccagagtccttgtgacctaatcatctcccagaaggctccgcctcccaaccctgttgcattgggattaagtttccaacacatgaattgtggagacaacacattcaaaacatagcattccacaccttgggctccccagattcatgtcctcacatgcaaaataaattcattccatcccaatagcccctaaaaagtcttaacttgttccagcatcaactttaaagtcaaagtccaaagtctcatctaaatcagatatgagtgagactcaaggcatgattcatcatgagacaaangatgtacatttgcaatgtttgtcatgtcagacaaaacaaaaatatgtaaatatccatcaatangggaactgctggaaaaatttttttgtntaatcataaaatgaaacatgccgatgtttaaaccaatggagctagatctcaacgtgctgatattggaaatgcttcaaaatgtnttaanggacataaaata

SEQ ID NO: 3528 - DNA, 777 bp, Homo sapiens
  misc_feature 3, 4, 5, 6, 7, 14, 15, 16, 553, 671, 753, 761, 775: n = A,T,C or G
ttnnnnntttaatnnnatacagctcttgttctttttgcaggatcccatcgattcgaattcggcacgaggggagactggggtctatttcacccctgcagtctcgaccataagagatggctacacccaggggggccagttcagagacccactcccaggtgtgcattctctttctcaaggatgttccttgctgagaaaaagaattcagtgatatttctcccatttgcttgtgaaagaagagaaatgtggctttgttccacctggctcaccggcggcagaatttaaggttatctctcttgtttcctaaacattgctgttatcctgttcttttttcaaggtgcccagatttcatattgctcaaacacacatgctgtataatttgtgcagttaatgcaattattacagggtcctgaggtaatatacatcctcctcagctgacaggattgagagattaaagtaaagacaggcataggaaatcacaagggtattgactggggaagtgataagtgtccatgaaatctttacaatttatgtttagagattgcagtaaagacangcataagaaattataaaaagtattaatttggggaactaataaatgtccatgaaaccttcacaatccatgtttttctgccatggcttcaaccagtccccccgtttggggtcctgacttnctgcaacaatgtcctgcaggaaaagtttttctttatatccagtttttacatgatgaatatttccaatattcatagttatgangctgaatnctcttgaatttatnaa

SEQ ID NO: 3529 - DNA, 775 bp, Homo sapiens
  misc_feature 11, 582, 594, 617, 623, 642, 666, 672, 738, 755, 765, 773: n = A,T,C or G
tattttatcanctctgttctttttgcaggatccctcgattcgtttaaggaaaaccagcaaataacaagaaaaccatttaatgtaaagatttgtaaataatcacttcaaaagaagtgccttgttgctgtcacatttagtccatcttcatataattcttatctgggccagtttcttgggcatgggacatgtgcagttacacaagcctgtgctcttaagagggtcttacccatagtttaatgttctgctgttgtagtcttgaaattcttaatgatttaacaaggggtcctccattttcattttgcactgggccctgcaaattacatagcccatcctgatttctacaactatagaatagcacaatgggaattccatatggattaataatatgtgacacttacggctttttctatacgcttccaagtacttcatataaattacttcatttcattcaatggtagaattggtagatgcttaacttttaatgaaagacaaagtcagattcactctaaggattaaaaaatatatgtaacattacattttaaagattttcaaaaacaatttgttgtggaaatgaattattgncatgagatattncccactagacggacttcctgtanggtcangggtcctggtcttctgtanggatgaaccaagcttttcttgaanggccangtgctaagtgtctcaagctttgtctgttaaggactacccactctgctggtgtagcaaggaacacanctggttgcagccagatnctcaaatgancaagcctntt

SEQ ID NO: 3530 - DNA, 899 bp, Homo sapiens
  misc_feature 16, 139, 265, 277, 296, 434, 438, 448, 471, 488, 504, 547,628, 637, 661, 665, 685, 686, 704, 710, 720, 730, 739, 790,798, 815, 834, 837, 838, 855, 861, 862, 869, 873, 876, 879: n = A,T,C or G
taaatttatacaactncttgttctttttgcaggatcccatcgattcgttcaagcccccagcctacgaggatgtggttcaccgcccaggcacaccaccccccccttatactgtggccccaggccgccccttgactgcttncagtgaacaaacctgctgttcctcctcatccagctgccctgcccactttgaaggaacaaatgtggaaggtgtttcctcccaccagagtgccccccctcatcaggagggtgagcccggggcaggggngacccctgcctncacacccccctcctgccgntatcgccgtttaactggcgactccggtattgagctctgcccttgtcctgcctccggtgagggtgagccagtcaaggaggtgagggttagtgccaccctgccagatctggaggactactcccgtgtgccttacccccanagtntgtaccgcanatctttcccatggggctgtcttncagtgaaaggggacatnccataatagttttganagggtggatgggttactttgcccaccaaaaacagcccttagtnccaacttccttgcgtttccttttggcccctcccttgccttaccttaaaaaattttgccttgaaaaagggctttgggaaaanggggcaaanaatttggggggggaacttggtgcntaancctttttaaccccccccgcnngggaacaattacaaccangggaancccttttggnatccttccantttaaaaanaaaaatgtttggaaaccccaaaaaaaaaaaaaaaaaaaaaaaaaaaaaacnttcggagncccctttttaaaaaacntttttagggggggggcccnttnntttaacctttaaaaatncccccnnccttggntttnggnaanccccttttggttggaagttt

SEQ ID NO: 3531 - DNA, 794 bp, Homo sapiens
  misc_feature 1, 2, 3, 7, 8, 9, 10, 11, 12, 722, 766, 782, 794: n = A,T,C or G
nnntttnnnnnntttaatatttatacacctcttgttctttttgcaggatcccatcgattcgaaaacctgctgtcaaggcttgaagagccggcacactcaatggcaaacacagcaccgagtctgctctgaatcctggaggatctggccctcctctcaacccccactcacagtcaccgtcttacaactcagggccacctgggatcagtcatcagtcagggtgcgtaagccttgaataccaggtagcctcaggagtgaaaagataaatgtcctagatcattccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatctgagaggccccatttaaaaaagaaagaacatgggtggtcattgaggagtatttacattttataaaatgacttaaaaatttgaaggcatttttgagcatttccaattatatggaagagttacttctacggaatagtttttgctcatggaactcaaacagatgaagcaccactgttacagaataatgtgctccagatgaaaatgtctcgtttctgtgaatttcatgaagagcagaacatttctcaagaatcctcttgagccagtaatcaatcctgtctnaaaaaatgttctttgccttttctaaatactgcacaaaagtgggncatgtcgacatttgtncacccaccctcn

SEQ ID NO: 3532 - DNA, 775 bp, Homo sapiens
  misc_feature 3, 5, 6, 22, 292, 328, 337, 454, 563, 585, 692, 702, 764: n = A,T,C or G
ttnannttttaaaccctttgtnctttttgcaccatcccatcgattcgaattcggcacgagagtatgagaagggaggatgggggagaatctgattaaaaaaaatgattcattccttcacagacactaacaaacatggctaaaaagcacatgtcagaacacagaagcctaggtagatggttgacatttttataacttccttaagtgagtagttaaaccagcagtcttaattctgttggtcttccaagagtgtttaattacataagtattacctgtattcatttcccacaactgntgggtttttctttctttttttttttttttcctctgngcatcctanaaaaactcccaggactagacttaggaggaggcaatcaagttatgtggtaaaacaagagtgccttttctgttggatatccactttagtttcctggcttccagggcataagatgtttanaaactttttttctctaaacataagaattattgtgtccacaattttgaaccaccgatttccatatcttcagcagctatcaacttgccaattccctttgggtctcctttgnatattcttatgtttccttctgnttccaggtgcctcaaaaagagttgaggggggcatgactcttataaaatggataaaaatgaactgtacagatgtttgcctccttgttctgtgagcatgactctatcangctggaaaancgctttatcattttggatatttgaccattttggattcagcattacttgactccttatgtgcnttggcaatgtt

SEQ ID NO: 3533 - DNA, 1157 bp, Homo sapiens
  misc_feature 1, 4, 8, 9, 11, 21, 24, 33, 52, 72, 78, 80, 98, 99, 103,109, 118, 135, 166, 169, 199, 205, 220, 222, 223, 234, 237,242, 253, 255, 259, 264, 267, 274, 278, 280, 286, 287, 292,295, 305, 326, 327, 328, 334, 336, 337, 352, 380, 382: n = A,T,C or G
  misc_feature 387, 409, 410, 412, 420, 436, 452, 454, 460, 464, 465, 468,474, 476, 502, 512, 523, 529, 536, 540, 554, 564, 571, 579,582, 583, 586, 589, 592, 593, 599, 605, 607, 608, 614, 617,621, 628, 633, 638, 639, 659, 660, 663, 669, 681, 701: n = A,T,C or G
  misc_feature 704, 708, 711, 748, 750, 751, 753, 754, 765, 770, 773, 774,778, 781, 788, 789, 790, 795, 796, 802, 811, 814, 848, 861,885, 889, 900, 920, 936, 953, 961, 964, 972, 975, 979, 981,985, 989, 990, 991, 992, 995, 999, 1001, 1009, 1010: n = A,T,C or G
  misc_feature 1013, 1017, 1018, 1024, 1032, 1036, 1043, 1067, 1068, 1075,1079, 1082, 1084, 1095, 1096, 1105, 1106, 1114, 1117, 1133,1135, 1152, 1153: n = A,T,C or G
nttncctnngnaaaaaacccnccnttttaaaantttcaaaattccccccccnttttttttggaacccccccnttttgncnaaggaaaaaacccccaanncagnaacttnttttaaatntacgggggaccacaggnaggccaggcaccctgtcccaaatgccccggnacntttttatttaaccacccaaacaagaaaacngagaantacgccaccccgggnannggccaaaaggnagnaaggngggaacaagcntnaccntgtgnctngcaacanacangngtggcnngaaancanccaggactcnccggtacatcaaatcgcccannnggcgcncnncatgttcttaaccanccggaataggggacaatcaattggttgncntttgngcctgccgaaaagctagctggnnanatctgccnggttaaataagccccnttaaacggaagggcanangggggnaacnnaanaaggtnangccattcccgcccaccggaatgaagnaatggggaancccgccttggngggggnaagtcangcanaaacggcttgacgnaaaaacaaanccattcncccccaanttnngtnaanggnncccaangaaatncnnccacgngcnaagnccccccngggcnaatgnncccaaatcccctcccatttnnatnttatgnaaaccacctttngggggaaaaaaaaaaaaagnccntttnttngaaaggaaagggttgccccattgggctatgggaaggngnncnnccccaaattanaaaanttnngggnganaaaaaannngggcnnccccgntttgggggncgnctttgggcaaaccaccccccgtgcccccaaaaangcccaatgggtantccctaaaaaaaaaagttcccccntttngtgggaaaaancccccgggagagggccccgngtttcaaagggggaanaatcccaaaaaaaaccnaatcctanaanggccaaanggnggtntncctnaaannnnggnaatngncaaaaggnnggngaannaaaccnttgggganggcngaatttnccccctggaaaaacccgggggggnncccctcnccgnaananaaaaaaaaccnnttcaaaccnngggggccntcncggggtgcccggaacncnttttgaaaagatccacnncccg

SEQ ID NO: 3534 - DNA, 769 bp, Homo sapiens; identical to SEQ ID NO: 3517
  misc_feature 7, 10, 104, 354, 495, 544, 615, 643, 691, 757, 768: n = A,T,C or G

SEQ ID NO: 3535 - DNA, 776 bp, Homo sapiens
  misc_feature 15, 624, 676, 724, 739, 747, 752: n = A,T,C or G
tattttatacagctnttgttcttttgcaggatccctcgattcgaattcggcacgaggccaggtgtcattgcacatgcctgcagtcctggctactagggaggctgaggcaggagaattttttgcacccagaagttcaaggctgcagtgagctatgatcacaccatggcactccagcctgggcaatagaatgagacccagtctctaaaaaagtagaagttaaaaaaaaagattaagaatagatgtagggcagcagaatttcgaacttcttttcagcatcacaatactttaaaacagtgattgtcatctgcctcaaacccattgcctctcacataggaaatattttgaaacatattttttagtaccttgaaatgaaattcatgataattaacccatctacacacatttttaaaaatcaatatagggccctaacagcaatataaaggggaaataaaaagaaactaattgtaataaaataatattgatttcaataagtacattctagcccagtgcttataaattttaatgtgcatatgaatcatccagcattcttattaaatgcagattctagttcagtagattttggttcagtaggtaagccctgagatttggcatttctagcagctnctagatgatgcccacactgctgtttagtaaagagcatactttgagtagtaanggccgaaaagtataaaaaaaaaaaaaaaaaaaaaaactcggcctctanactataggagtcgtnttacgtanatccngactgataagatcattggtgagtt

SEQ ID NO: 3536 - DNA, 774 bp, Homo sapiens
  misc_feature 4, 5, 691, 774: n = A,T,C or G
tatnnatacaactttttgttctttttgcaggatcccatcgattcgcagctctgcacccagctgcttctccagggagccctccctcactggagactgggatttagcaaccaagacctgggcactggctgtgcttgttgcttctgggccctcctgggacagagctgggaagtggatctatgacacgtgcttgtgcatttacccgccctgttggtttctgtagctgtctagttcctgctgttcctgtctcacctgcccctttccttatgtgtagtttcttcctgtgacagggagaaacctggctctcagattgacaggacattcgcttaggccatgtcagtgctgtaggtgaactgttcaacctgtgccccagggaggcgcagtcactatggaggcaccttacttccttaatcgtgtactggtgtttttgtgtttgacctgtagcatctaagtactggtttcaaaagttgcctagatgagttcttttctttctttcacctcctgcaaattatgtgatttgcataatttgtacataagttaggttcatttgttagtttgtattccttttggcttcccccatatcctcgttgactttttctttcttttgtaacttacatatgttatgaaattatatgaggatatataatttcataaatgtttatgggttacatgtattaattggtattattaaaancaccctgggattgactggccaaccatttggtggaagatagcaataaataatacatcataaaagactttaatgtaaaaataaan

SEQ ID NO: 3537 - DNA, 816 bp, Homo sapiens
  misc_feature 1, 2, 3, 8, 12, 14, 22, 29, 40, 52, 53, 57, 58, 60, 359,387, 453, 465, 466, 633, 663, 675, 694, 739, 741, 743, 744,748, 749, 750, 751, 752, 753, 754, 755, 756, 757, 759, 765,767, 792, 801: n = A,T,C or G
nnntttantatntntacagctntcggctnttgcacgatcncatgatcccatnnattnngnttaattccctgaatcctacttgaacattgtataaatttctctttgcatataatacatatttgtgaatgagacatattcccaaaaaattcttatctctgtatgtgattggaaaagaaaagatcacatttgtatattcaacaatctttcacctatttcataagtcattttttcaccctgtatagtatgggaattattttttatgttaaatagaaactgaatgtactgggttgaatggtgtcctctccaaaattcatgtacttcctggagcctcagaatgtgaccttatttggaaatactgnggttgtggttgtaagtagctaagatgangtcatactggagcagggcaggcccttaatccaatatgactggtgttccttataaaaaaaagataanggcgggcatggnnggctcacgcctgtaatcccagcactgtgggaggccaagccaggcaaatcgcttgaggctgaggagttcaagaccagcctggcccaacatggcgaaaacccatctcttctaaaaataaaattagccatgccgtggtgcttgtaatgtcagctaccccaagaatctgangcacaaagaatcacttcgaacctgggaagnggaggttgccanaaccccaccactggcactncagtgtggagcaacaaaaccgagactcttgtcttcaaaaaaaaananannaaannnnnnnnnnancctcgnancctttaaaactttagggaggccgtntttacgtanatcccaaacatggat

SEQ ID NO: 3538 - DNA, 786 bp, Homo sapiens
  misc_feature 16, 516, 641, 652, 682, 726, 784: n = A,T,C or G
ttattttatacagctnttgttctttttgcaggatccctcgattcgaattcggcacgaggatgaggagtgtttaatcattgatacagaatgtaaaaataatagtgatggaaagacagctgttgtgggttctaacttaagttccagaccagctagtccaaattcttcctcaggacaggcttctgtaggaaaccagactaatactgcttgtagtcctgaagagtcatgtgttttaaaaaaacctatcaaacgagtatataaaaaattgatccagttggagagattttaaaaatgcaggatgagctcttaaagccaatttccagaaaagtaccagaattgcccttaatgaatttagaaaattctaaacagccttctgtttctgagcaattgtctggtccttcagactcctctagttggccgaaatctggatggccttctgcatttcagaagccaaaaggacgattgccatatgaacttcaggactatgttgaagatacatcggaatacctagctcctcangaaggaaattttgtttataagttatttagcctgcaagacctgttgttactcgtacgctgcagtgtccagaggatagagacaagaccacgttctaaaaaaccggaagaaaatcagaagacaatttncagtttatgtnctacccaaagtagagtatcaagcttggttntggagtttgaagctcttgactgaaagtggactttgtcgcttatngactggaaagtttattgctttccaccagctcattttatgtttgggcatatcgatgccntt

SEQ ID NO: 3539 - DNA, 786 bp, Homo sapiens; identical to SEQ ID NO: 3538
  misc_feature 16, 516, 641, 652, 682, 726, 784: n = A,T,C or G

SEQ ID NO: 3540 - DNA, 780 bp, Homo sapiens
  misc_feature 3, 6, 356, 414, 444, 475, 491, 526, 571, 616, 651, 662, 692,697, 713, 741, 757, 763: n = A,T,C or G
ttnctngttctttttgcaggatcccatcgattcgcgccggtagcggctgggtctggagccggccgagggagacggtcggcagccacagtggcggcttggggcggatggggcggcccggccgcgggcctggtaacattcttgcttgcaacttgcggcagggccaacttgaccggccgggccctggtccggccgggtgcaagttcaattgagaacttttttgacggaagaggggaccaaaccattccaagtgggagtggaattcctcagctgcttcctcaagctgcacaccaccagccaccttcacagtgactttgttgagtgtcaaaacatctcaaggaaatttctcctcttctctncatggaggctatggcattggtactgaagagaggaaacttacccaagaaaccacttatncaaatacttacatttttgacttgtttggangtgttgatcttcttgtagaaattcttatgangcctacgatctctatncggggacagaaactgaaaataagtgatgaaatgtncaaggactgcttgagtatcctggataatacctgtgtctgtcaganggagttacaaagcgtttggcagaaaagaatgactttgtgatcttnctggttacattgatgaccaagtaaagaagacattnttacaaacagnaacccttcattgaagatattttgggtgttnaaaanggaaatgatccgactngatgaagtccccaatctgagtccttaanttccaattcgatcaanaacaantcgcttaatttttgccg

SEQ ID NO: 3541 - DNA, 794 bp, Homo sapiens; identical to SEQ ID NO: 3531
  misc_feature 1, 2, 3, 7, 8, 9, 10, 11, 12, 722, 766, 782, 794: n = A,T,C or G

SEQ ID NO: 3542 - DNA, 696 bp, Homo sapiens
  misc_feature 5, 8, 590, 668, 669, 670, 671, 672, 673, 674, 675, 676, 677,678, 679, 680, 681, 682, 683, 684, 685, 686, 687, 688, 689,690, 691, 692, 693, 694: n = A,T,C or G
aaatngcnaggctacttgttctttttgcaggatcccatcgattcgaattcggcacgagaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctncagtcctgattactgtacacagtagctttagatggcgtggacgtgaataaatgcaacttatgttttaaaaaaaaaaannnnnnnnnnnnnnnnnnnnnnnnnnnat

SEQ ID NO: 3543 - DNA, 708 bp, Homo sapiens
  misc_feature 10, 11, 18, 580, 586, 589, 604, 651, 676, 680, 690: n = A,T,C or G
ttagccttgnnttttgcngatccctcgattcgaattcggcacgagaaaaacctgggtatgtatctagaagtggaaaaacaaaaaaaggaaataagttatgaaaataaaaaccatgtcttgagctgggtgcgctggtgtgtgcctatatccctagattctcaagaggttgagacaggaggatcacttgagcccaggagttcaagtccaacttgggcaacatgacaagacccttgtctctttaaaaaagcaactcaaaccatgtcttgaaaagctatttaatggtcagacacgatggctcacgcctgtaatcccagcactttgggaggccgaggcaggcggatcacttgaggtcaggagttcaagaccagcctggccaacatggcaaaacccagtctctactgaatgaaaatacaaaaattagctggcctagcagttggtggtggcaggtgcctgtagtcccagctacttgggaggctgaggcaggagaatcgcttgaattttgggaggcggaggttacagtgaacccacatggcgccactgcactccagcttgggtgatagatgagactctatctcaaaanaaaaanaanaaaaactcgagcctntagaactatagtgagtctattacgtagatccagacattgataagatncattgatgagtttggacaaaccacnactnggaatgcagngaaaaaaaatgctttttt

SEQ ID NO: 3544 - DNA, 772 bp, Homo sapiens
  misc_feature 2, 7, 8, 17: n = A,T,C or G
tnctaannccggctatngttctttttgcaggatcccatcgattcgaattcggcacgaggtttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggagaggagggagacctgctggtgcccttgcaccagggtgaggcctgactcacgctgcttccccccacaggccctgctttgcttgcctgctttttccagaatcgattttgcaagcttcaagattctgttcccctcttcgcagaagtgaggaaggcaaatactcagggtttgaagggagacctggccggcctgagggctggcagatgtgagggcaggacacctgggatggactcgtaggctgacccaggcccaaagggggctgcctgttcccaactctttcactctgtaacccattttaaaatgagtttttgaatcttgcctcaaattgacctacttggataaaatcagtgcttttcctaacttgattttgtttgacgtggttccctctaagagaatggtaggaattgaaactatttgtatatgttgaaatttgtaggggttcaggaacccatggcagaaacactaaactatttatttacaagtatgactatttttttttcaaaagtaggcaattctttgtatattttaaggcaaataatcacttcaccttctggtgccttcc

SEQ ID NO: 3545 - DNA, 777 bp, Homo sapiens
  misc_feature 6, 8, 749: n = A,T,C or G
ttaacntncagctacttgttctttttgcagggatcccatcgattcgctggaccgggtcttggtgctttccagctcagggcgttggtccacttggttattcttggggaccaaaatccaagctaggatggggacagaggcctggagacaacctgctggcctccttccattaaagccattacagtgtcaccacaggattgtaagaattacaaatgcgttttccagagtccccagagaaaaaggagtctggcagttagaagagtaaagtgcatctgtcaacaaaagaaataccaaagatgagactacagcagcgacttgtcacctcttccgtgttgctactgcctgagaacagaggtttttagtttctttaaagggttgtaaacataaaaacaaagaaggatacaacatgcaaggcctaaaatgtttactttctggccttttacacaggcagttcgccagccccctaccctacagtatggaaaaaaggcatagaacagtcaaatcacgtaggatttcttggtttctccatgcaggctcatcgaatagcaaccatcctttcttagtttcttgaaacaagtaccttatttacattcagagaattatatgtggacaaacagctcataagcccgtacttttacatactcacttcctgaattgcatattgaaaaagagagttcatgtaaagccgattattatttaatctaaagttatgttcacataggaagcactagtgtagagaaatagggtctganggacaaggagcctgtgtgcccgtgtcgg

SEQ ID NO: 3546 - DNA, 777 bp, Homo sapiens; identical to SEQ ID NO: 3545
  misc_feature 6, 8, 749: n = A,T,C or G

SEQ ID NO: 3547 - DNA, 786 bp, Homo sapiens
  misc_feature 6, 21, 22, 79, 656, 670, 687, 694, 738, 749, 765, 768, 771,772, 776, 777, 778, 779, 780, 781, 782: n = A,T,C or G
cctaancgcttggctactcgnnctctctgcaggcatcccatgcgattcgggtagttaagcccccccaaaacaagacggnaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaangtgcaccgaaggtnaaaaagtattttttcangttgtanataatttatttaatatttaatggaaagtgtatttattttaccanctcattaaacnttttttaaaccaaaanaanacnntctnnnnnnntccc

SEQ ID NO: 3548 - DNA, 741 bp, Homo sapiens
  misc_feature 2, 7, 8, 9, 10, 14, 15, 18, 55, 686: n = A,T,C or G
gngaggnnnntttnnaanatcagctacttgttctttttgcaggatccctcgattngaattcggcacgagatttgaggacctcagacatttttaaaaatgtaaagggggtggggtcaggctcagtggctcgtgcctgtaatcccagcattttggagggccgaggcgaacggatcacttgaggccaggagtttgaggctagtctggtcagcatggtgaaaccccgtctccactaaaacaaaaagttttctggatgtggtggcacacatacctgtaatcccagctactttggtggctgaggcatgagaatcacttgaacccagaagacaggttgcagtgagccaagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatncttgccagtcttcatttgcctaattttgccattctcataatgtggcaattgtcaa

SEQ ID NO: 3549 - DNA, 709 bp, Homo sapiens
  misc_feature 3, 12, 20, 652, 701, 708: n = A,T,C or G
ttnaaatcgctnggctactngttctttttgcaggatcccatcgattcgaattcggcacgaggtaagttatttgttaagttagaaccctcagtgcatggtctagggatctctggaggtccccaggaccctttcagagaagccatgaggtcaaaactgttttcataagcagaaccaaaacattatttgactttttcaatgcattggcatttgcattgatggtacaaaagcaaggatgagtaaaatgggtgattccttagcgtgatcaagatggtagtaattgtactagtagtcattgtattcttcactgccacaattttttttaaaactaccaattttaattaagaatgttagtcacagttgtttaaaagctcagaactcccattaaaaaaaaatttaaaaaagaatgtctttggtaaagcagcaaaaactggatgaattttattaactctagagccttgagtaaacatcttttcaggattttgtgtgttgaaatagaaagtatgggccaggtgcagtagctcatacctgtaatcctagcactttgggaggctgacgtgagtggatcgcttgagcctaggagttccagaccagcctgggtaacatagtgaaaaccctgtctctacaaaaaatacaaaaaaattagctgggtgtngtggtgtgcacctggtggtgtcagctactttgggaagcttgaaggcaanaaaggant

SEQ ID NO: 3550 - DNA, 744 bp, Homo sapiens
  misc_feature 7, 8, 16, 18, 19, 38: n = A,T,C or G
gagaggnnttctaatncnngctacttgttctttttgcnggatccctcgattcgaattcggcacgaggtggatacctctagtgcaatttataagcaatatcgtttacaaaaggttacagagaagtatccagaattgcagaatttacctcaagaactctttgctgttgacccaactaccgtttcacaaggattgaaagatgaggttctctacaagtgtagaaagtgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaacctgtacagtggatggaatctgctttgttgggagtgatggatggacagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagatgtttgtgctttcaacatttcatttgaaatgggagaagataaaatcacttgatgtacctggaaactatgctttacatggcaatcaaagccttt

SEQ ID NO: 3551 - DNA, 699 bp, Homo sapiens
  misc_feature 1, 656: n = A,T,C or G
naatcgctaggctcttgttctttttgcaggatcccatcgattcgaattcggcacgagctatgatcaggactgactaggtagttggcatggcccatagagaacaaggaaagatgggctggtggattggcccacctgggagccacatggggcaaggggagccctcaccctcagccagccagacgagtgggatttcccccagcacagcatacccccttcacaaagggacaactaaagtgcttcattaagcaagtcctggatcctgtgccccccaactgggtgagacaccccaatgggtcaccagacaccttatacaagagcatttctactggcatcaggtgggtgcccctcaaggacagagatcccagaggaaggagtggggtctcatctttgctgttctccagcactctctggtgacatcttcaggtgtgggagggacccagataagtagggcttgaagtgaatccccagcaaactgcagcagccctacagaagaggtgcctgactgttcaaaggaaaacagaaagcaacaacaacatcaaccaaaaagtccccacgaaaacctcatctaaaggtcagcagcctcaaagatcaaaatgagacaaactcatgaagatgagaaaggaatgaaaaacccctcacaactcaaaaggccagantggcttgtttactccaaatgatcacaacacctctacagcaagg

SEQ ID NO: 3552 - DNA, 692 bp, Homo sapiens; identical to SEQ ID NO: 526
  misc_feature 5, 659: n = A,T,C or G

SEQ ID NO: 3553 - DNA, 719 bp, Homo sapiens
  misc_feature 3, 4, 5, 6, 7, 8, 10, 11, 12, 13, 18, 654, 691, 693, 695,696, 697, 698, 699, 700, 702, 703, 704, 705, 706, 707, 708,709, 710, 711, 712, 713, 714, 715, 716, 717: n = A,T,C or G
gcnnnnnntnnnnttgcnaatcgctaggctacttgttctttttgcaggatcccatcgattcgaattcggcacgagttttttctaatccaaacgcacttctctttattcaaaccagggtcaaactggtcaatgggaaacgccctgaagccacgtgcctggggagaaaggcttcctactcggttcggttcagcgctgcgtgggatccacgcggctggctgtgcgcaacccccacagttcacctcagacactaccaagcaggtcagtcgacaaaagcaaggaattaaacaaaaaacagaaatacactcagtagatttcttctagaagctcccagagtttctggaccaccaagtcccaacccccaaagccaggagcgaggggactaacagcgcaccccctccaccagtgccgacggaaaccccgttttaaattaaaaaataagccagtatacatcgtagaaaatttctcttaaaaatctcacaatttgtaaatgtatattttttctttaacataaaagtttacaatataccgtaaaacaaaaggctcaggaaaataatttccaaaaaaaaggaagaaaaagaaacctgaagttttgaattaaagctgaagacatttttttaaaaccctgttgttgaaccagtgacttttttttattgngctgatgggttagagaaagaaatatttaaaaacaaananannnnnnannnnnnnnnnnnnnnnaa

SEQ ID NO: 3554 - DNA, 715 bp, Homo sapiens
  misc_feature 2, 4, 5, 7, 10, 17, 36, 61, 75, 93, 108, 124, 130, 144, 150,162, 174, 176, 177, 185, 192, 193, 197, 206, 208, 222, 233,243, 261, 281, 289, 290, 291, 295, 308, 309, 317, 319, 320,322, 324, 325, 333, 334, 339, 340, 341, 342, 344: n = A,T,C or G
  misc_feature 351, 353, 358, 363, 365, 370, 382, 386, 388, 392, 396, 403,408, 411, 412, 427, 430, 433, 434, 440, 448, 449, 454, 457,463, 464, 469, 480, 492, 493, 497, 503, 505, 506, 508, 532,533, 538, 540, 543, 544, 553, 561, 570, 581, 585, 587: n = A,T,C or G
  misc_feature 592, 594, 619, 623, 632, 646, 668, 697, 698, 699, 701, 702,711: n = A,T,C or G
gncnntnttnacttccnaatcgcttggctactcgtnctctatgcaggatcccatcgattcngacagactcgtctnatcagagatggggagaangtcgaagcctatcantggagtgttagtgaanggaggnggataaaaattggngatgtngttggctcatcnggtgctaatcancnnacatctgnaaaagtnntatntgaagggananaatttgattatgtnttctcaattgntgttaatgancgtggaccatcatataanttgccatataataccagtgntgaccctnnnttanctgcctaccactnnttacagancnntnanntgaatccnntgttnnnngntcaactncnttaantcatnantggtnacacataaggtnatangntggnactngagaatnccagnttnncagatccatttacangcngtnncacggnatgtcacnnctctnctngatctnntgacncactgcccacngctgatcctttnncaantgctgnanngnatgtaccacattctgaatgtatcnnaactncnatnncctgataancatccatntcagggaanattgcctcccnatcngnatgcntntaaaacaatgaatcttgggcccctnatanctaggctgncacattatgaccangcttaccctacaccaatattangtaaactgaaatgaactttatggaactgnnntnntagcacaantttc

SEQ ID NO: 3555 - DNA, 721 bp, Homo sapiens
  misc_feature 3, 10, 12, 15, 17, 459, 520, 683: n = A,T,C or G
ttnaagcctntnttnantttcaaatcgctaggctacttgttctttttgcaggatcccatcgattcgaattcggcacgagaggaggaaagggaactccctgaccccttgtgcttcccaagtgaggcaatgcctcgccctgcttcggctcgcgcacggtgcgcgcacccactggcctgcgcccactgtctggcactcgctagtgagatgaacccggtacctcagatggaaatgcagaaatcacccgtcttctgtgtcgctcacgctgggagctgtagaccggagctgttcctattcggacatcttggctcctccccaagagttctggagtctgagaagtcaaggatcggggtgctggcctattcagttcctggtaagggctgtcttcctggcttgcagttgaactacttcttgctgtgtcttcacaagcatgcccccatcctgtgccgataagaactccanaccccaaactcagctcatacacacacggaagagagaagcatctgaacatcaagaagagaanaagctgctggacatcagaaactgtgaaaggagaggagtttggctgagctccaggggaagactgcctgcacattctatccccttttcagttccccatcctgctgtcagccacatttaccactcaataaaatcttcacattcaccatccttcaaaaaaaaaaaangaaaaaactcgagcctctagaactatagtgagtccgat

SEQ ID NO: 3556 - DNA, 711 bp, Homo sapiens; identical to SEQ ID NO: 525
  misc_feature 3, 5, 7, 10, 12, 25, 546: n = A,T,C or G

SEQ ID NO: 3557 - DNA, 771 bp, Homo sapiens
  misc_feature 1, 4, 13, 127, 131, 133, 136, 143, 145, 158, 159, 160, 173,207, 209, 215, 218, 220, 222, 225, 226, 229, 252, 279, 404,500, 505, 512, 535, 545, 613, 631, 639, 646, 653, 656, 662,712: n = A,T,C or G
nttnaacatacangctacttgttctttttgcaggatcccatcgattcgaattcggcacgaggtgaaagagttcatgacctccttgcgccgggcctggtgctctgcgatcaagggctgcagaaccagncccngngcntggtggncntgacctcttacannncgtgccgtattcnaatcgttggtatcctgctcaaggactgtagctcntntacganaangntnacnnacntgatagacacgtccacatcacanttgcccccaaactgcctgtgctcctcnatggtgtctctccctccagaaaacgcatgcttattgaccttggttttgatctgcttggccgtgtcggtgaggaagatggaggagttggggtcgctggcactcattttggtctgggcgccctgcanggctgggaagaaggtggagtgcacatgggataaggcactggatatccgtcctgtctcggaagatctgtgggaatgagttgctgaaggagggagcancctgnatggcangaaaactgatcttcccaatgcantcgctgtcantgaagccgaaaatgcctttcacttggttgaaggtaacatgcttttgaatcttcaccacatttttgtanaaacctgaactgctctanaactatantgagtcntattacntanatccanacatgataagatacattgatgaatttggacaaaccacaactagaatgcantgaaaaaaatgctttatttgtgaaatttgtgatgctattgctttatttgtaaccattac

SEQ ID NO: 3558 - DNA, 752 bp, Homo sapiens
  misc_feature 2, 6, 7, 8, 9, 10, 18, 38, 470, 572, 684, 708, 723: n = A,T,C or G
gngagnnnnntttttaanatcagctacttgttcttttngcaggatccctcgattcgctcaaaaccaaatctcaactcagctacagaatctactgtggtccttgtctgaaaaaattagttcactcggttggaatcttgtctcagagcatcctcatctctttctcaaaagcccctaccccaacaccggcgtgttggttgtctattgaaacttacaagtggatggaccctttctcccgaataaactggcctttgaaagctctaatcgaaatggtttggcaaaatccatactgcaggagattagggaggacaagaatgatgtgcctttttgtactgctgagcctgatggtggtgccactacttcaggtacttagatgagtcttgatgctaatagaattgtgtcgccaaacatatctggacagttacaacctaatctatgcattaattggtttgggaattgcttgaaattattgnttaattcaatgttttaattcgttttcctaaaaatttaagtgcccccatcatcgtgcaatacctcagtgcagcaactccttgattcttggatgactgaacttnctaacttgactctgcccattggtcccatttttcatgtttttcacaaatagttaaccaggtacctactactgtgcaccgctgcagaagcattgaaggatgtatgtgatgagtnaaaacacccaacctgctctgctgngttaggattatgacngaaactggtcaaaatcacatgtgaacaaa

SEQ ID NO: 3559 - DNA, 742 bp, Homo sapiens; identical to SEQ ID NO: 3461
  misc_feature 2, 3, 6, 7, 8, 9, 10, 11, 12, 13, 14, 15, 17, 18, 19, 21,25, 26, 31, 735: n = A,T,C or G

SEQ ID NO: 3560 - DNA, 742 bp, Homo sapiens; identical to SEQ ID NO: 3461
  misc_feature 2, 3, 6, 7, 8, 9, 10, 11, 12, 13, 14, 15, 17, 18, 19, 21,25, 26, 31, 735: n = A,T,C or G

SEQ ID NO: 3561 - DNA, 733 bp, Homo sapiens
  misc_feature 2, 3, 4, 6, 7, 8, 9, 10, 11, 12, 13, 14, 15, 18, 19, 21,25, 32, 84, 91, 92, 99, 107, 115, 116, 119, 123, 133, 136,147, 148, 153, 161, 162, 194, 195, 198, 200, 208, 214, 223,228, 234, 237, 240, 241, 245, 247, 254, 256, 268, 272: n = A,T,C or G
  misc_feature 290, 313, 316, 317, 335, 341, 346, 356, 375, 378, 383, 385,391, 406, 407, 417, 426, 443, 480, 496, 531, 532, 556, 578,580, 582, 583, 586, 587, 597, 603, 604, 607, 610, 613, 614,623, 624, 631, 648, 677, 682, 718, 720: n = A,T,C or G
gnnngnnnnnnnnnnggnngntttntagatanagctcttgttctttttgcaggatcccatcgattcgaattcggcacgaggccntcctgtnnacagcgnggcaagangaatcatnntgnctgngcattttgcnctncttatctgggnntatantgtacatnnaggacagaccactcctaattgacaacatctannctntntggatgtnaaagangttgccagngtatnacaaangtnganntagnanactaatntnttttgtacattntggnttacaagtcctaggaaanattggcttctgaaaatttgatgnctnntgggttgatggagatggnaagggntctangccagaatgntcacatttggaagactctntcnaattntnactgtnggtacatgtttgcanntatattcaanactgctgtntacatagtagacaaatnaactccttacttgaaacatctagtctatctagatgtntagaagtgccccatgnatgctaaatgtatacgtagtgaaataccactttgnnaatatctctttgctaaaattcatncgaaatgcttttggaaattgantngnnaanncacctttgtnaacagnntantgntgnntatccttgnncaatatnttaaaggacgtaagganggaagaaattgcaaaaagggatatcctancgtgngcatacttgggcatttcagacccttgttctatatgntngggcatctgggtt

SEQ ID NO: 3562 - DNA, 733 bp, Homo sapiens; identical to SEQ ID NO: 3561
  misc_feature 2, 3, 4, 6, 7, 8, 9, 10, 11, 12, 13, 14, 15, 18, 19, 21,25, 32, 84, 91, 92, 99, 107, 115, 116, 119, 123, 133, 136,147, 148, 153, 161, 162, 194, 195, 198, 200, 208, 214, 223,228, 234, 237, 240, 241, 245, 247, 254, 256, 268, 272: n = A,T,C or G
  misc_feature 290, 313, 316, 317, 335, 341, 346, 356, 375, 378, 383, 385,391, 406, 407, 417, 426, 443, 480, 496, 531, 532, 556, 578,580, 582, 583, 586, 587, 597, 603, 604, 607, 610, 613, 614,623, 624, 631, 648, 677, 682, 718, 720: n = A,T,C or G

SEQ ID NO: 3563 - DNA, 749 bp, Homo sapiens
  misc_feature 1, 2, 3, 5, 6, 7, 8, 9, 10, 11, 12, 13, 14, 16, 17, 18, 20,21, 22, 23, 24, 25, 26, 27, 28, 30, 31, 32, 33, 34, 35,37, 487, 641, 642, 643, 644, 645, 646, 647, 648, 649, 650,651, 652, 653, 654, 655, 656, 657, 658, 659, 660, 661, 662: n = A,T,C or G
  misc_feature 663, 664, 665, 666, 667, 668, 669, 670, 671, 672, 673, 674,675, 676, 677, 678, 679, 680, 681, 682, 684, 698, 700, 714,717, 718, 721, 725, 727, 731, 732, 735, 736, 747, 749: n = A,T,C or G
nnngnnnnnnnnnngnnngnnnnnnnnngnnnnnntntttagatcagctcttgttctttttgcaggatcccatcgattcgaattcggcacgagctcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaaggtgaatgaaataatggccatggatatattgntattgttctgatatgaaacaaagaatttagagtttcatgaagttatacgtgctctgtccccacaattctgattcagaccaaaatgtgttaagcttaatagcctttttacaagtttgctttaataaatttgaagatgaaggcaaaaaaaaaaaannnnnnnnnnnnnnnnnnnnnnnnnnnnnnnnnnnnnnnnnnanaaaaaaaaaacctngnccctttaaactttnggnngcntttncntaannccnnacttgaaaaancn

SEQ ID NO: 3564 - DNA, 768 bp, Homo sapiens
acatacagctacttgttctttttgcaggatcccatcgattcgagacagtcaagctgcattgcaacactgcatgtctgactaacagcatacattgtcctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaatgttcagaaacacatgtgcaagggagctgtgccaagctcatgttgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggagatgactataagaacaaactcatcttcgcaatatctgtgactgtaatactaataattttgattataattttttgtcttatagaggtgaattcacataaaagggcatcagaaaaatcaaagacaacccatcaatatcaggagcctgagcatgagttaaagcatgtggatggcctggaactatgtttttaaaatggtattaaatattggttttttactt

SEQ ID NO: 3565 - DNA, 735 bp, Homo sapiens
  misc_feature 7, 8, 9, 18, 20, 24, 26, 27, 29, 35, 38, 39, 44, 50, 54,59, 89, 382, 409, 426, 521, 571, 612, 678: n = A,T,C or G
gagaggnnnttttgaagncngctngnngncttttngannagttntcgtcngcangatgnacacacggagacagatactgtggaccccanaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttcagtcttgcgaggacagcctcatagagaatgagattcaccagtaaggggagggaggggccctggaggccacatcctgccccaccccacccccactcccacngacactaaaacgctaataatttattanatctaaagccccttctncccagcccctgctttcattaaggtatttaaacttgggggtttcactgctctccccccatgatggaaggagggagccccccaacctcagtgagganagccccgagccggccccggggcaaagaggggtgcagagggagttccccanatcaagtcccccaacccttcccactagtacatgaccagganagggttaatgataccaacaagagtcctggtgcacctggtgccggtggctggagacctggggggcangtggatctggggctgatcccccctccgttttttcacccacatttctctgggatttgc

SEQ ID NO: 3566 - DNA, 716 bp, Homo sapiens
  misc_feature 2, 3, 4, 5, 6, 12, 19, 20, 24, 36, 37, 631, 632, 633, 634,635, 637, 638, 639, 640, 641, 642, 643, 644, 645, 646, 647,648, 649, 650, 651, 652, 653, 655, 656, 657, 659, 660, 661,662, 663, 664, 665, 667, 668, 669, 670, 671, 672, 673: n = A,T,C or G
  misc_feature 674, 675, 676, 677, 679, 680, 681, 682, 683, 684, 685, 686,688, 689, 690, 691, 692, 693, 694, 695, 696, 697, 698, 699,700, 701, 702, 703, 704, 705, 706, 707, 708, 709, 710, 711,712, 713, 714, 715: n = A,T,C or G
tnnnnntttttnaaccagnnttcnaatccttggcgnnaggctacttgttctttttgcaggatcccatcgattcgaattcggcacgagaagaaaggctgcctttgagttgaccaaccatgttgaggtggtagatgggtgctaaactcactgtagtctgagtaattgacttccacaagtcatccccactgttgagcctttcaaaatgaagtctcagtatatttacaaattaatggacatcctctctggggattagtcatattctaattcaacaaagacattgtttgaagtttgtttttgtttgctaaatgaactaaaaattatgagatttgcacctaaaggtactgaggtaaaggagagccaaaagtggggtagtcaatctacttattcagaatgagtcgataatttaaacatgtctaatagcagagacagtatattatagaaatggcattacattctctgagatctgcttttactgaagtggatcaatgatgaaactagccaaatctgagcatcagaaggctttccggtctacctgatgcatgatctctacagttctgagaagcagaactataaaacaatgtaaaacaataagggcatatgtctggtgtgtgtgtggggggtgtgtgtgtgnnnnncnnnnnnnnnnnnnnnnngnnncnnnnnnngnnnnnnnnnnntnnnnnnnngnnnnnnnnnnnnnnnnnnnnnnnnnnnnc

SEQ ID NO: 3567 - DNA, 751 bp, Homo sapiens
  misc_feature 7, 8, 14, 38, 193, 400, 514, 566, 647, 656, 663, 700, 714,732: n = A,T,C or G
gagaggnnttttanagcctgctacttgttctttttgcngatcatcgattcgaattcggcacgagaaatacctcaggaaaaacgaggaggtgaagtattggattcttctcatgatgacataaaacttgaaaaaagtaatattttgctgcttggaccaactgggtcaggtaaaactctgctggcacaaaccctanctaaatgccttgatgtcccttttgctatctgtgactgtacaactttgactcacgctggatatgtacgcgaagatattgaatctgtgattgcaaaactactccaagatgccaattataatgtggaaaaagcacaacaaggaattgtctttctggatgaagtagataagattggcagtgtgccaggcattcatcaattacgggatgtangtggagaaggcgttcatcaaggcttattaaaactacttgaaggcacaatagtcaatgttccagaaaagaattcccgaaagctccgtggagaaacagttcaagttgatacaacanacatactgtttgtggcatctggtgctttcaatgggttacacagaatcatcancaggaggaaaaatgaaaagtatctttggatttggaacaccatctaatctggggaaaaggcagaagggctgcagcttgctgnagaccttgnttaatcnaaagtggggaatccaatacttacccaagacattgaanaaaaagatcgggtntgcgtcatgtggaaaccngagatctgattgagtttgg

SEQ ID NO: 3568 - DNA, 749 bp, Homo sapiens
  misc_feature 2, 6, 7, 8, 9, 10, 15, 18, 341, 358, 640: n = A,T,C or G
gngagnnnnntttanaanatcaggctacttgttctttttgcaggatccctcgattcgtaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtnattgtttctctcactgnttatacgttattcatgattgatggctactataatgtcctctgggaaaagcttgacgattatgtctactacgttcgttcaacaggcagtattattgaatttatatttggagttgtaatggttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgnaataaaagggagcccgcttacaagaaataaatgaaggtatgtgcaatctgctatcatgagtttacaacatctgctcgtattacaccgtgtaatcattatttccatgccc

SEQ ID NO: 3569 - DNA, 746 bp, Homo sapiens
  misc_feature 4, 5, 6, 7, 583, 596, 728: n = A,T,C or G
gagnnnnttttaataacagctacttgttctttttgcggatccctcgattcgaattcggcacgagcgtggagagaatactcagaaatgaacctctttaaagccttgcaggaatgagtcactcttacttaatgaaatgttaaagccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtgggtagaaagtgtgttcaggctgacactggcaatgagtacagataatttcactttcctcttcaggggcaaaggctgatggcctctacctttgtatccaggagaaactgcagagcagccctgtgactttacaaaatatgctacctcaaagtgctacccgataaacctttctaattgtaagtgcccttactaagggcacatgtcttaatcaaagttagttttttgttttctggtttgntttttttttttgnatattgatgaatgagatcttacctattaaatatattattggattatgggtcctgaaggtcattaaaagtttgagtgtgtgtgtgtgtgtgtgtgtgtgtgtgtgtgtttatgacttaaatatctttacgtgnggtttttaaaacttgggt

SEQ ID NO: 3570 - DNA, 967 bp, Homo sapiens; identical to SEQ ID NO: 537
  misc_feature 5, 10, 19, 20, 22, 23, 24, 39, 45, 52, 58, 68, 69, 81, 91,94, 95, 99, 105, 123, 136, 138, 139, 140, 141, 146, 155,163, 167, 168, 171, 176, 189, 199, 200, 225, 228, 230, 231,232, 240, 249, 251, 265, 273, 274, 280, 282, 283, 284: n = A,T,C or G
  misc_feature 287, 298, 301, 305, 308, 319, 320, 321, 328, 335, 336, 350,356, 358, 359, 361, 362, 365, 372, 393, 394, 408, 411, 412,413, 424, 425, 430, 440, 452, 454, 457, 458, 460, 467, 469,474, 479, 482, 484, 485, 492, 507, 509, 519, 520, 522: n = A,T,C or G
  misc_feature 525, 537, 540, 547, 554, 556, 559, 561, 563, 564, 575, 581,584, 586, 588, 595, 596, 599, 602, 606, 609, 610, 613, 618,620, 624, 635, 643, 648, 652, 657, 659, 665, 669, 670, 671,678, 685, 699, 701, 704, 707, 714, 715, 719, 723, 724: n = A,T,C or G
  misc_feature 726, 728, 731, 734, 736, 741, 745, 746, 752, 753, 756, 764,765, 771, 782, 788, 790, 792, 795, 800, 804, 811, 813, 814,819, 828, 833, 834, 841, 842, 843, 850, 851, 866, 871, 878,882, 883, 886, 887, 891, 895, 899, 902, 910, 911, 917: n = A,T,C or G
  misc_feature 919, 927, 934, 935, 937, 941, 951, 952, 953, 957, 965, 966,967: n = A,T,C or G

SEQ ID NO: 3571 - DNA, 967 bp, Homo sapiens; identical to SEQ ID NO: 537
  misc_feature 5, 10, 19, 20, 22, 23, 24, 39, 45, 52, 58, 68, 69, 81, 91,94, 95, 99, 105, 123, 136, 138, 139, 140, 141, 146, 155,163, 167, 168, 171, 176, 189, 199, 200, 225, 228, 230, 231,232, 240, 249, 251, 265, 273, 274, 280, 282, 283, 284: n = A,T,C or G
  misc_feature 287, 298, 301, 305, 308, 319, 320, 321, 328, 335, 336, 350,356, 358, 359, 361, 362, 365, 372, 393, 394, 408, 411, 412,413, 424, 425, 430, 440, 452, 454, 457, 458, 460, 467, 469,474, 479, 482, 484, 485, 492, 507, 509, 519, 520, 522: n = A,T,C or G
  misc_feature 525, 537, 540, 547, 554, 556, 559, 561, 563, 564, 575, 581,584, 586, 588, 595, 596, 599, 602, 606, 609, 610, 613, 618,620, 624, 635, 643, 648, 652, 657, 659, 665, 669, 670, 671,678, 685, 699, 701, 704, 707, 714, 715, 719, 723, 724: n = A,T,C or G
  misc_feature 726, 728, 731, 734, 736, 741, 745, 746, 752, 753, 756, 764,765, 771, 782, 788, 790, 792, 795, 800, 804, 811, 813, 814,819, 828, 833, 834, 841, 842, 843, 850, 851, 866, 871, 878,882, 883, 886, 887, 891, 895, 899, 902, 910, 911, 917: n = A,T,C or G
  misc_feature 919, 927, 934, 935, 937, 941, 951, 952, 953, 957, 965, 966,967: n = A,T,C or G

SEQ ID NO: 3572 - DNA, 738 bp, Homo sapiens
  misc_feature 6, 7, 8, 12, 17, 18, 695: n = A,T,C or G
gagagnnntttntaatnncagctcttgttctttttgcggtccctcgttcgagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaaggagagcacagcagagagcagaatctcctgaatctagtgcaattgaatccacacagtccacaccacagaaaggacgaggaagaccatcaaaaacgccatcaccatcacaaccaaaaaaaaatgtcccgtgtaggacgctccaaacaagcagctactaaggaaaatgattcaagtgaagaagtagatgtgtttcaagggtagctctcctgtcgatgatattccacaggaagaaacagaggaggaggaagtttctacagtaaatgtacggcggcgaagtgctaaaagggaacggcgatgaacaaatgtaattaataactttctctgtgaaagctttggaaaaatctttttttttttttggtcaagcttgagcttgataaagcctttgatgcacaaaatgggctgctgaaaatggacagttggncttactttggtgcccctactttgtggcacatctttaccatcac

SEQ ID NO: 3573 - DNA, 747 bp, Homo sapiens
  misc_feature 2, 3, 5, 6, 8, 9, 10, 11, 12, 13, 14, 15, 16, 17, 18, 20,21, 22, 23, 24, 25, 26, 27, 28, 29, 30, 31, 32, 34, 35,36, 38, 39, 46, 480, 482, 483, 484, 577, 609, 611, 697,719, 741, 743: n = A,T,C or G
gnngnngnnnnnnnnnnngnnnnnnnnnnnnngnnngnntttatgnatcagctacttgttctttttgcaggatcccatcgattcgctccattgtgaagatccaggcatttttccgagccaggaaagcccaagatgactacaggatattagtgcatgcaccccaccctcctctcagtgtggtacgcagatttgcccatctcttgaatcaaagccagcaagacttctctgctgctgtgatctgcacaccctccaacctgggcagggactggggggatgcagtgtgtgttagtgcccatgtggcattgtggcactgttgccccccatggcggcatgggcaagatgaccttccattagcttcaagtcttgttctcttgtctgtggtctgtttaatatgtgggtcactagggtatttattctttctcccatccttacactctggatcattgtgcagacttaatcagggttttaacgctttcattntnnnttttttttttttgactcaaagagagttctcattttccctattcaaactaatacccatgccgggttttttaccttggatttaaagtcaccttangttggggcaacagattctcactcatgtttaananctggtatttcagcttcataagatcaaagaggagtctttccctttctcttttaccctcaggatctcatcccttacagctgactcttncaggcaatttccatagaactgnagtcctgctttggcacaagctntntgtg

SEQ ID NO: 3574 - DNA, 716 bp, Homo sapiens
  misc_feature 3, 29, 627, 689, 690, 691, 692, 694, 697, 698, 700, 701,702, 704, 707, 708, 712, 714, 715: n = A,T,C or G
ttnattaatgcttggctactcgttctttntgcaggatccctcgattcgaattcggcacgaggtcctaaagccgctgaagcaaaaaccatgataaaacattctgctttcttttcttttacaaccccacgaacgcaaaaaaaaaaaaaaacaaaaacaaaacaaaaaaaagaaacaacaacaaaacccaaactatttgtaggaaaaaatggttttgtacatgggatgaaacaatataaattcaaaacttacagataagggttagctctatcactcaactctttaaaaagtttatatgaatatccagtcaaaaccaacacggtattgcccttgaaatgttaactagacggatttccaaggagaccacaggactgtatactgtcttggaatgtcctcagaaggctctgtcattgatcaggtaacagtaaaaaccccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattangccccagcaacacgtcattgtgtaaggaaaaataaaagtgctgccgtaccaaaaaaaaaatnnnngnccnnannncnaanncttngnnt

SEQ ID NO: 3575 - DNA, 731 bp, Homo sapiens
  misc_feature 3, 4, 5, 10, 11, 18, 39, 46, 67, 71, 72, 88, 99, 105, 110,112, 119, 121, 124, 131, 141, 147, 155, 157, 160, 166, 168,181, 182, 188, 189, 190, 205, 206, 208, 216, 219, 222, 223,226, 235, 237, 243, 248, 249, 250, 251, 255, 256, 258: n = A,T,C or G
  misc_feature 264, 267, 274, 275, 291, 297, 298, 303, 304, 307, 308, 311,313, 315, 316, 319, 325, 326, 329, 330, 336, 338, 349, 363,366, 367, 372, 374, 377, 380, 381, 384, 387, 389, 392, 394,397, 399, 401, 404, 406, 416, 418, 419, 420, 422, 423: n = A,T,C or G
  misc_feature 432, 436, 439, 441, 442, 444, 445, 446, 449, 472, 479, 501,503, 504, 520, 522, 540, 544, 546, 570, 571, 576, 579, 602,617, 628, 634, 635, 644, 646, 653, 659, 667, 673, 675, 684,689, 702, 704, 706, 707, 710, 713, 717, 720, 721, 729: n = A,T,C or G
tgnnnttttnnagtcaanccttggaaatccttggctctngccgctntctgcaggatcccatcgattngctnngcagctccccttccantgagagccctncacacnatttnanaaaaccntncgnatgcatnaactttcaanccatancatgcatncnggntattgntncatgctgatcatnnaacctnnngtccaacagggcggnncngtaatggntgnttnnttnactttttantntgtggngtatnnnntagnncncgcggngcnggctcannttactggaccttgcanatcctnngattnngcnntgngngnntcnggctcnnacnnacatgngnttacagacatnctggcatgttcatntcnncgtgntntcnctnngtnaananggngnctnancntgntngccaagctgntnnnannctcctgggntacnttnanntnnnatnttgactcataccgttgctgattncaaggcntgagccaccactcctggccaangnngcgttgcttgacattncnactaagactatgactatnatgntnccgtgacgacactatagtcctccnnacttntcngtcaagtggcatctgggattgtntcaacatggataaangggccttctanatatcnnggcgttgancntcatttncctgcnttcctganaatttngngcactgaancttanagggccttattcncncnngancancacncgnngatactancc

SEQ ID NO: 3576 - DNA, 731 bp, Homo sapiens; identical to SEQ ID NO: 3575
  misc_feature 3, 4, 5, 10, 11, 18, 39, 46, 67, 71, 72, 88, 99, 105, 110,112, 119, 121, 124, 131, 141, 147, 155, 157, 160, 166, 168,181, 182, 188, 189, 190, 205, 206, 208, 216, 219, 222, 223,226, 235, 237, 243, 248, 249, 250, 251, 255, 256, 258: n = A,T,C or G
  misc_feature 264, 267, 274, 275, 291, 297, 298, 303, 304, 307, 308, 311,313, 315, 316, 319, 325, 326, 329, 330, 336, 338, 349, 363,366, 367, 372, 374, 377, 380, 381, 384, 387, 389, 392, 394,397, 399, 401, 404, 406, 416, 418, 419, 420, 422, 423: n = A,T,C or G
  misc_feature 432, 436, 439, 441, 442, 444, 445, 446, 449, 472, 479, 501,503, 504, 520, 522, 540, 544, 546, 570, 571, 576, 579, 602,617, 628, 634, 635, 644, 646, 653, 659, 667, 673, 675, 684,689, 702, 704, 706, 707, 710, 713, 717, 720, 721, 729: n = A,T,C or G

SEQ ID NO: 3577 - DNA, 750 bp, Homo sapiens
  misc_feature 5, 17, 29, 381, 398, 399, 413, 416, 454, 462, 478, 520, 542,547, 558, 562, 564, 565, 588, 593, 594, 596, 597, 602, 610,611, 615, 619, 620, 621, 630, 632, 633, 636, 638, 642, 646,648, 649, 652, 655, 657, 675, 681, 687, 706, 710: n = A,T,C or G
  misc_feature 713, 715, 723, 725, 727, 729, 732, 734, 741, 748: n = A,T,C or G
ccttnccttgaaagccncaagctacttgntctttttgcaggatcccatcgattcgaattcggcacgagattcccatctgcttttacttcgggtgagcagagggggatgtgtgtgtgcgtgtgtgtcagtctgtttgtgagtgtgttaaaggctacagaccacagttggtttaaaatgcttggaacttcccaaactggctttactttatgtttatacagtgctcagggttaacgcagtacatccatgccattgctgtgggaggtatccccggatgcatgtgttttgagtctataaatatagaaaatatatattggtttctttttccaacttaataggtctattaaagcatgaaatgaaaggttgcatatcatgcattcaggntattacctaatttttgnnctgacagtgcatgnctntggaagcatgctgaaacaccgattaacacaggagtcgngtaacacngagaaacatttgatanatgtacagcattggctattgcattcctatagtgtatataccngggtattgcttcaaaccctgcngaccnctattttcccntctncnncccctgtgttctttggtcaaacntaatnnannacatncatttgcnnttgngttnnnaaactttananntcntngatngtgnanntanacnangtaactttttacctaaanggtgtngcctgnccccaaaattgccattatngggnccncntatttccncnantntananttgttcncacattncg

SEQ ID NO: 3578 - DNA, 712 bp, Homo sapiens
  misc_feature 2, 8, 25, 26: n = A,T,C or G
anttgaanctttctaatgcttggcnntgcaggatcccatcgattcgaattcggcacgagggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccttcacatcacttgacacagctgagctttgttatccatcttcccaaactttctctttctttgtacttcttgtcatccccactc

SEQ ID NO: 3579 - DNA, 710 bp, Homo sapiens
  misc_feature 1, 6, 8, 11, 13, 15, 16, 17, 21, 63, 71, 205, 206, 209, 210,244, 373, 382, 445, 449, 568, 628, 634, 648, 650, 679, 691: n = A,T,C or G
nttaancnttnanannngttntttttgcaggatcccatcgattcgaattcggcacgagggcangggacttnctgtaacaatgcatctcatatttggaatgacccagtcctctcccaagtccacacaggggaggtgatagcattgctttcgtgtaaattatgtaatgcaaaatttttttaatcttcgccttaatactttattattnngtnntattttgaatgatgagccttcgtgcccccccttnccccttttttgtcccccaacttgagatgtatgaaggcttttggtctccctgggagtgggtggaggcagccagggcttacctgtacactgacttgagaccagttgaataaaagtgcacaccttaaaaaanaatgcatanaaaaaactcgagcctctagaactatagtgagtcgtattacgtagatccagacatgataagatncatngatgagtttggacaaaccacaactagaatgcagtgaaaaaaatgctttatttgtgaaatttgtgatgctattgctttatttgtaaccattataagctgcaataaacaagttaacaacancaattgcattcattttatgtttcaggttcagggggaggtgtgggaggttttttaattcgnggccgnggcgccaatgcatngngcccggtacccagcttttggtccctttantgagggttaatngcgcgcttggcgtaatcat

SEQ ID NO: 3580 - DNA, 714 bp, Homo sapiens
  misc_feature 9, 11, 12, 16, 18, 21, 23, 30, 714: n = A,T,C or G
tctaatccngnntttnanttncnaatcgcnaggctacttgttctttttgcaggatcccatcgattcgaattcggcacgagaaagaactgtctcacgcaaccattgattctaaaactggcgatttaggggacatcaatgctgagcagcttcctgggagggaacatcttaatgaacctggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaatttattattgataacacaaaaggtcaaatgttgggacttgggaatcccacttttcagatccatttacaggtggtggtcggtatgttccgggctcttcgggatcttctaacacactacccacagcagatccttttacaggtgctggtcgttatgtaccaggttctgcaagtatgggaactccatggccggagttgatccattacagggaatagtgcctaccgatcactgn

SEQ ID NO: 3581 - DNA, 707 bp, Homo sapiens
  misc_feature 4, 140, 173, 212, 270, 295, 431, 474, 601: n = A,T,C or G
aatntttgctctcgttctttttgcaggatccctcgattcgaattcggcacgaggctatctgaacacagtggaaagatgggaccctcaggctcgccagtggaattttgttgccactatgtctacccctaggagtacagtangtgtggcagtactaagtggaaaactttatgcanttggtggtcgtgatggaagttcttgtctcaaatcagtanaatgttttgatcctcatactaataagtggacactgtgtgcacagatgtcaaaaagganaggtggcgtaggagtgacgacctgnaatggactgctgtatgctataggggggcacgatgctcccgcatccaacttgacttccagactctcagactgtgtggaaagatatgatcccaaaacagacatgtggactgcagtagcatccatgagcatcagcaganatgcagtgggggtctgtttacttggtgataagttatatgctgntggggggtatgatggacaggcataccttaatactgtggaggcttatgatccccagacaaatgagtggacccaggtattttcacatacttttgaggacagcaaagatcacctggtggccatcaagcanaccatctggaggcaaaactccttatctgaggaattcagaagtcattagactgccctattatctaaagcccggcatcttgtactaggcttctttaccaaaaatgtat

SEQ ID NO: 3582 - DNA, 706 bp, Homo sapiens
  misc_feature 573: n = A,T,C or G
ctttaaatctcaagctcttgttctttttgcaggatcccatcgattcgggagagaaaccttatggatgcattgactgtggcaaggccttcagccagaagtcttgccttgtagcacatcagagatatcatacaggaaagactccctttgtatgtcctgaatgtgggcaaccctgttcacagaagtcaggactcattagacatcagaaaattcactcaggagagaaaccctataaatgcagtgactgtgggaaagccttccttacaaagacaatgctcattgtacatcacagaactcacacgggagagagaccctatggctgtgatgagtgtgagaaagcttacttctatatgtcttgccttgttaaacataagagaatacactcaagggagaaacggggggattcagtgaaggtggaaaatccttccacagcaagtcacagcttaagtcctagtgaacatgtgcaggggaaaagccctgttaatatggtaactgtggcaatggtggcagggcagtgtgagtttgcccacatcctgcattcatgataaacagtttgctgtttgatcatatagcctncagcggaatgctgagtttgtcatgtcccatgggcctttggctccctgcactaatatgtatagtagggtttacaagatatgaaatatattttacttttttatatcttataaacctcactaccccttccacaata

SEQ ID NO: 3583 - DNA, 752 bp, Homo sapiens
  misc_feature 2, 6, 7, 15, 248, 251, 252, 260, 269, 273, 274, 276, 277,284, 294, 297, 309, 311, 313, 315, 323, 335, 336, 351, 357,361, 373, 376, 381, 385, 395, 396, 403, 407, 409, 410, 415,424, 441, 448, 450, 454, 476, 491, 498, 504, 510, 518: n = A,T,C or G
  misc_feature 523, 525, 531, 546, 547, 558, 564, 565, 569, 574, 578, 584,585, 588, 589, 596, 597, 598, 607, 609, 610, 620, 629, 631,644, 648, 652, 656, 658, 660, 666, 667, 682, 683, 694, 704,705, 708, 715, 719, 729, 737, 738, 748: n = A,T,C or G
tnaatnnttgctctngttctttttgcaggatccctcgattcggtggtggcacatacctgtaatcccagctactcgggaggctgaaacaggagaattgcttgaacctgggaggtagctgttgcagtgagaaagattggtaccattgcactgcggtctgggccacagagcgagacttccatctcaaaaaataaataaaatagggatggggtctcactgtgttgaccaggctggtcttgaactaatgtccncanntaggcctnccatatcancttnnannggctatncattacaggntcntgtccacatgcnangncnctattacnaactgcatcatnntttgcaccccatatntatganccgnattttaattttncancaatntctnataacattgnngatctgnatanannctatnttgctgctnacaaatctgaatcatcntttccanancatnttggacacacatcacttaattnaacaatttaatgcanctatttngctatnctcctnatttgttncttcntnccacantatgttcttatgaanncatctattttncaattnngaanaaaancacntattgnntgnntatgtannngtatatacntnntcaataccgnctacttttnanctaaacctttccnttgnatanttantntnatgttnncacacttacgggtcnntccattaattntcctacatgnnaanttttacntatntcattagtanactttatnntaattaattnttcc

SEQ ID NO: 3584 - DNA, 704 bp, Homo sapiens
  misc_feature 6, 8, 15, 21: n = A,T,C or G
tcaatncnggctctngttctntttgcaggatccctcgattcgaattcggcacgaggctggacttggcaatggtggtcttgggagacttgctgcctgcttcttggattccatggcaaccctgggacttgcagcctatggatacggcattcggtatgaatatgggattttcaatcagaagatccgagatggatggcaggtagaagaagcagatgattggctcagatatggaaacccttgggagaagtcccgcccagaattcatgctgcctgtgcacttctatggaaaagtagaacacaccaacaccgggaccaagtggattgacactcaagtattcagagtgctcgtatagccagcgttttgtatagtatttagtacagtagataatacattgactatgtagcatatagtggtgatattgagtatagggcatgtcgtgttttgaataatagaatatatttttgtaaataaatctgttacttctcttagcgcagcccagtcattttggagacaaaggagctgaggccaagagaggagtgacttttataagggtcattttgcaaccagctttgtcagaaaattgtcagttcttttttttttttttttttgccagaaaattgtcagttctatagtaaccagcatgcttacctctttggttttatattaaggtgttgatagcaaaattgaatatttgaaaatgtcatttc

SEQ ID NO: 3585 - DNA, 753 bp, Homo sapiens
  misc_feature 2, 4, 7, 10, 12, 14, 16, 19, 25, 26, 28, 33, 37, 88, 89,118, 211, 253, 358, 392, 399, 442, 478, 493, 501, 508, 513,527, 539, 554, 562, 575, 576, 580, 587, 592, 593, 599, 620,628, 641, 660, 674, 683, 700, 711, 716, 721, 725, 726: n = A,T,C or G
  misc_feature 734, 744, 747, 752, 753: n = A,T,C or G
tncnaanggntngnantcncctctnngnaggancccntcgattcgaattcggcacgaggtcaagcctgtaatcccaacactttgggtnnaccgaggtgggggtatctgattgagcctnggaggtcgagatcagcctgggaaacacagggaggcccccatcgctacaaaatattttaaaaattagccaggtgtggtggcttgtgcttgttgncccggctacttgggaggctgaagtgggagggtggcttgagtncaggagttcactgcactgagctgtgatcacaccactgcactccagcctggacgacagagtgagacgtccatctcaaaaaaaaaaataaaaaactcgagcctttanaactatagtgagtcgtattacgtagatccagacntgataangatacattgatgagtttggacaaaccacaactagaatgcagtngaaaaaaatgctttatttgtgaaatttgtgatgctnttgctttatttgtanccattatnagctgcnataancaagtttaacaacnaacaattgcatncattttatgtttcangttcaagngggaggttctggnnaagnttttttnatttnncggccngctggcgccattggcattggnccccggtnccccaaacttttngtcccccttttatctgganggggtttaatttgnctccctttnggccgattatcatgggncaatagcatgntcttncctgngggnngaaaattngtttattccnttncaacnn

SEQ ID NO: 3586 - DNA, 702 bp, Homo sapiens
  misc_feature 8, 13, 15, 17, 21, 702: n = A,T,C or G
tcaatacnagctntngntctntttgcaggatcccatcgattcgaattcggcacgagcaagaagagttttctgttcagtttggaacaagattttgagaagacatttaggatgtactagtttgagtttttaaatgtatatttgagatattttctcaactttctctttgggtctgtagctaaaatatgcagtataatgttttatttatttattttttaagagatggggtctagctattttgcccaggcagactcaaattcctgggctcaagtgatcctctgccttggcctcctgagtagctgggacttacagacatgtgccaccaaacctagtggctatataatttttaaaaatattcttaggatatctttacatacttttcttaaaaaaaaaaagttaacctttgtagttctgtacctttcagtagtctgcaaattttctaccaaaaaaaatcccaagaatttatttgggaattattaaaaaggcaaacaatgaatgttattaggacaagaatatagcagtcaggaggccatgactacatcacagccaggcggcattccctgccacagtggcggcttgaatcatcaagaaatggataaatggggctttagtaaatcaggcttgcaggctcaaagctgcaatctgcccactctcaggtctgagactttgtgggcctcagacaccaggaagaaagttgggatacan

SEQ ID NO: 3587 - DNA, 709 bp, Homo sapiens
cagctcttgttctttttgcaggatcccatcgattcgttgagacggagtttcaccatgttggccaggatggtcttcaacttctaacttcgtgatccacgctgctgggattacaggtgtgagccaccgcgtgtggcctctgggcaccttttgaagctgaagcagagagagaaggcggcaggcatcagcgttttcttctatgaacttataagatcaaagactttaagactttcactatttcttctaccgctatctactacgaacttcaaagaggaaccaggagtacggaaggagcatgaaagtggacaaggaacgtgaccattgaagcaccacagggaggggttcaggcctccggatgactgcaggcaggcctgggtaacatccagcctcccacaagaagctggtggagcagagcgttccctgactcctccaaggaaaggagactccctttcccggtctgctcagtaacgggtgccttcccagacactggcgttaccgcttgaccaaggggccctcaagcggcccttatgcgggcatgacagaaggctcccctcttgccttctattcacttctcacaatgtcccttcagcacctgaccctatacctgccggttattcctaggttatattattaatgcaacagagtaatattaaaagctaatgattaataatgtttataataatgatggataattggtcatgatcatcgctgg

SEQ ID NO: 3588 - DNA, 709 bp, Homo sapiens; identical to SEQ ID NO: 3587

SEQ ID NO: 3589 - DNA, 727 bp, Homo sapiens
  misc_feature 2, 3, 4, 5, 6, 7, 13, 15, 22, 709, 712: n = A,T,C or G
tnnnnnnttttgnanttgaatncttggctctcgttctttctgcaggatcccatcgattcgcagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatagctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaagtgttacgcagtcggctagaagaagttcttggaagaacttggagcgcttaaacaggctggagaccctggccgccattggangtnggggaactggaaagt

SEQ ID NO: 3590 - DNA, 706 bp, Homo sapiens
  misc_feature 2, 3, 4, 5, 17: n = A,T,C or G
tnnnncttcaaatcgcnaggctacttgttctttttgcaggatcccatcgattcgaattcggcacgaggttgctgtcacttggatttctagctttgggagcctgttccacctactcagctctgcattgagcagtatgggcacatgccctgtggacagttactggacgttaatgaactcagaggagaaaagcagtgagccacttgttctgtgtgatttatggtacttcattgctcttccttcacctctagtcactttctattgctacctgccctacattggctcctgccaaggtccctctctctccctgttttcctttttttttttttttgagacggaggacggagtcttgctctgtcgcccaggttggagtgcagtggcgcgatctcggctcactgcaacctccacctcccgggttcaagcgattctcctgcctcagcctcccgagtagctgggactacaggcgcgcgccgccacgcccggctaatttttatatttttagtagagacggggtttcaccatgctggccaggctggtctcgaaccccgacctcgtgatccgcctccttagcctcccaatcctctcttaaaaaagtgatagctcagaaatatttgtaaaagcaaggtttttatttcattttggctctgcattttcagaggcaaagaagtttggcctgtaaaatagagtgctagagctcttaccccctccc

SEQ ID NO: 3591 - DNA, 807 bp, Homo sapiens
  misc_feature 3, 4, 5, 6, 7, 13, 297, 337, 351, 420, 433, 492, 497, 499,512, 533, 565, 590, 610, 611, 614, 616, 619, 624, 625, 626,627, 631, 632, 633, 635, 636, 637, 639, 640, 644, 646, 647,648, 650, 652, 653, 654, 655, 656, 657, 658, 661, 662: n = A,T,C or G
  misc_feature 663, 664, 665, 667, 670, 671, 672, 673, 675, 677, 678, 679,680, 682, 683, 685, 688, 689, 691, 694, 702, 706, 708, 710,712, 713, 714, 715, 721, 722, 723, 725, 727, 729, 730, 734,735, 737, 740, 741, 743, 744, 746, 747, 749, 750, 751: n = A,T,C or G
  misc_feature 752, 753, 756, 757, 758, 759, 760, 762, 763, 764, 765, 767,769, 770, 771, 772, 774, 777, 780, 781, 782, 787, 788, 790,791, 792, 793, 795, 796, 798, 799, 800, 802, 803, 804, 806: n = A,T,C or G
ggnnnnnggggantttagatcagctcttgttctttttgcaggatcccatcgattggaattcggcacgaggtgtgtgtgtgtgtgtgtgtagaggagagaaagagaccattatcatatgagtgtgttggggctgctgagagggtttcgtttacaagtgaccttgagtgtatttcatctctggaatgcatggtccctgcgctcaagctacacaatctgattagtgaagtattactaatacactagaaaaatatacatagtaattaccaaatgactgacacaattttatagggggttcanagaaacatctgtgaatgggtaataatgaaaaaagaaaagnttttctctttgttntagtctgacccttttaacagtctctattcataatgtgaggaaatcgctacaaaaactgaaatattgtanatactgttcattngcatatggaaatacttgtatgctgtgtgttgttctttcatgggacaaactctacccctnctctntncacacacatatanccaagctataagttagcctanctttcgccataggaagttgctggcttttttantgagaagtcaaagaacctggcttgntaaaagtctttataagaaannaananttnctttnnnnttannntnnncnnatgntnnntnannnnnnnttnnnnntnacnnnnanannnnannanttnncnaancatattantgtnananannnnaatatnnnanantnntttnnanccnngnntnntnnnnnaannnnnannnntnannnnanttntannnaattnncnnnntnntnnngnnncng

SEQ ID NO: 3592 - DNA, 716 bp, Homo sapiens; identical to SEQ ID NO: 3566
  misc_feature 2, 3, 4, 5, 6, 12, 19, 20, 24, 36, 37, 631, 632, 633, 634,635, 637, 638, 639, 640, 641, 642, 643, 644, 645, 646, 647,648, 649, 650, 651, 652, 653, 655, 656, 657, 659, 660, 661,662, 663, 664, 665, 667, 668, 669, 670, 671, 672, 673: n = A,T,C or G
  misc_feature 674, 675, 676, 677, 679, 680, 681, 682, 683, 684, 685, 686,688, 689, 690, 691, 692, 693, 694, 695, 696, 697, 698, 699,700, 701, 702, 703, 704, 705, 706, 707, 708, 709, 710, 711,712, 713, 714, 715: n = A,T,C or G

SEQ ID NO: 3593 - DNA, 718 bp, Homo sapiens
  misc_feature 2, 3, 4, 19, 23, 28, 30, 35, 38, 45, 47, 51, 53, 87, 515,632, 634, 635, 637, 639, 640, 642, 646, 647, 648, 650, 651,652, 654, 656, 657, 659, 660, 661, 664, 666, 668, 669, 671,677, 679, 680, 683, 684, 688, 690, 691, 692, 693, 694: n = A,T,C or G
  misc_feature 697, 698, 699, 700, 702, 703, 709, 713, 714, 715: n = A,T,C or G
tnnnctttttaaacctgcnttcnaattncnagacnctnggctctngntctntntgcaggatcccatcgattcgaattcggcacgagnaagaaaggctgcctttgagttgaccaaccatgttgaggtggtagatgggtgctaaactcactgtagtctgagtaattgacttccacaagtcatccccactgttgagcctttcaaaatgaagtctcagtatatttacaaattaatggacatcctctctggggattagtcatattctaattcaacaaagacattgtttgaagtttgtttttgtttgctaaatgaactaaaaattatgagatttgcacctaaaggtactgaggtaaaggagagccaaaagtggggtagtcaatctacttattcagaatgagtcgataatttaaacatgtctaatagcagagacagtatattatagaaatggcattacattctctgagatctgcttttactgaagtggatcaatgatgaaactagccaaatctgagcatcanaaggctttccggtctacctgatgcatgatctctacagttctgagaagcagaactataaaacaatgtaaaacaataagggcatatgtctggtgtgtgtgtggggggtgtgtgtgtgtntnntnanncncgtnnntnnnancnnannnttncnanntntgattncnnttnntctnannnnnttnnnntnnttcttnaatnnncac

SEQ ID NO: 3594 - DNA, 718 bp, Homo sapiens; identical to SEQ ID NO: 3593
  misc_feature 2, 3, 4, 19, 23, 28, 30, 35, 38, 45, 47, 51, 53, 87, 515,632, 634, 635, 637, 639, 640, 642, 646, 647, 648, 650, 651,652, 654, 656, 657, 659, 660, 661, 664, 666, 668, 669, 671,677, 679, 680, 683, 684, 688, 690, 691, 692, 693, 694: n = A,T,C or G
  misc_feature 697, 698, 699, 700, 702, 703, 709, 713, 714, 715: n = A,T,C or G

SEQ ID NO: 3595 - DNA, 726 bp, Homo sapiens
  misc_feature 3, 4, 5, 6, 11, 15, 20, 21, 22, 94, 676, 726: n = A,T,C or G
tgnnnnttttntaanccggnnntttcaaatcgcttggccctaggctacttgttctttttgcaggatcccatcgattcgaattcggcacgagagnaataactaccagacaacatttgttaaaactcaggacagtatgtattttaaaggagcaagtgcatgtgtgaaaatggctcattcagtttataaaatattacattaaatttgaggtttctgttttttttcttttgtgacagtcttgctctgttccccatgctgtagtgcagtggcaccagttcacctcactgtaacttccacatcctggtttcaagcaatttgtgcctcagcctcccaagtagctgggattacagtcatgccaccatgtccagataatttttatatttttttgtagagatggtgttttaccatgtttgccaggctgatctcaagctcctggcctcaagtgatttgccaccttggcctcacacgttgctgagattacaggcatgagccaccacacctggccaatggggcgtttcttaaaatagctactagactatgacgtttatcctaaggtttgaagtctatcatcttccttacatatccttcattgtggtatctgggaatgaatcaacaagatgagagagccttcttcattcagtgtggctccttcatttccatgcttcctgaagattaaggncactgaatttaaaattcaatattctgtgagttacacaccatggagtaacn

SEQ ID NO: 3596 - DNA, 710 bp, Homo sapiens
  misc_feature 2, 4, 5, 13, 17, 22, 26, 707: n = A,T,C or G
cntnnctttgaanttgnaaatngctnggctacttgttctttttgcaggatcccatcgattcgaattcggcacgaggtcactctgtcacccaggctggagtgcagtggtgtgatcatagctcactgcagcctctacctcctgacacaagctgtcatcccgctttggcttctcaaagtgctaggattataggcgtgagccaccatgcccgaccagtttctgcttttattaaaattgttcacagttttatacattcatgttcattaaaaatgctatttagaaaagagtttgataaaataaatattatacaaaattcgaagaaaaaagaaaagagtttctgtttcagtcacaaattagggttattgtgatgtgtatttatgatgaccattgaacaaatgtgaagaatactgtgaattctatgactttatcaaaatcagccacatccaggagcttgcagttgttgaccaaatgaatgatgacatagagtagttcagatctatcatgtgctcttctatctaatcagtcaatatttccttggccctcaagccaacattcattttttatgtataaccttcttcatgattttgaaattttgatagggtaactgctaatgagttcacaaatgtagcactttaaaaggaaaataaatggagagtgaaaacaacttggctacgtataattgtggggttttaattttctggttttaaaanaaa

SEQ ID NO: 3597 - DNA, 710 bp, Homo sapiens; identical to SEQ ID NO: 523
  misc_feature 2, 3, 4, 15, 17: n = A,T,C or G

SEQ ID NO: 3598 - DNA, 727 bp, Homo sapiens
  misc_feature 3, 4, 5, 6, 15, 19, 20, 21, 25, 31, 36, 49, 533, 611, 623: n = A,T,C or G
gtnnnnttttctaanttgnnncttnaaattnctaancgcttgttctttntgcaggatcccatcgattcgaattcggcacgagcttactttgatcctcgtgaggcatacccagatggaagtagcaaagaaaagagaagagcagcaattgcccaggccttagctggcgaagtcagtgtggtgcctccatctcgtctcatggcattgctgggacaggcactgaagtggcagcagcatcagggattgcttcctcctggtatgaccatagatttgtttcgaggcaaggcagctgtcaaagatgtggaagaagaaaagtttcctacacaactgagcaggcatattaagtttggtcagaaatcacatgtggagtgtgctcgattttctccagatggtcagtatttggtcactgggtctgttgatggattcattgaagtatggaactttactactggaaaaatcagaaaggatcttaagtaccaggcccaagataactttatgatgatggatgatgctgtcctctgcatgtgtttcagcanagatacagaaatgttagcaactggggcccaagatggaaaaatcaaggtgtggaagattcagagtggacaatgtttaangagatttgaganggcacacagtaagggtgtcacctgtctaaacttttctaaggatagcagtcagatccttaatgcttcttttgaccagacaattagaattcatgggttaaaatctg

SEQ ID NO: 3599 - DNA, 708 bp, Homo sapiens
  misc_feature 13: n = A,T,C or G
cttcaaatcgctnggctacttgttctttttgcaggatcccatcgattcgaattcggcacgagggcagaccatccacatcagtttcagagaaaaacaataatcttgtttgtgccgtgatgaagaggactgacagctaacagcagaaacaatagtcaggaggttgagaacaggctggttaacatggtgaaatgccatctctattaaaaatacaaaaattagctaggtatggtcgcagacacctgtaatcccagctccttgggaggctgaggtgggagaatcgcttgaacccaggaggtggaagttgcagtgaaccgatagtgccattgcactccagcctgggcaacaagagtgaaactttctctcaaaaaaaaaaaaaaaagatgtcaagccccttctcttcctttctccaccatcatggtgtgtacttgactctgcttctcaccagatcttctcataagactatcaggattaagcaattcctggccaagaaaaaaagcaaaattgttccattccccagtggattcagatgaaaactggtaataaaatcaggtacaactttaaaaggagacattggagaagaaccaatccgtgtctataaggaattgtcatgagatggcacacatttttatgctgtctgagcattcaatcacgttaccatatcaagcagaaaatgtcaccattatctggagagttggacatgttttattg

SEQ ID NO: 3600 - DNA, 730 bp, Homo sapiens; identical to SEQ ID NO: 524
  misc_feature 3, 4, 5, 6, 7, 13, 15, 24, 389, 662, 664, 666, 667, 668,671, 672, 673, 676, 677, 678, 680, 688, 690, 694, 695: n = A,T,C or G

SEQ ID NO: 3601 - DNA, 710 bp, Homo sapiens
  misc_feature 2, 6, 548, 580, 697, 709: n = A,T,C or G
tntatntacagctacttgttctttttgcaggatcccatcgattcgaattcggcacgagaccaagagaacgcggtcagaaggaggtggaactggggagtcctctcagggagggacaagcaaaagactcaaagtagatggacagaaaaactgctgtgaggaggggaaagaggagcagcagggatgtgcaggggacggtggggaagacagggtagaagagatggttatagaggttggagagatggtgcaggactgggccatgcagagccctgggcagccaggggacctgcccctgaccactggaaagcatggagcccctggagaagaggggcagcccagccacgcagccctggcagagcgggggcccaagggacatgaggcagcccaagaatggtctcagggtgaggcagggaagggggcatccctgccctcctcagcgagctggcgctgtgccttgtggcaccgagtgtggcaagggcggcggcgagcccgtagacgcttgcagcagcaaaccaaggagggagctggaggtggcgctggcacaagagcanggtggctggcgactgaagctcaggtcacccangagctgaaaggactgaatggtggccaaagaaaggcccagaaactgagcccctgctgaacttttgtggccgtcttgtcttcccggctgacccgaatgcttactgtgaccccgcttcangatccccaaggnc

SEQ ID NO: 3602 - DNA, 716 bp, Homo sapiens
  misc_feature 2, 3, 4, 5, 6, 14, 16, 17: n = A,T,C or G
tnnnnnttcaaatngnnagctcttgttctttttgcaggatcccatcgattcgaattcggcacgagccagagctggcagaagaaaacagtaaagcttagagtagaaataaatgaaataaagaacagaaaaatatagaaaatcaaaaataccaaaagttggctctttgaaaagatcaacaaaattgccaacccttttaagtagacaagaaagaatgaattgttggtggtgcagtggtgagcatagctgcttttcaagaacaaaaaagactcaaatgactaaaatcaagaatgatcaagaatgagagagtagacattactacagatcttacagaaatgaaaggattattaatgagtactgtgaacagttgcatgccaacaaatagtctaagtgaactagacaaatatctagaaagacacaaaacaaccaaaaccgaatcaagaaaaaaatataaaatctgaatacacgtataacaagtaaagagattaaattggtaccacaaagaaaaactgtcaccaaggtaaagtccagacccagatggcttttttggtgaattccaccaaatgtttaagggagaattaacaccaaatctaaaactaaaccagacagagacattgcaagaaaaccacagaccaatatcccttatgaatatagatataaaatcctcaacaaagtactagcaaatcaagtccatgaacatatacaattctattttactt

SEQ ID NO: 3603 - DNA, 715 bp, Homo sapiens
  misc_feature 3, 4, 5, 6, 29, 33, 35, 627, 633, 714: n = A,T,C or G
gtnnnncttcaaatcgcttggctactcgntctntntgcaggatcccatcgattcgaattcggcacgaggggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatatttcttctatttcatatatttctatgacattatatcttagatgtgtaatttatgaactactactggattattttaatccattagaaattactattcacgcattctgtattcaattcatgtgatagctaatatatttggttttaaatgcatcttattttgtggttttcttctaggctgttttttgtgctttcttttaaaaatatataggttttaataatcttaattttcttttagtttgaaatgtatatactcattttattcattagtctaagataaagaattgtaacacttctctaacctattatanaattgntaatacctttacccttctcttgaacacatcaaaaggatgtcattgagtgttggtattggagtatagcatatctattattcng

SEQ ID NO: 3604 - DNA, 706 bp, Homo sapiens; identical to SEQ ID NO: 3582
  misc_feature 573: n = A,T,C or G

SEQ ID NO: 3605 - DNA, 726 bp, Homo sapiens
  misc_feature 2, 3, 4, 5, 6, 11, 17, 18, 20, 21, 24, 25, 39, 41: n = A,T,C or G
tnnnnnttttntaatcnngnnttnnctttgcaaatcganangctacttgttctttttgcaggatcccatcgattcgaattcggcacgagatggtgttttcacctggaagctgagaagaaaggggctttaatggaacaaatagcacatcaagctgttgtaatgcagtttattatggaaatggccaaaaactgtaatgtggatccaagagggtgttttcgtttatttttccagaaagccaaagcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacagaatccagattatcttcagtattctatcagtacagctctctgcagcttaaactcggtggtacataaagaagatgatgaacccaaaatgatggacactgtataatttggttaagactgctgaggccaagtgctattttgttacaagaaaggaagaacttggctattttcttgacacttttatgggtgctgcactttatttttgtttggtttttgatgggagggaaagagtactgaaatgttttgtaaattttttttaatgtgctgctaggttttttgttttgtttggtctgaagagaagagtggtccatatgttgcaggaagt

SEQ ID NO: 3606 - DNA, 710 bp, Homo sapiens; identical to SEQ ID NO: 3596
  misc_feature 2, 4, 5, 13, 17, 22, 26, 707: n = A,T,C or G

SEQ ID NO: 3607 - DNA, 740 bp, Homo sapiens
  misc_feature 2, 7, 8, 13, 14, 15, 19, 23, 28, 411, 547, 549, 554, 561,564, 569, 571, 584, 625, 657, 670, 690, 691, 707, 716, 724,725, 736: n = A,T,C or G
gnaaatnngctcnnntgcngctncttgntctttttgcaggatcccatcgattcgttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcanagtgcaattgtgatgaaagtcagtgggaaccagtctgtgggaacaatggaataacttacctgtcaccttgtctagcaggatgcaaatcctcaagtggtattaaaaagcatacagtgtcttataactgaagttgtgngnaagtnactgggnctncagancngaaaattactcancgcacttggggtgaatgcccaagagataatacttgtccaanggaaatttttcatctatgttggcagttcaggncttaaaactcttnggtcctctggacaaggaggnnccacattaatttggtnactgtgaanatggttcnncctgaattggnaagg

SEQ ID NO: 3608 - DNA, 734 bp, Homo sapiens
  misc_feature 2, 3, 7, 15, 21, 24, 25, 26, 29, 30, 32, 34, 38, 46, 94,139, 147, 159, 169, 174, 189, 193, 203, 216, 234, 251, 252,258, 259, 260, 275, 284, 289, 339, 340, 341, 343, 345, 346,347, 364, 371, 379, 380, 399, 400, 402, 405, 415, 426: n = A,T,C or G
  misc_feature 432, 435, 436, 438, 440, 445, 449, 452, 459, 460, 461, 465,467, 469, 471, 481, 482, 488, 492, 499, 534, 548, 553, 554,567, 571, 573, 578, 598, 605, 606, 608, 628, 630, 642, 644,653, 665, 681, 700, 712, 713, 722: n = A,T,C or G
anngttnatgaagcnctttgnaannnccnncnangagncctcgatncgcaatgaactactctgcagcctcattttttaaaaaatgagataggtnagtgtggatataaataactgtccaacatatatagctgagtaacanaaatagcnaactagaaaacnatgtattatnccatntgtgctgaaatatgnatgntggtatgtgnaaatatgtatggntgtatagacagatctttnctaaaattttttcattnntaattnnngtgggtacatactangtatatatntttgnggggtcctgaggtattttgatacaggcatgcaatgtgaaataatcacatnnncntnnntggggtatccatccccncaagcanttgatctnntgtgtgcaaacattccaanngnatncctttagttntccataaatgngcaatnaanntngnctatngtcnctntggagannnatcngnantnatctcaatcnncccatntgtnacttganccattgaccattcccaccaatcctgaatgcctcantacccttctcaccnatggnnctcttgcttatangctntntgtcnatgagttcaatcgtagtgantttaganncnggacttccatgcgaacatgntnaaggccggcctntntggcctggncttacttaaatnaaccataatattgccnatgacaggaacggatactntgctaacggccnnatagttccncatttgggaccc

SEQ ID NO: 3609 - DNA, 728 bp, Homo sapiens
  misc_feature 3, 4, 5, 6, 7, 9, 11, 12, 14, 494, 495, 498, 503, 506, 508,592, 611, 614, 623, 665, 679, 691, 708, 712, 725: n = A,T,C or G
ggnnnnntntnnanatacagctacttgttctttttgcaggatcccatcgattcgaattcggcacgagtagggtcttagtactggtttgggcataattatactcagtgtttgggcctctgctaaaattctaagacgataagaatatcagtttaagttctgttacagttgttttcatgaagcttgtaagattgatatttaagtggacaaagtgggaagtagtcagttttcagggctccaggggtcatcactttgtgctcagagtacagctgtcaactagtgatttggtgcatttagacaaggaacaggagcaaagggcctatttcaagagggtcatagacactgccttgtgataagtgaatggctagagggtttcttggtaaactgaagtccttttcacatttttagctttttctgtggcaacctgtcttttacagaagctactcatgaactctggcttttcattttcagggttgggctggacattctttgatttnntgntttgnttngntttctgagacagagtctctctccatcacccagctggagtgcactggcgtgatctcgctcactgcaatctctgtctctcgggtcnggtgatctcctgcctcagnctnccgagtagntgggactgcagtttcatgctacacgcccaggtaaatttttgngattttgatagaanacagggttttgncatgttggccgggctgnctcnaactcctgacctnaat

SEQ ID NO: 3610 - DNA, 712 bp, Homo sapiens
  misc_feature 3, 526, 545, 581, 674, 682, 690: n = A,T,C or G
cangctacttgttctttttgcaggatcccatcgattcgaattcggcacgagcatttcttgtctttattaatttgacttctctagggacctcatttaaatgaaatcatacagaatttgaacttttgtatctggataaaaaatatatacagcattttgctgactgtaaaatgtatttttttgggccgggtacggtggctcatgcctgtaatcccagcactttggtaggctgaggcaggtggatcacctgaggtcgggagtttgagaccagcctgaccaacatggagaaaccccgtctctactaaaaataaaaaattagccaggcgtggtggcacatgcctgtaatcccagatactcaggaggctgaggcaggagaatcgcttgaacctgggaggcggaggttgcggtgagccgagatcgcgccattgcactccaagccttcaattcctatctgtgagtaggtcctcaaggcttcctctgctcccagtcggacaacccatcggctgggacagtactgattctccagctnctctgcagacatcttcttncaaggaaccttgcttgggaaacccacaccaggcctntagaactatagtgagtcgtattacgtagatccagacatgataagatacattgatgagtttggacaaaccacactagaatgcagtgaaaaaaancttattgngaaattgngaagctatgctttatttgaacc

SEQ ID NO: 3611 - DNA, 751 bp, Homo sapiens
  misc_feature 3, 4, 10, 14, 389, 410, 415, 427, 437, 443, 445, 446, 450,466, 498, 511, 516, 530, 615, 616, 623, 632, 653, 659, 671,678, 692, 698, 702, 707, 717, 722, 723, 728, 730, 736, 737: n = A,T,C or G
ggnntttgcnaatnctaggctacttgttctttttgcaggatcccatcgattcgaattcggcacgagcagctactcgggaggctgagggcacaagaattgcttgaacccgggaggcagaggttgcagtgagccgagattgtgccaccgcactccagcctgaatgacagagcgagactccacctaaaaaaagtaaaagaaaaaaaagaggaagaattagcacatttctattacagaattggacttgaacatgcaaaatcatgtctggatttctcagtgaaaagctgttttacgttagtggactcttctaacattttgaaatggtgatctggatttgggatctggctatcactgacccaccttgggtctgtgaatgaccaactcacctaggngggagtcagttacccctgccntacantggcccatggancacctgcggnaagaangnntttntgcttactgattcttncatctatggtgtccaattgggaaggatcctgngccattgactganctctntgagggttgttatnaagcttgtggatccattctcatgactactgggaaatttctgtgaatttgaccctgcccctgaactccaaggcagcttttcccctnnaaaggtnaaatccaanccctattataactgggggganttgttngacaaaattttngggctantttaccgaccaaanttttcnctgncctanaaatgttcgnacccnncccgnantttggnnggcttcaccccctc

SEQ ID NO: 3612 - DNA, 800 bp, Homo sapiens
  misc_feature 5, 6, 11, 29, 34, 57, 59, 62, 66, 69, 74, 76, 80, 86, 88,102, 113, 116, 117, 126, 145, 146, 152, 153, 155, 159, 161,162, 167, 170, 171, 175, 183, 191, 192, 200, 201, 203, 207,218, 220, 223, 229, 233, 249, 251, 253, 261, 262, 263: n = A,T,C or G
  misc_feature 267, 282, 285, 287, 291, 297, 303, 305, 307, 310, 311, 312,315, 321, 322, 326, 333, 335, 338, 340, 341, 343, 346, 347,356, 359, 365, 367, 370, 372, 373, 381, 384, 386, 389, 393,403, 404, 420, 422, 428, 434, 435, 446, 450, 453, 461: n = A,T,C or G
  misc_feature 484, 487, 492, 497, 498, 499, 502, 504, 505, 509, 512, 518,519, 525, 527, 530, 531, 534, 538, 540, 544, 549, 557, 563,564, 570, 571, 575, 580, 581, 589, 593, 599, 600, 602, 608,609, 613, 614, 617, 626, 637, 640, 641, 644, 653, 671: n = A,T,C or G
  misc_feature 672, 680, 683, 696, 697, 698, 699, 700, 701, 706, 718, 720,730, 732, 734, 737, 740, 741, 745, 746, 750, 751, 758, 759,766, 767, 770, 778, 779, 780, 782, 783, 784, 788, 790, 796,797, 800: n = A,T,C or G
gtaanntttcnaatgcttggctactcganctctntgcaggcatcccatcgattcgtncntcntgtntangtcgncncagnccttantngggatacttaaatntactatttttnccnngtactctcnaggatttggatatgacttnncagatnnanatgngnnaactnatnngagnataatccntgaacagnntttgttcnncncatncttggagaggncntgntatatncagntcatgcaacactatcnantnagggtatnnnccgncatccatagtgaatnatngntaanccactngagggntncntannnatntctgtnnagcncagaccncnatnannangannaagagcacntgncatatngnagngnnagttactncancntcntgangtggaatacnnatgacatcaatcgagntnaccatnacgcanntgtactgaganttgngancctctttntaccaggcatatgtcaatggtcnaanagagnccatnnnacntnnaccnttntggctnnatgttngntcnnccnttgnangctntcctntgcatgantggganntcaaannttcnggacnncaatttangggncttaanntnaaaggnnccannctngggctctcnataataaccantannggnaaaatctgnaacccttgctctacctanncctagggngancctgggatttgtnnnnnnaaaantcccaacccttnantacttgagangntnccncgnntttnnaagnnactttgnngatagcnnccnaaatgttnnncnnntcangnaatccnntgn

SEQ ID NO: 3613 - DNA, 718 bp, Homo sapiens
  misc_feature 531, 541, 590, 654, 661, 672, 689, 690, 715: n = A,T,C or G
gctcttgttctttttgcaggatccctcgattcgaattcggcacgaggatcagtgaaaaacattagtatacgtttttaaataggctaatttttcaacttggatcattaggcttacgtactacttgtttcaaatgtgtcaaatacaaaaatggtaactaggttgacagatactttgtatttttcttttgaattcagacctggaatgtaagtaagtgacaatgcttatggaaagccagttagttagaattggaaatctgtcttgtcattttacaagcattagattcctttcctgtgtgaagaaagcctcagtgaaacaggtctttgccataactttatgaagtgctacagaaagcacaaagaattgattcatgttcatcaatacctgctgagagtactgtcccaggaatatccagtggatggattcatcatccaggaggttcaaaagtaagatggttttcaaatcatttttgagactggtgcataacagcagggtacctgaaaagagccttctgggagttagtgaactaggtanatggttttgntcacatacgccccatcaacttaaaagtgaatggctttggtataaatgangtcactatggacttaccctaaagatcttctgtacttctggcttccataggacaaatgataagtnctacttnctcatctcttngggttattaattggaanncttgcattcatgggtattgaaattnaaa

SEQ ID NO: 3614 - DNA, 730 bp, Homo sapiens
  misc_feature 12, 19, 262, 302, 360, 375, 439, 507, 508, 515, 524, 527,537, 669, 682, 695, 696: n = A,T,C or G
gcaatagttgcnaatagcnaggctacttgttctttttgcaggatcccatcgattcgaattcggcacgagctttttctcactgaaatatttaagcactgcattttaagaaaacttcctattcattcgtagacttttatctggccagatttccactctgagggcttttctttctagttatctgacaaaccataaattttatttcctttaagggcaaaaccaacctccaagcacatttatggcccatgttttaagagctggccgncctttctatcctgtatctctggttaaacgtgttttctttntcttggagcaaatttttcaaagaggggctaaagctatgtgttcctctggagagaactnctgcctacccagcangaaagaaaatgccagagaagcctccgacctgggttctgcccctggtagccaggtctcaggctanaagccttctttttggttgcattggagtccttctctacctcacctttattgcacttccttcttggttcnnatgtatnctcctctgnctnctttaaagantggcaactttttggactttggacaattcctgtgtagcaatctgggctgattttagagaggccttctgttcctgcttccaatgagctgattgggtgatcagctgattttattacctttccctggaggaagtanagtcccaggatgntggggaaggcccnntggggacccctgaagccctttatgttgacccctt

SEQ ID NO: 3615 - DNA, 755 bp, Homo sapiens
  misc_feature 2, 3, 6, 8, 10, 15, 17, 18, 19, 20, 21, 22, 23, 183, 187,208, 214, 235, 253, 259, 273, 312, 336, 339, 344, 351, 354,391, 436, 469, 474, 475, 500, 531, 547, 549, 552, 574, 580,582, 603, 621, 630, 632, 634, 636, 646, 648, 653, 665: n = A,T,C or G
  misc_feature 675, 679, 680, 718, 723, 728, 739, 740, 750, 751: n = A,T,C or G
gnnttnananagctngnnnnnnnctacttgttctttttgcaggatcccatcgattcgaattcggcacgagcagactcgcattatggacaagtcccttctccccacacaaaggaagacatacaccgcatagtccatttcatttcagctcctgatggcatctgaccgccgtggacacttcccagnggtntggcttttggagggagagtanagcggnggatgatctgtgccagttggncactccttggatattggngttatntccactggtcttgntgctcctctgtgttgattttcattaactcatttcacctnaatgaattctggagcctggctganatngtgcntactctntgncagaggatcatcatgaacaaccccttatgtagcaagnttcccaggttttttcagaagtggtgaatccatgccttggcattcntggattattccatgtcatgtcagatcattcatnaaatnnatattgacacatgtcatgtgatgcnttctatgctgacaccatcaggaattcaaaanggtgaccacacgttgntntgntcctgaggacttccagggttanaaaaananataaaaaaaacttgagggctntaaaactatatgagtccnatttacgtngnancngacatgaatncngaatncattgaatgaantttggccaancccnnaactatgaattgccgttgacaaaaaggcctttttttgngaaantttgngctgcttttgnntttaatttgnnaacc

SEQ ID NO: 3616 - DNA, 632 bp, Homo sapiens
  misc_feature 16, 21, 23, 29, 31, 78, 79, 91, 114, 121, 146, 150, 151,152, 155, 164, 165, 166, 168, 177, 178, 194, 200, 206, 207,218, 219, 224, 232, 233, 244, 250, 256, 260, 261, 264, 266,270, 273, 286, 292, 298, 303, 304, 314, 320, 322, 328: n = A,T,C or G
  misc_feature 340, 342, 351, 353, 357, 361, 365, 367, 370, 372, 378, 381,382, 394, 399, 401, 404, 407, 408, 410, 416, 419, 420, 422,427, 437, 442, 451, 452, 454, 456, 468, 474, 477, 495, 500,501, 509, 525, 532, 535, 536, 538, 556, 560, 566, 569: n = A,T,C or G
  misc_feature 573, 578, 593, 600, 601, 623: n = A,T,C or G
gttgagctgctcttgntcttncnctggtncnatctgcaggatcccatcgattcgaattcggcacgagcccttctgagnntgtccattcatnggtggttctgcccctactccccnagccctnaataccccatctgctgttcctaccnatcnnncanccaccggannntncattcagcnntttgtctgacccctgnagcccngagggnnggagcagtgcnntacanctcctttnncaattgctggncagacngctatntgtnnctnanattnaanactttctgtctanttcganctgacnttcannactaacgctncaatcngngattcnttctttaatccntnaggtatctntnattnctgngctnangangngccttnaanngctgagcttacntgccngngantgnngntattgngannanggatnctgacattgncttgntcacagtcnntntnagcgtgcactgngatganaancttgaccctgaccattanttgcnnaccgattnattgcctgatgtacanatcttgntgnnangaccactgatctagatgntctnatctanatnatcnactgntgacattgtctaaancatcacnnatcaaagttttagatgcagtgnttgagaatc

SEQ ID NO: 3617 - DNA, 744 bp, Homo sapiens
  misc_feature 12, 15, 16, 17, 544, 551, 565, 580, 621, 683, 689, 711, 721,728, 741, 743: n = A,T,C or G
gtctatgctggntannnatacaggctacttgttctttttgcaggatcccatcgattcgaattcggcacgaggaccaaggagatgtgagtgaaaatgatgcaggctgcttccaggtgtgaccagtaagatacttcccacataatcttcctactctttcttccctgtttggcatcccatgtgctaagaatgggaaccctgaggtcctatatgtggaaccataaggtaaatgtctttgggctctgaatctcacacagggctcactgagaataagaaacatccttcttgggctttgtatgaataagaaaatactagcaaatttttaagaaggaagtaattccagtatttcacaaacccttccaaagaatagtaaaaacaaagagctttcctttcctcgttatctaaaattagcctaactttgatagcaaaaccagctaggagagttgcaaagataataatcagaagccagtctcactgaacataaatgtgaaagtcttcagcaaaatattagtctacttcgtgttcacatctttcttatgggagactnttttgtntggttggttttganatggagtttcgctcntggttgcccaggctggagtgcaatggccgtgactttggctnaacccgacctacgcctgggagacatttttattttcagaatggacccattttctctactggtntgggcncaaaactagactctggattaancctcccctgngggttangaagtgggccatntna

SEQ ID NO: 3618 - DNA, 760 bp, Homo sapiens
  misc_feature 7, 15, 31, 32, 34, 40, 83, 98, 209, 212, 266, 329, 339, 345,376, 377, 418, 443, 444, 447, 472, 492, 497, 500, 505, 507,509, 510, 537, 539, 563, 573, 574, 579, 591, 596, 611, 624,636, 641, 655, 661, 663, 666, 694, 703, 705, 710: n = A,T,C or G
  misc_feature 717, 732, 737, 738, 741, 748, 750, 760: n = A,T,C or G
gtctatnctttgaanctctttgctacttgcnngntctgtntgcaggatcccatcgattcgaattcggcacgaggatctctttngaggtgatggtgctntccgagctgtttctggagatgctccagagggattttggctatagagtttataagatgctactgagccttcctgaaaaggtcgtgtccccacctgaacctgagaaggaggangcngccaaggaagaagccaccaaggaggaagaagccatcaaagaggacgtggtcaangagcccaaggatgaggcacacaatgagggcccggctacagagtcagaggccccgctgaaggangatgggcttntgcccnaaccactctcttctgggggagaggaagaatnnaaaaccccggggcgaggcttcttgaggacctgtgtgagatngccctggacccagaactggtgcttnnganggatgatggataggaggaagtttgnaggagcaaagctggatgatnctgangtncggtncngnncctaaaccagtcacagatggagttctntncacttcaagacatgcccaaggacntggatccctnntgctntgcttcccttanactgnctggttccttttagnggttcttttgatnccaactgatgtngcttncttgcaccggccangacttngnganggaaccttcttacccttgggatcccggnttaaatggnanaccanggccaanccaaatggtttaccnagggnnggngaacccnanaaaaattttn

SEQ ID NO: 3619 - DNA, 737 bp, Homo sapiens
  misc_feature 4, 5, 6, 7, 8, 9, 10, 11, 13, 15, 22, 650, 657, 658, 665,668, 697, 715: n = A,T,C or G
gggnnnnnnnnananatacagntgttctttttgcaggatccctcgattcgctggaattagattgtgtagggcccgacattggatttattttaagtacaataggaagccactggaatgtgataaccagaggcttgatgtaatctagtctaatctattaaaggattgctgtctagtttgtgataaatggagccttgaccttggtgtcaagaaattgtccttgataccagcaaggccaatttggaggttattgccattctgagatgagaagcagtaatgacttggtgtttatttgagatagaaagcaagtaaaatagaaacattttctggtagtagaggcaagaaaacttggtgttaatattatcaaagcagataataagaaattgttactgggttgtagtaattatctcactgatatttaaacccttgggtttattggactgggtggccgatgtttgggtaagaaggaaatgagaagtgtttttaatatgggagataccttagcatatttataaacaaaaactgataaacaaggacaaaacttccacttatggtcacggtgaagtaactgatactggcccgtgttttctctccattaacaactagaaatctggttgcatacccaaagaagctggctctgatccacactaatnaaattgnnaaaaatncangctttaatgatctaggatcccaaaagtantgtggtcaaagccaaatncaaaagtcttttaaggaagacc

SEQ ID NO: 3620 - DNA, 769 bp, Homo sapiens
  misc_feature 5, 6, 7, 16, 18, 19, 242, 314, 357, 441, 478, 526, 536, 556,557, 561, 597, 600, 601, 602, 618, 663, 674, 677, 700, 715,729, 730, 732, 733: n = A,T,C or G
ggggnnnttgcaaatncnnggctgttcttttgcaggatcccatcgattcgccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctnccccacttgatgtttgtgttttgtttggggggatatttttcataattatttaaaagacaggccgggcgcggnggctcacgtctgtaatcccagcactttgggaggctgaggcggncggatcacctgaggttgggagttcaagaccagcctggccaacatggggaaaccccgtctctactaaaaatacaaaaaattagcncgggtgtggtggacgtgcctataatcccagctactcnggaggctgaggcaggagaatcgcttgaacccggtaggtgggggttgcngtgagccaanatcgcaccattgcacttcannctgngcaacaaagaaccgaaactctgtcttaaaataaatnaannnattaaaagacagaaangcaagggggtgcctaaaattctaaaactttgggggtccaacaccngggcaaccggnggnttgcaaacccaaacaaccttggnaaggcttccattttntttcccaaagcccnnanncagaaggggtcattgccgggccccaaaaggaaaaaa

SEQ ID NO: 3621 - DNA, 769 bp, Homo sapiens; identical to SEQ ID NO: 3620
  misc_feature 5, 6, 7, 16, 18, 19, 242, 314, 357, 441, 478, 526, 536, 556,557, 561, 597, 600, 601, 602, 618, 663, 674, 677, 700, 715,729, 730, 732, 733: n = A,T,C or G

SEQ ID NO: 3622 - DNA, 735 bp, Homo sapiens
  misc_feature 17, 209, 536, 537, 616, 644, 659, 720, 732: n = A,T,C or G
gctatgtggaaatcgcnaggctacttgttctttttgcaggatcccatcgattcgaattcggcacgagaggaagctggttgagaagaagaaggaaaaagtcgattctactgactgacgtttccccctgctgttaagaatcccaaccacacactttcacacactattccaggttctggctactgaatgatcccacagctgaggtctattgncatcgctccacttctatttttagcagcactaaaaacattcccaaaaaaaatgttttttagctttttaactgtagattcaccactaagaaattggcattggaacagtccacagagcttattcaaatttcacccattttacatgcactcatttgtgttgcatgtgatatatagttctatttcattttatcacctgtgtagatggatgaaaacagcaacataagcaagatacagagctgttccgtcatcacagagctctgccatactatccttttatagccatctctacctctgtcccccatttctaacccctggaaaccactaatctgnncttcataattttcttatttcaagaatcttacgtaaatagggatcacgaagtataacctttgagaatggccttttcactncattcccttgagatacatccaggtagtngcatgtatcaatagntaattcctttttattgctacacagtctccatagtatgaatatactatgtacatagcatatntatttataggtnacc

SEQ ID NO: 3623 - DNA, 759 bp, Homo sapiens
  misc_feature 8, 9, 18, 20, 27, 31, 33, 36, 476, 537, 554, 593, 596, 619,621, 622, 628, 631, 638, 697, 701, 704, 711, 722, 726, 736,746, 747, 758: n = A,T,C or G
tgcgtcgnngagcgtgcnantcgcatngccnanaanaatggcggggcgcatccctgacagttggataataggttccaggaagttcagtggaaaattttttcaaagcaacatttatagctgattgaacttgaaaagccattttggtgttgaatggcaaatatgtggacttcagcattcctggagcctgatgcatcccgctggatggccctgttcctgtgtacatgatggcctggggactcagcagtgtgcagggtactctcctttagagggtgctttgaggaaagaagtttgctgccacttacagaagtccccttcccatacagtgatataacacaagtaccccatgtccagggagcatctttcctctgatggcttgaggacttatttattaaaaggacaggaatgtctggcaagaaacagaggagctcttaagtactgtaaatactcctagtcactctgcatcagggctgcaagtntaagcagattgctgtggtgtatacacatgattttagcatgataacacttctgtttaaatgnccttagttggtccgggngccaccactggcgtgagccttaagaaaggctaacgccgntgngaagaaagggctttataggccgngnntggagnggntaaattntctttagaacttaaaagaagaacttgcaggggatggggaaggggaaaaatgaacccatnggtncanggaaatntaggtgaacangagnaattgaaccnatttgcaagnnttaaagaaaang

SEQ ID NO: 3624 - DNA, 678 bp, Homo sapiens
  misc_feature 1, 4, 5, 7, 8, 10, 65, 68, 79, 84, 90, 96, 101, 103, 107,108, 112, 116, 121, 122, 132, 143, 145, 146, 150, 164, 167,170, 186, 191, 193, 199, 242, 250, 257, 269, 271, 273, 275,280, 287, 292, 315, 324, 327, 345, 356, 364, 370, 378: n = A,T,C or G
  misc_feature 384, 388, 392, 393, 399, 401, 404, 406, 407, 408, 423, 427,429, 439, 447, 455, 456, 457, 462, 463, 466, 472, 475, 544,546, 553, 565, 569, 584, 613, 630, 635, 641, 647, 648, 667,669: n = A,T,C or G
nttnnanncncagctacttgttctttttgcaggatcccatcgattcgaattcggcacgagcgttnacngactacgtgtngagcnctgtgncagacnctgantncacnntggngaanatganngtctaggggnctcagcccgtntnnttcntaatccagtgaganacnaanacatgtacacaggctncgatnanttgtgncaattgggaaatgtgccatgctactaggggatggatgagatcncagcttantcttggnaagaatgagtgngncntngcaantaagggnggaanagaatattatcaagagaggtgangaaagttgncgngacctcaagtgtacaganatgagaatacnttgctgtntaaatnactgcttnacctcnatangggnngaggtncngtntnnntgagctaatcgtatntcangngatgttatcnggaagaanaaaggctnnnaaacnntcncttttnagncacgtatgtgcacttaactgcaaatggtactgggggagccatatatggacttatctgaaaatgacctancncaattgnctttagaaaaancccngctgccttgtaactngtaatggcaactgaggtggtagacatatngatttgcactatgagtngaatncttatntctgtnngagtgcattccttcgtggntnggactgaac

SEQ ID NO: 3625 - DNA, 682 bp, Homo sapiens
  misc_feature 39, 91, 339, 340, 357, 370, 390, 395, 406, 408, 411, 457,515, 554, 566, 569, 578, 602, 603, 604, 612, 617, 620, 640,647, 656, 657, 660, 665, 669, 675, 682: n = A,T,C or G
ggcacgagattttttttgttcgaatgagccttaatcttntactagtgattttttgtttgaaggagccttgatcttggccaccgaaaaggtnaaaccagtggcaagcttgaatgcttgttttatggtagacttagatacgagaacgggtaaagggtactggataaacttgggatataagattgcttcttttatgcataccactcataccactggtgggaaatttcatttggaattactccctagggccatggagtcttcctgcatatgctaataatgtaagttcccattacctttggtaataagaaaatatctttaaaacaagttagcttttcctattgnntatatatggaaggacangctgttttccctnctgtgcatttagcattttgngtatnctctcattgcncnaantatgcttataacattgtgaaaccccgtctctactaaaaatacaaanattagccaggcatggtggagccgtgcctggaatccctgctgcttaagaagctgaggcncaagaattgcttgacctgggatgcaaaagttgcagtgancctacatcacancantgccttcanccttggggacaaaactgtttctcnnnaaaaaaantaaanaantttgagcctttaaaactatngtggagncgtattacnntanatccngacntggatnagaatcn

SEQ ID NO: 3626 - DNA, 784 bp, Homo sapiens
  misc_feature 3, 7, 9, 12, 14, 15, 16, 35, 36, 40, 42, 43, 47, 50, 68,72, 74, 122, 229, 408, 528, 550, 574, 594, 615, 625, 655,676, 703, 709, 713, 738, 745, 753, 755, 756, 771: n = A,T,C or G
cgntgantntcnannngcgggcctcgctctttcannaagncnngcgnggngaattcggcacgaggagntcgnanctcctggtggcgcttttttgagctgcagtgctacaagagtggcctgantccaccaagagaaggcccaggaggaagaagagaaaaagatgctgtggttactagtgccaaaaatgctggcaggaacaaggaggagaagacaatcataaaaaagctgntcttttttcgatcggggaaacagacctagatccaaggccacaagtaaggctatggctctgattctagaagacaaccttccaagatgcctggcaaaaccacctccctgtgccacacagacacactaggcctgtgtatttatttccccttcaaagcagactgaggagggaggagacgaggntctcttggcatcactttctccctggctgcagaactagacacccttgaagatttggcctgggccagtgagactgaaatcaagaaaaacagaagggatgtgcaaggtgggggggtccacttnctgctcccatgtcaacccccanggccttcagcgtgcagacgcctgncctactcatctgctcccacnggatggaccctgggctttaangggtaagcanaaagggagaaaaagaaaacccggaaaatgngcctattggagaattcccagngggggaccttcacctggatatttaaanggaaanattnggattttaagcccaacatgcccttncttttangggggaantnnggggattaaaaaggnaaaaaaggattcc

SEQ ID NO: 3627 - DNA, 741 bp, Homo sapiens
  misc_feature 1, 2, 3, 6, 7, 9, 11, 12, 13, 29, 30, 34, 45, 46, 95, 598,660, 693, 740: n = A,T,C or G
nnnttnntnannnttgggctaacgccctnnaagnaaccagtcggnncgaattcggcacgagaagacctgcagcttcagcatcacttgagaagttnttaggaatgcatactagtgggccccgcccccagacatagtgaatcagaaaccaacagggaggcgcctagcattgtttttttaacaagtgctgggttattctgatgcacagtctagtttaagaaccactactttgggtaaacgttttgactgtttaaagtttatggcggtgaagtgggcatcttcaaagactagtacttacacagtttagaagatttcaaggtactgctgacagtagtttattatgtcagtatacatacgtgtagagatcataatttagttcccttcttaatgttacaatttcttagtttacttttcctaaagggccatagcataattcttgattcctggtggaaatcttttctgaggtgtgggggtgggcaaggtgtggattgctgtttacgatagtgccttcattagttttagttctgtctgttttcattcattattgactcaaaggtattagaacaggcccttatctttttcctattagatttatttttgntttttactttatgtaagttcagaatcctttttttaaagtgatgactactgatgaaataatgntactagtagctgaatttagacttgatgctatgntgataatatttaaatggtgaaaagtaattaaggcaaaatagcaattnt

SEQ ID NO: 3628 - DNA, 721 bp, Homo sapiens
  misc_feature 1, 5, 6, 7, 8, 10, 11, 21, 25, 32, 374, 474, 550, 564, 586,720: n = A,T,C or G
nttcnnnntnnttggctgttnttcngcaggancccatcgattcgctgcctcctccttaggcagagagctccttggttccatttgaaaaccttccttccccttttgctggaattgagagactgaggacacaaagtggtgtgctggagaataaactagagcctgtggtgccagactggcaacttggggattgtgtgagtgagggagagattgtgcagagctaatcctaacattgctgatgagtggacagaaaccataggcctcatgaatagtgatttctgaagtcaaagcccagtatgcttaaatatcaacccaagtggtttgggagaggggagcacagcttactgttctgctaaaattctttgaggaattaagtnagaatacgtgtaaggtacgtagcaatggttatttacaaaatggactctgcctgcagattattagtatgtctcagatgtaaaaccagctcaaaagtactangacgatttgtagtagtatttaattatttgtaaacttacaccgtttttcttcacgtttgcagaatacaaatctttgncagtagtgaaatgngaatctagtaggattaaactgngtgtaaaccttgtgggcgggatgaagagaggcagaagcgcgtactggtgctgtagttgcccgcaagctcaagggcccactatgtactgctctgggttgcactgcccagaggtaaggggaagcttccttaagacnt

SEQ ID NO: 3629 - DNA, 730 bp, Homo sapiens
  misc_feature 3, 4, 8, 9, 12, 13, 425, 496, 514, 584, 642, 645, 655, 669: n = A,T,C or G
ggnntttnntannatacagctacttgttctttttgcaggatcccatcgattcgaattcggcacgaggggttctttaacctgtgcttcctctgtcctacttcccatcctgcacagttcatagagtcactttctgactatcctatagacacagtaattggacctgtgtttttttctaatctttatatgacagcacatttcctaattcagggaccatcccctatcccaaattccatcctgtgagatgtgaaacctgtgagttcatgtgaatgagtgtttgaagggcttgacgccatgtagtctcttaggaaggcttcagggtgctcttatgttgatgctttgccattatcaaatggcattgattgatccgagggactcagaaagttagggtagactctataaataatttcattattcctcatcctctncgtcatcattttattggttagtcattctgccagatcactaagattcttcctctacaggccccgcaaaattncacagagccctgattctncacctgcagatggagtctccctatcccattgctcagcttttcaagatttattatgatgctggcaagtganggaatttcttaagccgagaaatcagaagttcatgcctgttacctcctaagaacccggngtnaaagaccatntatcctggtctganatggcgggcctttagtgagaaataagttgtttttaagttggttcagaaaaaaaaacccacc

SEQ ID NO: 3630 - DNA, 759 bp, Homo sapiens
  misc_feature 9, 23, 30, 31, 32, 40, 376, 391, 511, 545, 564, 593, 618,624, 647, 667, 703, 719, 757, 758: n = A,T,C or G
agagtttgngtgtagcgccttcnctaagannntggcggtncgaattcggcacgagcagggatccacttgccttaatttgcacagtgttcttataaatcaacagaaagtacacataacagaaaaatttaaaaggttagggatcatttaggaaaaaatgcaaatgccaacaaatgtgagaaaatgctcaatcttacttataatttaagaactacaattcagccaggcgcggtggctcatgcctgtaatcccagctacttgggaggctgaggcacgagaattgcttgaacccaagagggagaggttgcagtgagccaagatcatgccactgcactccagcctgggcgacagagcaagacttgtctcaaaaacaaacaancataaaacaacaaanaaattaccattaaaaatgagagagttttcattggcaaagttaaaaagaaaggtgaaagaaaaacctactcttcttgatttgtgtttggtcacttatggagaatttattttgtcataaggnctgaatcataattaaatatgttctttgggtctancagttcttctatttcttgnattataagtaaaccttggaaccatcttanacactgatcatgaagactaatttgnaataanaaagtttctagcctttcattccnatggaaatatggttgcccgntaaaaaaaaaagcctctagaacttttagtgagtcgnattaccgttagatccngaacttgattaaggatacaattgattaagtttgggacnnt

SEQ ID NO: 3631 - DNA, 751 bp, Homo sapiens
  misc_feature 2, 7, 13, 14, 607, 627, 630, 720, 726, 734, 743, 745, 751: n = A,T,C or G
gnctttnaaatcnnttgctacttgttctttttgcaggatcccatcgattcgaattcggcacgagatggggtatagatggttttccccctgtgtactctagtaaatttctatgccatttctcctatcgatctgccttttgtcagttgatttttcagcttaacttcagagagcaaaggggaaggtggccaagtgcagtgtctcatgcctgtaatcccagcactgtgggaagctgaggcaggcagatcacttgaagtcaggagttcaagaccagcctggccaacatggtgaaaccctatctttactataaagaaaaataagtcgagtgtggtggtgcacacttgtaatcccagctactcaggaggctgaggcagaagaattgcttgaactcgggagatggaggttgcagtgagccaaaatcgcgccactgcgctccaacctgggtgacagagtaagaccctgtctcaaaaaaaaaaaaaaaaaactcgagcctctagaactatagtgagtcgtattacgtagatccagacatgataagatacattgatgagtttgggacaaaccacaactagaatgcagtgaaaaaaatgctttatttgtgaaaatttgngatgctattgctttatttgnaancctttttaagctgcaataaaccaagttaacaaccaccattggcatttcattttatggtttcaaggttcaagggggaagttttgggaaggntttttnaatttccnggccccggngnccaatn

SEQ ID NO: 3632 - DNA, 739 bp, Homo sapiens
  misc_feature 2, 7, 10, 12, 13, 19, 22, 34, 35, 36, 87, 96, 685, 725: n = A,T,C or G
tnttatntgngnnctttgnaantccccaggagcnnngcgattcgctggatgaagactaagcatttaaatactaagttgagggcatantagcttttntgtgcctataatcccagtgttttgggaggcctaggcgggaggatgccttgagcccaggagattgaagctgcagtgaattatgagccaatgcactccagcctgggtgagagtgagaccctatctcaaaacagcaacaacaacaagatacaaattgagaaactgttacttgatttgcgatatgtattctgtccagcagtgatagaataacaaggactgggtttaccttgctattttaagcaacaatatatgaaatagcaatttgtaggcattgggtaacaggcaaagcaagactgtggtcactgaaagctgggaaacaaacctactgagctctatggttgccccaatttattatctggaggtagttttcaggctgcagagcagggatggggaagtcaaacagagcatggtgtcttagaattgggaggacaagatgggggttggcggggagggaaggttgtcatcattcgtggggcagagtaccagagaagtgggaagttgtacacagaacttccagtgataggtggaggagtcttctgaatctggttgaatcctgatctacaggtgcatgaaaaggagaacaccctgaggncagaaaaagaacccactggaaaccacaggccaaacaattnctgggactcacact

SEQ ID NO: 3633 - DNA, 746 bp, Homo sapiens
  misc_feature 5, 6, 7, 8, 11, 16, 22, 28, 39, 41, 42, 45, 98, 478, 672,721, 744, 746: n = A,T,C or G
ttagnnnncgncgcgntgaccnggaaanccccaggagcntnncgntgcgaattcggcacgagtcttctaggaatgaggggcatcagcccaccccaggnttttcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgnttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgacacatcactncatatgggggaggaagaaaggatccctggcaccttctcctctctttaanggggcccttttgcaagccctagncn

SEQ ID NO: 3634 - DNA, 814 bp, Homo sapiens
  misc_feature 1, 4, 6, 9, 10, 26, 32, 43, 46, 53, 56, 67, 69, 77, 78, 90,113, 141, 152, 153, 155, 169, 178, 188, 189, 190, 207, 241,243, 245, 271, 275, 281, 283, 286, 289, 291, 297, 300, 311,319, 331, 336, 340, 357, 363, 368, 381, 400, 402, 411: n = A,T,C or G
  misc_feature 456, 463, 472, 473, 492, 498, 503, 504, 506, 511, 523, 525,540, 555, 565, 575, 579, 580, 596, 599, 600, 603, 605, 606,616, 617, 618, 623, 624, 626, 627, 629, 630, 636, 645, 646,649, 655, 657, 661, 670, 671, 685, 698, 705, 716, 727: n = A,T,C or G
  misc_feature 730, 731, 737, 741, 742, 749, 751, 752, 755, 756, 760, 761,774, 778, 782, 791, 798, 807: n = A,T,C or G
nccngnggnncagacggaaagcccangagccnggcgaggcgcnganacatganaancacttgaaccngngaggtggnngatgcagttttnttttgattgagccattgcactcnagcctgggcaacatagcgagactctagnctcaagaagannanaaatagactgaganaaagaagangaaaaaactnnngaggccaccagtcctgngaagacaacaaagaagcagggctctgagagagancnangagggcataggtggcccgaggacatnagangggttnanctncangngaaatnggngggaacggtgntccaggcntagggaatagcncatgnaaangccgtgataaagggaanaaactnggtgngatggaggaatgncagagagggcagaacagancnagagggcancattcgtaggagacgagggaatcacgggcctgccaggccatgganggggtgnggattctannacgaagcctgaggaaagtnaaggcngggannancacancaaagatgccancnggcttgggcttacgnacctcccccatggcngcatgggaangaaaattaanatgnncgcaccaaaaagttgnaannaangnngaacgcagcnnnggtgnnanngnnccccanggcgaaaannggncaaagnangggnccggggtcnnggggcttggaaaangataggacggggngccaagnaaggctccaanaaaaatcgganccnngggaanaacnngggagancnngcnngganngggacaaaaattngggncccnggccaaggncccgggnggcacccanatgggcg

SEQ ID NO: 3635 - DNA, 750 bp, Homo sapiens
  misc_feature 2, 3, 4, 6, 7, 15, 18, 21, 23, 30, 35, 37, 38, 93, 428, 447,508, 538, 548, 568, 597, 607, 614, 623, 625, 628, 634, 647,655, 660, 663, 672, 677, 680, 682, 716, 719, 723: n = A,T,C or G
cnnncnntgtactgnacnggnantcccatnagccnanngattcgaattcggcacgaggcatattgtggagaggcacagttcaggaggaatagntttcgtcttgaagaggaggacactttcctgtgaatcatgagggacagaagatccatatagaagaagacaatagctttgatcttctattacaagaaaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaanaaaatgtcccacatggcanaaatgatgtacacctgatagcaagaagctaattcatatgctttaaaccaatgaaggcttgncaaagagatttagttaatggcagaccttgnggccactttntgtgagaagacatctctttntgctcactgtcttgcaataaaaacttttnttggcaaaanaccaaantttagagtnanccnttaaangaaaaaccttggnccccttanaactnttntggaggcgnatttnccntngaatcccgaccttggattcaggaatcctttgatnaantttnggaaaaaccccccacttggaaatgccc

SEQ ID NO: 3636 - DNA, 770 bp, Homo sapiens
  misc_feature 6, 8, 9, 11, 12, 15, 19, 20, 21, 28, 35, 36, 43, 45, 47,96, 98, 339, 458, 459, 492, 515, 519, 551, 566, 571, 577,580, 607, 609, 611, 619, 623, 649, 661, 691, 702, 709, 714,723, 751, 763, 767: n = A,T,C or G
agcttncnntnnatnagtnnnggaactngccgcannatcccancnantcgctccgcagcaggcccctgctgtccccccacctgctggctgagctcntnctggcctcgtcccctctcagctgtagctgcaccacccccgctctggctaccaggctctcccggctgggcactgcgtggccttgcccctctcccgctggcagctcctcaggggaacaggggctaccagaggctgatttctcccctctcctgggccaggggaggggtattatccctgcctcctgcccccgatgcccaaagcagcatcttccagcactttccatcgaggacttgggtggcagantgtgggtgcagcctggctgttgctcacccaagtgctagctctgcacttcgtgtctgctgagagcaaccaagaccttccatgtcctcgaggcagctgcaactccccgcgagaccccgcanntgggtgggatgaacaaagcaacgcagaccacangcgagtgcctgggaaggagtggnccanggtggttctggagccattgtgggtgagggttnagggccaccgaagtnccgcncaccgntgnctgccctgcactggctttaacaagttngntntgccaaanactnttcaatttaccatcaagccggtctantgtcttcaaggnattggagcctgcgattccttcggggcaccntggggcccccnccggctntgggntcccttggngggaaatgggcccaagccgggctttgcnggtttccttccnttanggg

SEQ ID NO: 3637 - DNA, 806 bp, Homo sapiens
  misc_feature 5, 11, 17, 23, 29, 30, 34, 42, 86, 389, 399, 423, 453, 458,470, 489, 501, 540, 541, 554, 565, 566, 574, 576, 600, 606,607, 631, 632, 645, 650, 656, 661, 667, 680, 691, 703, 705,706, 707, 722, 725, 737, 739, 741, 749, 761, 762, 767: n = A,T,C or G
  misc_feature 780, 791, 794, 797, 803: n = A,T,C or G
tctanctttgngtgtancgcctngcctannagantgggtggncggaagatgaggaagccagcactggatctcatctcaagctcatnttagatgctttcctacagcagttacccaactgtgtcaaccgagatctgatagacaaggcagcaatggatttttgcatgaacatgaacacaaaagcaaacaggaagaagttggtacgggcactcttcatagttcctagacaaaggtacggaaaaaggaccagatcaatattgaaacaaagaataaaactgttcgttttataggagaactaactaagtttaagatgttcaccaaaaatgacacactgcattgtttaaaggttagtgctgaattagttgattgtttttaattgaaaagtttaaagntttaattatnaatggtggataaagtgaaataatncaatatttgattaatccaaaagaagaccangaaangaagaaaaagtnacgtttaacaagtgtgcanaatacaaaacanatagtgagatcttagatacttatgcagttctaccgagtnnttaccgtgaaatntaaaaaagggnngaaaatantntccaaggttaaagcctttaaaaantattannaactttggattcaaaaacaaactnncttatggaagccnttttnccaacnaggangtccanccctttaaaatantgaaaggattntgtaaaaaaaanannnttaaaaaaactttgngcnccctttttaaancntnttttgggngggggccttttnnccgtnaaaattccctacnctttgtattanagnacncctttnggg

SEQ ID NO: 3638 - DNA, 737 bp, Homo sapiens
  misc_feature 2, 4, 7, 8, 9, 10, 17, 18, 26, 27, 34, 38, 43, 541, 573,615, 617, 636, 639, 654, 665, 667, 681, 708, 715, 734: n = A,T,C or G
tnanttnnnnggttggnngttcttcnntaagatncaancgatncgaattcggcacgagggcacagtcagggagttagttagtgggtagactcagcaggagttggttgctattcagatgtgttggggaaagtgacaggcatagctgactcggggtcattcactaagccaggagcccaggaagacacacagatgcaagcagagatcgtgccattacactccagcctgggctacagagtgagactctgtgtcaaaaaaaaaaagaaagaaaatgggcttgtgtggtagcaggtaagaaattgaatctctgttgtacagcagctagctgtactgcatgatcacttcccattccccagctgacagtggctgtctctggaactcctaccacagtcttcaattggtaggccagccctggtgccagtgattttatctgggcatggaaaatgccacttgcttctgtggaagagacacttaaaagatctggcagtcggccgggtgcggtggctcacgcctataatcccaacactctgggaggtcaaggcangcggatcacgaagtcaggagatggagaccatnctggctaacacggtgaaacccttgtctctactaaaaaaaaangnaaaaaaaaactcgagcctntanactatagtgagtcgnattcctagatncngacatgataagatncattgatgagtttggacaaccacactngaatgcntgaaaaaaatgtttttttntat

SEQ ID NO: 3639 - DNA, 726 bp, Homo sapiens
  misc_feature 551, 590, 646, 667, 677, 719: n = A,T,C or G
gtaaagtgctcttgttctttttgcaggatccatcgattcgaattcggcacgagggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctnacgacccagcacaggagctggaagccaagtgcacgcgangctcttcacagcccaagaaggcagcctgtcaccctgctctccgaccaagggccaangtgtggggggcacaagccatnctcatcctgncaggccccgctttcagaatggggtggtgccaatgctccactnaaaccct

SEQ ID NO: 3640 - DNA, 721 bp, Homo sapiens
  misc_feature 2, 3, 4, 8, 531, 615, 679: n = A,T,C or G
gnnnttangatcagctcttgttctttttgcaggatcccatcgattcgaattcggcacgagccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggcttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattcctttttttaaacaatgaacatcggaaatgagactgtggggtgtggtnctctctctctttttttttaattttctttgttgggtttttgagcaacctcatgtcccttccagggagcttttaattacctcttanaactcaagtggatgggaagtagagcactatgtgtcaatatgctttggtttctgacacgattacncagcgaggctttaatgccattgggtaggtgagcttctgcctt

SEQ ID NO: 3641 - DNA, 750 bp, Homo sapiens
  misc_feature 23, 25, 26, 34, 39, 54, 66, 91, 100, 104, 107, 108, 114,116, 117, 123, 133, 135, 138, 156, 157, 164, 186, 193, 195,197, 198, 205, 219, 239, 281, 282, 307, 319, 321, 334, 370,373, 376, 382, 398, 399, 403, 406, 408, 409, 412, 422: n = A,T,C or G
  misc_feature 426, 435, 437, 438, 451, 454, 501, 506, 510, 519, 524, 530,536, 538, 542, 543, 547, 551, 552, 554, 560, 581, 616, 622,631, 632, 636, 638, 642, 659, 661, 663, 679, 681, 687, 698,701, 702, 728, 744, 749: n = A,T,C or G
ggggttttaatgcttggctactngnnctctatgnaggancccatcgtttcgctntcggtggccttnctgtggaagtgacatgctcattttngccttattngtgnacnnggggangnnctaaanttggcctgtntncangggttaaggtcacactgnnctaattngcaatgggaacaccatgtactnagttggntncnnccgtttntaggaaagctttcnttatgcaagggataacatcnaatagggcacttatcccaaatgaatgcagcaatttaaaccanngatgtttacgcatggcaagaacacngttaggcaggantntggggtcaactangctgatgtctttgaacacccatgagctcactggaangtntgnatatcnggtggccgatgggctnngggngtntnntgnttgctcatangcgnaatttaaangnngagttatgtgggnganaatatgtatgtttgcaattacacatggaatgtaaaccaaagatacanttctnagcnccctaaccnctaantggatnccctcntntcanncaangggnntntccacngggaacctgaaacactagttnaggctgtgatggacatgagtgggtggacatgcctncatggnaaggaattnntacncnactnaccttcatgaacattcnancngagacctttaagggtnancaaganatgacttttgngtnnggaatatgaaggtggaattgacacanaggcccttgaaatggnaatgna

SEQ ID NO: 3642 - DNA, 761 bp, Homo sapiens
  misc_feature 3, 8, 29, 210, 211, 214, 220, 237, 258, 262, 269, 270, 272,280, 282, 286, 291, 295, 296, 298, 300, 301, 302, 307, 309,310, 312, 318, 319, 321, 322, 324, 328, 332, 334, 335, 344,348, 352, 355, 362, 366, 372, 376, 378, 382, 389, 399: n = A,T,C or G
  misc_feature 400, 401, 406, 408, 410, 413, 414, 422, 424, 426, 442, 444,445, 451, 453, 456, 459, 460, 463, 464, 466, 469, 476, 479,484, 485, 486, 488, 497, 498, 499, 500, 513, 516, 518, 528,535, 539, 540, 542, 543, 544, 551, 552, 553, 556, 569: n = A,T,C or G
  misc_feature 571, 572, 573, 574, 581, 583, 584, 585, 587, 589, 592, 594,596, 602, 608, 610, 614, 616, 620, 626, 635, 643, 644, 645,647, 649, 650, 655, 656, 658, 666, 669, 671, 675, 676, 681,682, 683, 685, 686, 687, 688, 691, 694, 695, 696, 702: n = A,T,C or G
  misc_feature 703, 705, 710, 712, 713, 714, 715, 718, 719, 720, 723, 725,728, 730, 734, 739, 741, 742, 743, 745, 746, 747, 750, 751,752, 753, 756, 761: n = A,T,C or G
tcnccctnttttgccgctcttgttctttntgcaggatccctcgattcgaattcggcacgaggaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttnntanatgctncttgcaaaactactacnctcatatggcatgatccattnacantaccgtnncnatatctgncntctngctgnaccnntncnnnatctncnntnctcacnncnntnaccnctgnannacgtgacgnagcnctcnctnagatcantganactgantatntntcangatcatntcacaattcnnnctctntngnacnncactgtangncnatcaatctgccttacnannccacancngantgnncanncntgngagaccnccnctttnnnangccaatgcnnnnggatcaccttagnccntngtcctgccgnccctgtnctcnntnnngaaaccnnntcnttactcccaatangnnnnatgcctncnnntntnctnancncgcccntttaantnccancnttcnttggcnaggccccanacactggnnnantnnacttnntncccccaanttngnggannggctnnnannnnaanccnnnatttgnncncaacntnnnnccnnnccngngcntnaatnccatntnnnannnaannnnaanaaccn

SEQ ID NO: 3643 - DNA, 698 bp, Homo sapiens
  misc_feature 2, 3, 5, 6, 7, 8, 9, 10, 13, 14, 15, 16, 97, 410, 411, 567,572, 573, 582, 588, 595, 616, 645, 669, 695: n = A,T,C or G
gnntnnnnnnttnnnncacgctcttgttctttttgcaggatccctcgattcgaattcggcacgaggcacaagccactgtgcccggccaatactgcanaatattttaaaaagttaaaattatctcttctggctggtcatagtggctcacacttttaatcccagcacactgggaagctcagtcagaaggattccttgaggccaggagttcaagatcagtctgggcaacacagaccccatatctccaaaaaaataaaaataaataaataaaacagttatcaggctgggagtggtggctcatgcctgtaatcccaccactttgggaggctgaggcaggcagatcatgaggtcaagagatcaagaccagcctggccaatgcggtgaaacttttgtctctactaaaaattcaaaanntaaaattagccaggtgagttggcgggcgcctgtaatcccagcccgcttgggaggctgaggcaggagaattgcttgaatctgggaggcgaagttgcagtgagttgagttcttggccactgcactccaacctgggtgacaagagcaaactcatctatnaaaannaagacactnagcttnatagttntgagatatctttagcatgttntatttccaatgttagaaaattatctttgntattgtcattttgtggtgatactnagctctttgctctgatactataatgngct

SEQ ID NO: 3644 - DNA, 741 bp, Homo sapiens
  misc_feature 3, 6, 8, 10, 16, 21, 29, 30, 36, 41, 43, 44, 637, 717, 724,727, 738: n = A,T,C or G
gtntangncngcactncttgntttgtgcnngatgcncgatntnngaattcggcacgagacctcttcttcattgttaaaatggaaataataatactacctagctcgtgggattgttgtgagacaacaacaaatgagacaacagagatctgaaactctgcctggcccctggtatataccaagtccacagttaaattagcctttgttactaaatcattgtttgggtagaaatcctcagattttggatttctcaagtgctccttttctactgtccaaaaggcagaatgttatttttgctcgattccattatgtaatatcctatgaatttgaaatttcggaggaggcacagcatggggctgtggaaatggtgcaggtatctgcatccgaaactccgaagttgtgtggggaggtcctctctcctgagcccagaggcaaaaagctgctcccaagaaatgatctttatgccccacagtccaaagccccacattaaacaaagtctcaagacaagaaggcaatgtgaccctggcccccatgttttgttttgacttttaatttcaaaataatatcattgtgggggggcttatagtttttaacagctgaaagttatatagacagaaaaaatgctcaatgagtagaaaanggaaaaaccttacttttaagaaaacgtgattaatcaaagagatattatgcttgacctcaggccatcactttgaactctgncactggntgnaaaatggcttncca

SEQ ID NO: 3645 - DNA, 730 bp, Homo sapiens
  misc_feature 4, 5, 7, 10, 669: n = A,T,C or G
gggnntntantatcagctcttgttctttttgcaggatccctcgattcgaattcggcacgagagcctctgatcatcaagacatggcagaataaaaagacaagtcacaggctagctgaagatatttgcaatacataaatccagcaaagacttatatccagagtatataaagaagttctgtaaatcagtgagaaaaaagacaaaccccccaattaagaatagtcaaaagatttgaacaggcacttcacaaaaggggggtattgaaatggccaataaacacataatcattacttatcacagaaaagcaaattaaaaacagaaagagataccacaacctcctccccagaatgtctatatggaaacaaatgtcaataccagggtttgaccaaaaccaactggaactttcacacatttttgctaaagtgtaaactggtacaacctcttcagaaaactgtttgacaagatttttgtttttgtttttatacagttaaacacttaacttatgactaagcattctgctcctaggtatttacccaagagaaatgaaaatgtatccaaacaaagacttgtacaagaatgtcacagcagctttactcaaaatcctacaaactagaaagacccaggtgtccaccaataggagaagggaggaaaaaactaaaaccactttggtgnaatctctgccagtaaggaatgaattactcgtgcgtgtacaatatggatgtgtcaaaacaaa

SEQ ID NO: 3646 - DNA, 732 bp, Homo sapiens
  misc_feature 570, 608, 632, 661, 686, 689, 696, 697, 698, 699, 700, 701,702, 703, 704, 705, 706, 707, 708, 709, 710, 711, 712, 713,714, 715, 716, 717, 718, 719: n = A,T,C or G
gtaatagcagctcttgttctttttgcaggatccctcgattcgaattcggcacgagggcagaagagcagacatggcagatgcttttctatcttggtgttgatgctttacgcaagagttttgagatgaccgtggaaaaagtacagggtattagcagattggaacaactttgtgaggaattttcagaagaggaacgagtaagagaactcaagcaagaaaagaaacgccaaaaacggaagaatagacgaaaaaataagtgtgtgtgtgatattcctactcccttacaaacagcagatgaaaaggaagtaagccaagagaaggaaacagacttcatagaaaatagcagctgcaaagcctgtggcagcactgaagatggtaatacttgtgtagaagtaattgttaccaatgaaaatacatcatgtacctgtcctagcagtggcaatcttttggggtcccctaaaataaagaaaggcttatctccacactgtaatggtagtgattgtggatattcatctagcatggaagggagtgaaacaggttctcgggagggttcggatgttgcctgcactgaangcatttgtaatcatgatgaacaccgtgatgactcttgngttcatcactgtgaagaccaagangatgatggtgatagttgtgttgaatgttnggccaatctgaagagaacgacccanaanaaaaaannnnnnnnnnnnnnnnnnnnnnnnaaaaaaacctccc

SEQ ID NO: 3647 - DNA, 732 bp, Homo sapiens
  misc_feature 3, 6, 24, 26, 101, 110, 126, 152, 180, 187, 193, 208, 244,263, 278, 304, 322, 347, 366, 418, 422, 429, 434, 467, 471,475, 480, 489, 491, 499, 526, 549, 566, 577, 607, 611, 641,642, 644, 651, 660, 662, 668, 669, 674, 686, 703, 705: n = A,T,C or G
  misc_feature 707, 720, 723, 731, 732: n = A,T,C or G
ggntcnaatgctggctcttgtgcntnatgcaggatcccatcgattcgacggagttgagttgctaacttttgtccttttcctcagtttccagatgagtttancagtaaagnatgcttttcccaggcncaaattgggaatggaaatcacctagntccgttccctctgacagctgtaatccanagagctnagctgnttacttcattagctnggtataagctgacgacagcagtgcccttgctttatntttgacagagctaggaaanaagccttctttgttnctgctgtaatcatagttacccttganctgaaatatcttacattnattctcaagcaggtagggagagganaaaagacattgcgaaaatnacacctgaatgcctggagcatggaagacattctgtccctagccttttccctntgantttggancctgngcccactatgcccaaagactgagctttctaaancatntatngattnatgttattncnctccctanaaggctttcagaggatctccatggccntacgaagaacttcagatccttancatgctacagaactcancatgatcaggnctccttatttctctaattgatttaaccacngatnctatgtgtccttacattcagactcaataanntncttaaanttttcctgnanaccaannagatnctataaaggctngagccctttaaaactanangnggtcgaattccgnagnaccagaann

SEQ ID NO: 3648 - DNA, 729 bp, Homo sapiens
  misc_feature 5, 6, 539, 685, 729: n = A,T,C or G
gaaannagctcttgtcttttgcaggatccctcgattcgaattcggcacgaggcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtactttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgccgcctcggcctcctaaagtgctgggattacaggcgtgagccactgcgcccagctatactgnatattttaagaagttccagcatgttgcatctctgcatttatcctatatcattaaaagaacataagttatcatggtgttgggtaaattagcgaaaatcaaccctttctaagtttaagggaaaaagtatttttaaaaacaacttaatnaaaacttacactcttttattacaagaatgtatttcccttaaatn

SEQ ID NO: 3649 - DNA, 729 bp, Homo sapiens
  misc_feature 13, 15, 93, 497, 624, 634, 653, 703, 729: n = A,T,C or G
gcatgtggctctngncttttgcggaccctcgattcgctggaattagtggcttgctgataatctcattttataatttgttcagcaatccagcangaccaactttttaaaaaaattaataacagtagttttatgaaaactaagtaagaaaacagtttccacctatttctgaggtctcctttagaaggagtaacagacagcttttatttctcttaaagttataaaaatcacaatcgcaagtcacaatgaatactgggaagggaaattacttttgcagagtgatcaagtaaatgatagcgggggctaaacttttttagtaaacttgtgaagattacatacagtaaagtgcataaatcttgagtgtcaattcaatgaatttttataagtaaacacactttgagagcaagcatcctaagactccacttcctccagaattagctgatgttcaggcataaggttgtttacaggtgaattcatgacacctttgactcttctactgnctcagaccttaggtaacatacctgcagctgcttttctaacaaactgttgatcagcaaaaataaaggggctacagaaacactcattttatgctggtcctctttgggcttcatgccaagacaattctgnggtaaatgtncagttgactctgatttggnaatatgaaaatcaagtccatccttggtattaaaaaattttttacaattgnaattattattgatggtcatattgggn

SEQ ID NO: 3650 - DNA, 739 bp, Homo sapiens
  misc_feature 7, 22, 43, 68, 93, 96, 97, 145, 146, 168, 209, 227, 270,275, 276, 299, 303, 308, 309, 312, 316, 326, 346, 348, 350,351, 353, 355, 361, 372, 373, 422, 454, 460, 463, 467, 490,516, 523, 543, 553, 564, 566, 581, 583, 584, 585, 586: n = A,T,C or G
  misc_feature 590, 591, 594, 626, 632, 641, 642, 680, 693, 702, 704, 715,734, 739: n = A,T,C or G
gcaaagnggctcttgttctttntgcaggatcccatcgattcgncggcggctctggctgcccggcggtngagagcatggactctccaggggcangtnnggcgcctccggagttaccggagcggaactgcgggtaccgcgaagtctnntactgggatcagcgctaccaangctcagccgattctgccccctacgattggttcggggactantcctccttccgtgccctnctagagccggagctgcggtccgaggaccgtatccttgtgctangatgnnggaacagtgccctgagctacganctgntcctnngangctnccctaatgtnaccagtgtggactactcatnantnntngnggctgncatgcaggctnnctatgcccatgtgccgcagctgctctgggagaccatggatgtgcggaanctggacttcccaatgcttcttttgatgtggtnctcganaanggcncgctggatgccctgatggctggngaacgagatccctggaccgtgaactntgaaggngtacacactgtggaccaaangttgagtgangtgagccgtgngnttgtcccatgcaggncnnnntatnncantgactacatgctggccctcgctttatgggccnaacctntgcccaagnntattatggataggaccctgaagcatgctacctattggnaatgggtttcacnttccattgngnacctcatgctncaaaggccggtaaagcttnaaacn

SEQ ID NO: 3651 - DNA, 728 bp, Homo sapiens
gaaagcagctcttgttctttctgcaggatcccatcgattcgcaaaaagttaaaattttatttttctctcatgtaacattttggataatttgatgattccctaatgttgggacccagtcttttctgtcttaggctcacaactatccttgagcctgtgtcatgggggatgactctgaagctgcgtgcaccctgttcattcacattttcttggcctgaacttagtcactaggctattcctaactgcaagagaagctggaagatgtagtcttccttctgaccagccatgtgctcaaccacaaattgagtttcagttattggagggcagaaagaatagatatggggctgctttgtaggctgctgctcggggcagcctctgctgtgttatttgagatttataattttccttggcttcccagatgacagtggaaaaaggcatagtcaagacttcaagtgcggaaaatgttggcaactctgacatgcaagttcttttccatatagagctgagttatgctggagtattttggttacaaagacttcattttctcacctgtctgaattcctgtttggattttagttactcttgatttatcagcatggattaaaaattgaaaagacttggtattttaaaattatatctgaaatggcagagacagcatctgaggattcctcttgctactataaggaatgagtaattagtttgatttttctttaaatccaaataaataagat

SEQ ID NO: 3652 - DNA, 739 bp, Homo sapiens
  misc_feature 2, 6, 22, 57, 280, 309, 432, 498, 514, 630, 634, 713, 739: n = A,T,C or G
gnaaancagctcttgttctttntgcaggatccctcgattcgaatcggcacgagacanagcatatgtaccaacaatgcatgtttatattctgtgccatgccaggggcaaattcatagttggcctgtttccataagtgtggggatggaaccttgaaacacaggacatctcataatgctgtaagcagggaccattgaaattgattcctagagtcttgttctacaacttctttaaaaattactgatttgacagcagtatgtattcaacatttaagactttctgnctaattttgagcatacattcttgactaangctagcaattagagattctttctttaatttatcagatatctattaattgtctacttttgagtgggctctgtgcaaggcgctaaaaagccagttactggggttctgttccttaaggatcctganaattgagttgctaagaattaaatcagcaggcgtgcaatatgactgtcaaagcttgacccctgcttngattccctttgttganacaggttcttataggacctggattctcaccacatcctctggtctgtttaagggaacacaaagggtaagctcaactctgtgtccaggagtaccttatagtccctttcccttaactgngtcnggttcaacttgatccaagatcagggattagtacaagctttgtaaaaaaaaaaaaggtttattttttaccaaaaataganccagatgccctttggaaggtaaaagn

SEQ ID NO: 3653 - DNA, 736 bp, Homo sapiens
  misc_feature 3, 676: n = A,T,C or G
gcnatgcttggctacttgttctttctgcaggatcccatcgattcgaattcggcacgaggagagacagtgagagagacacaccatggggcctgatatggaggcacttacgtccaccaatgctgtaacatttgcattcgttaacaccctttcattaatttattaaatcattctccagtgtaacttctgtagaattcccagtttttgcttttatgaaattctgtagttgatgaacctcagattttacaagtaattgaacttaactacaggagaaggaggagaagaaggtggagggaaaggacaagaaaaaaaagcaagatataactttttttggttcccctcttttaatattttttctaaaattcatactaataaatacaatcatttaaaaatgcaggtatctaaaattacatataaactggtccttcgagtaagtcagagaatgctatttgctcattgttaactgtatttttagtatcttccaaacaaaattctctttatcaaaattatcatttgcagcttttctaggtagtttccaaagtggatgcacgcttatggttggaaaggatccttcttgacaaagctttcacactcagaaactactatcaaatgcagtcaagcacaggaagaaagaatacactgatgacccgagtatgctgaaataaaagaaacataaggngctgctgtctgaattcacactggagtttctttcactggtgtcaagtggtggtaacctatc

SEQ ID NO: 3654 - DNA, 732 bp, Homo sapiens
  misc_feature 14, 532, 603, 609, 610, 618, 633, 645, 664, 732: n = A,T,C or G
ggatctagctctgntctttttgcaggatcccatcgattcgaattcggcacgagcattagtatttttgtgatttcattttttacacttaaatattgattcatgtggaattcactttgatgcagggtgcagtagggctccagtttaatttttttttagattgctactcagttgtttcagtactgcttagtgaataagccatctttattatcttgagatgtcacttttattatgtactgaatttctctgtttatgttgggtctttagctgtactatgtggtctcttccattgatttgtcttttactgggctgtgtcatactgtttttaattattgtagtgttatattttagtatttggtgaggctagaccctcttcaattaacttttgctttattttttccaaaggaaatttaggagccggacacatatgtgtgttcatgtattttcattgggaatgcattaaatatatagattaatttaagggatcattggcacttttgtgatgttgagtatgtctgttcaggaacatggtatngcttttccatttattcaagtctttcaagtattttttgggagcattttaaagttggcttcatatagatttgnatattnnctttctgngaaaccaatagactncaaaagctttantggcttatggcaaccaaanggttaatttctcattcaccgttacatgccacctgtaggtcaatggcagccctgcttatggttcgatgn

SEQ ID NO: 3655 - DNA, 735 bp, Homo sapiens
  misc_feature 5, 6, 8, 9, 10, 15, 18, 727: n = A,T,C or G
gtaanntnnnaatancangcttgttctttatgcaggatcccatcgattcgaattcggcacgagatccaatatttattgagtgtctattaggtgccaagcaccttaataggtcctatggatttgaaatgccgtccctgtcttagatctcacggtctactggaggacacagagaagtaagcaggcagttgcagtacaatgtaacactgagtgctgtctgtgtatgatgctgaggagggaggttagcctgagccggggaagcggagcttgcaatgatcggagatcgcgccactgcactctagcctgggcaacagaacaagcccctgtcttaaaaacaaaacaaaatcttcagagcaggcttaaaaaaaaatctccctaggggaataacaattacctgccttctgtaatcatgcatgtattgttacaatgaatgttacaaagttggttacgtgatgttcatgtttttaaactgagttattgtcattttcactcagattctgccacagtaattctgaaagggtttaattgaaaatattttctttctcagtttactcgtttactcattcattcatataaaaaaattgcttaaaatgtcaatcatcggctagaccccatacccaaagccaataactggcctcaagaatttacaatctagtgaggaagacatgtttagacaggcattaaaaaacccaacctagcaccaagctatgtagaactcagagaaccattnattgaagt

SEQ ID NO: 3656 - DNA, 744 bp, Homo sapiens
  misc_feature 12, 22, 28, 29, 33, 219, 284, 387, 422, 438, 444, 532, 545,607, 612, 638, 643, 656, 674, 683, 685, 695, 705, 714, 720,738, 740, 742: n = A,T,C or G
aaacaagcagcnccctgtaaanccctcnntgcnggacccatcgttcgaattcggcacgaggacatacgagaagaaattaaatgtgactttttatttaaagcaaaacaccgaattgctcataaaccgcattccaaaccaaaaacttcagatatttttgaagcagatattgcaaatgatgtgaaatccaaggatttgctagctgataaagaactgtgggcncgacttgaagaactagagagacaggaagaattgctgggtgaacttgatagtaagcctgatactgngattgcaaatggagaagatacgacatcttctgaagaggaaaaggaagatcgtaacacaaatgtgaatgcgatgcatcaagtaacagactctcatactccttgncataaggatggtgcaggtcagaaccattcaatggncaagtgaatagtcagntgaacnggtcagtgaatgggtccaggtcttacccagtgatgatgatgatgatgatgatgacgacgacgacgaccacattgacgacgatgatggngatacgccatgangctttaagggttggagaaaattctattcccacaatttattttcacatactggtgaccctaanagggncccaaataaaaccgggaagaatcccnctttnaaaaatccctggnaaggaaggaagaaagccnaaccgtaancnaaagaacaanccctggcaangggcacttntggccnagaactggccgaccaatnangncg

SEQ ID NO: 3657 - DNA, 746 bp, Homo sapiens
  misc_feature 3, 4, 6, 7, 12, 89, 245, 248, 257, 281, 287, 331, 333, 346,416, 519, 539, 540, 557, 594, 667, 670, 687, 700, 715, 717,728, 740, 744: n = A,T,C or G
ggnntnnaagancagctcttgttctttttgcaggatccctcgattcgaattcggcacgagacgaaatagtgacatgcacttattagatntggaatctatgggcaaaagttcagatggaaagtcgtatgtgtattacggggagctggaatccaaaatccccacattttcaagttgtaaatgaagaaactcctaaagataaagtcctgtttatgaccacagctgtagatttggtaataacagaagtncangagcctgtncgatttctcctggagacaaaagtncgcgtntgctcacctaatgaaagattattctggcccttcagcaaacgtantnctactgaaaattnctttttgaaactaaaacagataaagcaaagggagagaaagaataatactgacactttatatgaagttgtntgcttggaaagtgaatcagaaagagagaggaggaaaactacagccagtccttcagttcgcctgccacagtctggatcgcaaagttcagtgataccttctcctncagaagatgatgaagaggannataatgatgaacctctnctgagtggatctggtgatgtatccaaagaatgtgcanaaaaaattctttgaaacatggggagaactgttgtcaaaatggcatcttcaacttggaatgtgaagacccgaancangttggcattccttagtnaggaaaccgtgtnccttgaagctcttcnanggagaagtctngccacctgcttnccangg

SEQ ID NO: 3658 - DNA, 729 bp, Homo sapiens
  misc_feature 3, 4, 7, 12, 593, 633, 699, 702, 703, 704, 705, 706, 723: n = A,T,C or G
ggnnttnaaatncagctacttgttctttttgcaggatcccatcgattcgggagaccaggtgggagccactcacagaaatcagtaacatgaaaaccacagccacaaaaccaccactgtcactcaacgcccatcatcacgggcaggacagttctacatcatctccctccggcctgaggcttcccaggcagtgtgggaaggggggctgcatctcctggctggggttcacacctaagtttcctgaggtccaagctgacctggaaagtttctagtgagtggcacatcctgtcccaacaaggggaacacgggcaggatgtgcctgcaccctgggaaaagtgttgtctccgcacacggggaagaagttgtctgggggacagaggagttccaggtagcaaacacaggctacagggcaagggttggaagaggctggcagctggatgtgagacagccaggtgggaaggggtccccaggcccctccagccggcctgtgcactgggaggggtgcacactggggtggagcccacagaggtttgtgccatttgcggcggggagaacctgccctcctcttcctgggtggaattcaatctgtgaggcangaagcccatggcaggaaacacactatcttgctttgctganggtctctatttccctttttttttcctttttgcccaataaatccctttttctacttcttcaaaaaanaannnnnaaaaaaacttgagcctntaaaat

SEQ ID NO: 3659 - DNA, 711 bp, Homo sapiens
  misc_feature 597, 614, 617, 665, 675: n = A,T,C or G
caagctcttgttctttttgcaggatcccatcgattcgctctcactagccctgggcacttcccactgcctttgtggacttctgtttgctcttctgtagaatgggataacagtgccagtcctgcttactatttagggttatgtgatgcttgcagatgtacagggaaagcaccgctgatgggagctgctgaagtttctaggggaggtgaaggtggcgcctcctcccctggtctaagtggtagatggtgcagggagaggagaatttcattctgtggcagcagctgatagattccaggtctttaatactacctgggaaaccttaacaaagcagtcagtcaccaaaactgacctagcttctgagcattgctaaccatgcttttagagaaacaggagaattgcttgaacccaggaggtggaggttgcagtaagccaagatcacaccactgcactccaacctggacaacagagcgagactccatctcaaaaaaaaaaaattgtgttgcctcatacgaaatgtatttggttttgttggagagtgtcagactgatctggaagtgaaacacagtttatgtacagggaaaaggattttattatccttangaatgtcatccaagacntanagcttgaatgtgacgttatttaaaaacaacaaccaagaaggcagaccnggatatactngaaaaaggatgcttttttttttttactccctctaac

SEQ ID NO: 3660 - DNA, 739 bp, Homo sapiens
  misc_feature 2, 3, 4, 6, 14, 16, 532, 578, 658, 738: n = A,T,C or G
gnnntnttaatacntnaggctcttgttctttttgcaggatcccatcgattcgctctagcatgtgccataaattacagtgacctttaaaatctcgcttggtcactgctgaatgggtgagaataggcttggttccagtttttaaggtcacactgtcctaatttgcaatgcatcacaccatgtactaagttggtaacaaccgcttagaggaaagctttcgttatgcaagggagaacatcaaaaagggcacttatcccaaatgaatgcagcaatttaaaccaaagatgtttacgcagggcaagaacaaagtaaggcaggagtttggggtcaactaggctgatgtctttgaacacccatgagctcactggaaggtctgaatatctggtggccgatgggctcggggtgtctcgtcattgcttagaagcgaaaattaaatgctgagttatgtgggtgaaaatatgtatgtttgcaattacacatggaatgtaaaccaaagatacaattctaagccccctaaccactaaatggatccctnctctcagccaagggcattccaaagttaacctgaaacactagttcangctgtgatggaaatgagtgggtgggacatgccttcatggaaggaattcagacacaactgaacagcatgaacattcaaacnggagaccttaagtctacaaaaccagactctttgtagccattaagatgcttgatatgacagaaaggccctgaaagcaatana

SEQ ID NO: 3661 - DNA, 730 bp, Homo sapiens
  misc_feature 3, 4, 10, 21, 23, 627, 658, 664, 671, 693, 697, 711: n = A,T,C or G
gtnntttttntatccctttcnanttgctctttttgcaggatcccatcgattcgaattcggcacgagagtaaattcagtgtttctgttgccgaagagtgtttattggttctttcactttcatttcatagggccctttcttctactggcattctcactttgaattactaagaagtttcttctaatatccctctatctcctttttctttctagttttagataaagctgtcaaaagaacagttatcatagaaatagaaacatttaaattaccggcacgatagcttatttcttgctgcaaccattcagaatatctatttgtcactgccttgggtgctttgaagtgaaactgtgcttagatataaaaagtttaaaactcactttgattacatgttaagctcacagtttttacactgcagttcctgaatttagttccatcaaaactgtatgactaggccacatgtgatggctcatgcctgtaatcccagcactttgggaggccaaggcgggcggatcacctgaggtcaggagtttgagaccagcctggccaacatggtgaaaccctgtctctactaaaaatagaaaaattagctggatgtggtggtgcgtgcatgtagtcccagctcttgggangcccagcaggagaatcacttgaacccgaaangtggangctgcantgagccaagaatgcgccacggnactntacctgggtgactncatctcaaaaaaaaaaaaa

SEQ ID NO: 3662 - DNA, 727 bp, Homo sapiens
  misc_feature 3, 7, 25, 638, 640, 672, 684, 689, 727: n = A,T,C or G
ggntttnatcagctcttgttctttntgcggatccctcgattcgaattcggcacgaggccttttgtggggtctcatacataactcagtttccacaaagctgtgccccagctcagccctatggatagaagcatggtctggggttcctttgctgaccagggtgtgtgctttgtccaagttactgaccttcccaaacctcatcaatgcacataaaaagagcacttgcaaacaatgaatctagacatggaccttcacaaagaaataactcaaaatggatcccaggcctaaatgaaaaatgaaaaactataaaactcctagaagataacataaaagaagatctagatgacctagggtttggcaatgactttttagatccagcaccaaaggcaggatccaggaaagaaataattgataagctggacttcattaaaacgaaaacttctgctctgtgaaagatgctgccaaaaaatgaaaagacaagccacagactgggagaaaatatttttgatggaaatatctgagaagagaggcttggtatccaaaatatacaaagaatttctaaaactcaataatttgaaaataaacaacccaatttaaaaagtgggccaaagatcttaaatgacgcctcaccaaagaagatncncagatggcaaataagcatatgaaaagatgctnccggctggcacngtggntacgcccgtaatcccacactttgggatgccaaggcagn

SEQ ID NO: 3663 - DNA, 730 bp, Homo sapiens
  misc_feature 3, 4, 5, 6, 7, 8, 9, 10, 11, 12, 13, 23, 24, 25, 26, 27,31, 37, 556, 560, 630, 664, 675, 684, 730: n = A,T,C or G
gtnnnnnnnnnnnaatgcttggnnnnntccngacccntctttcgaattcggcacgaggtgagatacctgcccctactttgccttcttccatgattggaagcttcctgaggccaccccagagtcagaagccgctatgcttcctggacagcttgcagaaccagtattcactgactgctgaaactagagcatcactgagaagcaagagatagactgacctaactagagggagagctgccatccaggatgatgccaccatcacaggaggtgagaaggaacacagcatcttctgcaaatgctacagtaaatagggacggggtgcagcaatgtgaggaaagtggaatgaacttggactttgaaggcaaactaacctggaatcaaatactggctctgctgtttgcaagtgtgatctttgggtatgcttcctaatctgtgagcttcaacttcctcctctgtaaaccaagatcaaagacaaacagggaaacctacttgtctggtgcccatccccttggcagaacactcctctgaaggatgacagtttggctgtgccagggcaganctgncgacaccaaatgagccttcatagcaactatctgatgaggaactcactggcctacctttccttgacagctngggcctgccaccttgaagcatgacttcacaacgnccctacccaanggcatggangttgctgctgatgagcaactggttatatttaatccaggttctgctn

SEQ ID NO: 3664 - DNA, 727 bp, Homo sapiens; identical to SEQ ID NO: 3662
  misc_feature 3, 7, 25, 638, 640, 672, 684, 689, 727: n = A,T,C or G

SEQ ID NO: 3665 - DNA, 733 bp, Homo sapiens
  misc_feature 2, 4, 5, 6, 7, 21, 651, 668: n = A,T,C or G
gnannnnctaatgctcggctngttctttttgcaggatccctcgattcgaaaaagttgagtatttatatgtgccagtgtgtatcatgctgaatactttatctggatggtgttatattatccctcctatagactattgagttgagtactgttattagatccattttacaaatgaggaaactatggagagattaagtaatttgcccaagatcccataataagaaggcaagtgtcgaatgccaggcattctaacttcagagtccatagtcttaacccttgtgctattctcttccacaaatacacccagcaggtaaaagactgagaaaaataaatatcaaaaagtaccttttgaaattgactacatgaagttacgaaaacctgagttgttttgtgaaagcggtgagtacaaagcagtattttggagagggttgtgcagggaatcggagatgaagctgtgtgctgaaaaggagagaagaaattagaggaagggaatggtggccttacagagaaacagacttgaagtgatgtgaagtgtttgcgctgggtgaatgctggcaggaataagtgagcagggagcgagtgaacaggataagagagatcacttcggagtaaagccttgaaaagggagtgtaggaggaagtttttctccctttnctgcatccttcctttgngcgtaaaatagaaatgtcttccttctgaaggattcaaagagaatgttggcttttctttcattctc

SEQ ID NO: 3666 - DNA, 739 bp, Homo sapiens
  misc_feature 13, 29, 128, 201, 435, 470, 535, 567, 575, 627, 660, 661,710, 713, 728, 739: n = A,T,C or G
cgcatttttaatncagctcttgttctttntgcaggatcccatcgattcgaattcggcacgaggttgtaggcctccttcatctgttcattggctgtggcattaggccagctactctttgcacttctgtnaagtgagacggtcgatcttgtctgcctctctagaggatggctgcaggtgtcaaatggggtagttaggtggganggcatttcacaaagttaaaaaatatgactttggaggcttgttatattgatgaggattataatccctgagaattcctggtatgaaaaagggaaaagaagataatttgtgaaagaaataagtgtccagttactagtctttgaaaagggtcagtctgtagctcttcttaatgagaataggcagctttcagttgctcagggtcagatttccttagtggtgtatctaatcacaggaaanattgtggttccctccagtctctttctgggggaatngagcccacttctcatttcatttaattagatgaaatagaactcaaagtacaatttactgttgtttnacaatgccacaaagacatggttgggagctatnctttgatntgtgtaaaatgctgctttgtgtgctcataatggttccaaaaattgggtgctngctaaagagaagatactgttacagaagccaccnngaagacctctgttcattcacaccccccggggtatcaggaattggcttcnagnggtgtgccaaatccngtttgcctatn

SEQ ID NO: 3667 - DNA, 730 bp, Homo sapiens
  misc_feature 5, 11, 26, 526, 604, 616, 634, 636, 637, 638, 661, 668, 684,689, 714: n = A,T,C or G
ggttnaatagnagctcttgttctttntgcaggatcccatcgattcgaattcggcacgaggatgtcctgctatacaccatccactgccctgccccttaagcctcacatctttcatctctcctagttccaacccatggtctccagacgatgactctgcctccctgttctggtagcattcacagattgccttgtttagtagcctttcacatgagatccacttgacagcccctgtcctcacccctcctcaaactcctcaccacactgaaactcttccagctccatgagtaggttcttgggtggtttcttcacctgcaggttcaggtcaatgctcagccggggactcgacagggatgctttgcaggtctctggagtgctctttgtgcagtccctcctctgtggtactctgcccttgaactctcactgccttggcctccccaaagtctaaactttgtctcctcaactcagaaagtcctctgggctctgtctgggctccccttccctgtatgtggaattaaatctctctgcangcaggaagttggggcaatcctagggctcactttgttatcttcccatctctcagggatcactgtcctgatgtctattgncctggaaaccgntgtttcattttttttctngnnntggtttaaacattattttttcangtggganggtaaatcagctttgntactncatcttggctggaaattcataaccnaaggttaactgtttta

SEQ ID NO: 3668 - DNA, 739 bp, Homo sapiens
  misc_feature 11, 12, 26, 85, 137, 242, 300, 377, 674, 688, 711, 716, 721,727, 729: n = A,T,C or G
ggtttatatgnngctcttgttctttntgcaggatcccatcgattcgcgccgccccactcgccccagccgccgccatgaaggccgnggtgcagcgcgtcacccgggccagcgtcacagttggaggagagcagattagngccattggaaggggcatatgtgtgttgctgggtatttccctggaggatacgcagaaggaactggaacacatggtccgaaagattctaaacctgcgtgtatttgangatgagagtgggaagcactggtcgaagagtgtgatggacaaacagtacgagattctgngtgtcagccagtttaccctccagtgtgtcctgaagggaaacaagcctgatttccacctagcaatgcccacggagcangcagagggcttctacaacagcttcctggagcagctgcgtaaaacatacaggccggagcttatcaaagatggcaagtttggggcctacatgcatgtgcacattcagaatgatgggcctgtgaccatagagctggaatcgccagctcccggcactgctacctctgacccaaagcagctgtcaaagctcgaaaaacagcagcagaggaaagaaaagaccagagctaagggaccttctgaatcaagcaagggaaagaaacacttcccgaaaaggaagaccgcaatgccagcaacggggctnaaggcgacgttgtncttttgaacgggaaccgtaactnaaganggaanaattantntgttattaat

SEQ ID NO: 3669 - DNA, 747 bp, Homo sapiens
  misc_feature 27, 375, 398, 404, 453, 512, 544, 551, 580, 658, 666, 688,713, 747: n = A,T,C or G
ggttctatagctggctcttgttctttntgcaggatccctcgattcgaattcggcacgagcctgtgtccagcgtcctcggttcaggggaaatgttttggtgttcatgagtagtatgtcccccagtgccccattgtgtgggcgtcctcatggggtatccattcttctaggaagatcctggggctgtttccagttcgaagccattattaataaagctgcaaggaagaaatatttttatggatgtgtgtttttatatctctgataaatatattcaactggaatcattgggtgtattgggccattctcccattgccaaaaagaaatacctggccaggcgcagtggctcacacctgcaatctcagcacttgggtggctgangcaggtggttcacctgaggtcangagttngagaccatcctgaccaacatggcaaaaccccatctctactaaaaatacnaaaattggctgggccgtgggtgtcaggtgcctgtaatcccagctacttggaagactgangcaggagactcgcttgaacccaggaggtggangttgcantgagccgagatagcaccattgcactgcancctgggcaacaagagccaaaactcttgtttgaaaagaattcaaaaggaataccttgagcctggtgagcccaagaatgnactactgnacttccagcctggggtgacaanagtgagactgtctcaaaaaaaaaanaaggggattttttaaaaaaaagcccttttgaacn

SEQ ID NO: 3670 - DNA, 728 bp, Homo sapiens
  misc_feature 548, 600, 605, 607, 622, 718, 727: n = A,T,C or G
gggtttaagatcagctcttgttctttttgcaggatccctcgattcgactcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgtncttcccactagtaaaagcagccaaatgatcaccttcacctttgctaatggangcgtngncaccatgcgcaccantgggacagagcccaaaatcaagtactatgcagagctctgtgccccacctggggaacagtgatcctgacagctgaagaaggactggatgactggcantgcttttgna

SEQ ID NO: 3671 - DNA, 729 bp, Homo sapiens
  misc_feature 3, 4, 5, 6, 14, 21, 22, 25, 91, 93, 710, 713: n = A,T,C or G
gtnnnnttttgaanccttgcnnttncctttatgcggatcccatcgattcgtgggttgactcgctacatcagctcagacttggctgtgggtntncccttgtgaattgttgtttccacatgtgtgttgcttcatttttggctctccgttgtccccatcaccttcccgtctcaccatagggtttagggtattttgctgtgtgttcaaatagaacatgaaagaagccttttaaaagtatttctgtgcctattcacagtcccctaaattttattacagtttttacgttggtttaaagagtattttggtttgatttatatggaaaacttcttttttaacattatagtaacatagatttttaaaaaatgaaattctaggaaacaaatattatagactagttagatggcaaggagaacaggagttttagaactaacttttaatctccataggtactagttgtctggactagctgagtcatttcatctcagtaatacttggtagtgctgtgaatagcagatcttgcatgcacagaacacagcccagtacctgcatgtgacaggcactttattttctggtaaagttaagtacagttgacccttgaacaatgtgggggttaggggaaccaaccttccacacagtaaaaaatctggggtgaacttttgacttcccaaacttaacttctaacagcctactggttactggaagccttgctgatnacngaaacagtcaattatc

SEQ ID NO: 3672 - DNA, 775 bp, Homo sapiens
  misc_feature 7, 11, 12, 26, 28, 567, 583, 586, 587, 588, 589, 591, 593,594, 597, 599, 601, 602, 605, 609, 617, 619, 630, 634, 638,640, 641, 646, 647, 648, 651, 652, 656, 657, 658, 660, 665,667, 668, 671, 672, 673, 678, 679, 683, 684, 687, 689: n = A,T,C or G
  misc_feature 692, 693, 694, 697, 698, 702, 704, 711, 713, 716, 718, 719,721, 723, 724, 725, 728, 730, 731, 736, 740, 742, 744, 746,748, 749, 757, 758, 759, 760, 763, 764, 767, 768, 769, 770,774, 775: n = A,T,C or G
ggttttntggnngggggttttcaacncnggctcttgttctttttgcaggacccatcgattcgaattcggcacgagcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgctttattttttattttttgagaggtatgattctttctagagattttttctcatggctactattagatcaggaatgggtgattggagattattagattctaggttaacttctaccactttaccctaatacataaaactttttcctaaatnaatgatggaaggaatnaannnnancnnccncntnnccnctantacaaaancnctagcccttanaacntttngnnagctnnnttnncctnnntntcccntnntcnnnccccnncctnnttntnccnnnctnnctcnanccccacnanttncnntntnnnctncnnaatanattncncncntnnctcctcannnnctnntcnnnnctcnn

SEQ ID NO: 3673 - DNA, 725 bp, Homo sapiens
  misc_feature 9, 10, 13, 17, 24, 31, 35, 36, 264, 283, 312, 316, 389, 504,510, 526, 551, 565, 632, 645, 666, 673, 688, 690, 697, 710,714, 725: n = A,T,C or G
tcttttatnngangttnggaagcncaggagnctcnntcgttcggacaaatcacttaaggagaaagtagaaaaaaagctgtatttttcaaagaggtattctaatcggcaagacaatgaccaaccattacgaccaaccattatgagaatatagcttagggacgtttgtgctcagctcctcttttacccaatgtcaatgcctgcctcagtgtattttcttctggaggagagttttgtggatgccatctttccgttacggaaaaccantggaggaatgggcagtttnttgccatgacccaccatcatttaaacaantggngtttgagttcagaaataagctcatatatacttgaattccatgggttaaataagccattgagttaaagtggtangaaattaaaggtagaaaatagaagaatagggtgggcttggtggcttatgcctctaattccagcactttgggaggccaaggtggaggatgacttgaggccaggagttcaagaccancttggncaatatggtgaaaatncatctttactgaaaataccaaaaanattagatgggcatngtggcctgtgcctgtaatcccagctactacagaagcttgatgccccagtattctttgaaccttggangttgaagttgcantgaacccaagatgcccactgnactgganctgggcaatgaagtngnaccctgnctcaaaagaaaanaatnttaaacaactn

SEQ ID NO: 3674 - DNA, 841 bp, Homo sapiens
  misc_feature 3, 5, 12, 16, 17, 27, 31, 43, 49, 54, 63, 64, 67, 76, 157,158, 349, 395, 413, 451, 484, 496, 505, 518, 535, 538, 541,562, 566, 586, 589, 590, 593, 595, 597, 598, 602, 607, 608,610, 617, 620, 646, 658, 661, 667, 668, 670, 671, 672: n = A,T,C or G
  misc_feature 684, 685, 693, 695, 707, 712, 718, 721, 722, 727, 730, 731,739, 744, 745, 749, 752, 757, 761, 769, 780, 781, 789, 794,795, 798, 799, 800, 803, 807, 808, 815, 819, 824, 827, 828,830, 833, 835, 838: n = A,T,C or G
ctntngggcccntagnnggggctttcnatanggcgggctggtngttctntccgnacgatcccnncgntgtcgcagngttttgagcagagcaagtgacactatcagtacttaagcattaaaagaattgtccaatgaatggctgtgctgaaaatatatnngaggtaaagtaagctagaggcaggggtattgaaatcaggctaagagatgtttgtggtttgaattaagtggtagcaggaggtgttaagaattagtcacattgtgtatgtattttgaaggtacaaccaacaggatttccaggcaagatagagtgtgatgtgaaaaagaaagaaaggagtcagtagtgactcangagtttgtctgagcatccgaagtgtggaatttcatcacatcctganaggtgaaagaggctgtangaggagcaatatgtgggaaagatcagaagttcagtttnggacatgccaaatattacttggccaaatggttngggtggatgatngggcgatcntgagtcatccctnataaaatcggcatgcanatngcntttaaaaaactccagactggntganatcccaagttgttcgattgnaannacngngnnctcntttgnnantgctccnccntttaaagccacttttggggaaacccnaccaagggacantgnaccatnncnnnattcccttgggnnaacccccncnaaagtaaattanacgcnaggccntcnntccanccnntcaaaatnctttnntctnacntccancacnctttttantcaaaaatttnnctctcccntatannccnnnctnggcnntctttcnccanctttnggnnanctntnccncct

SEQ ID NO: 3675 - DNA, 803 bp, Homo sapiens
  misc_feature 2, 3, 4, 6, 7, 10, 11, 17, 18, 19, 20, 25, 28, 50, 56, 68,111, 255, 296, 367, 378, 438, 464, 481, 487, 497, 527, 534,536, 538, 540, 582, 583, 602, 606, 612, 621, 627, 633, 639,667, 668, 700, 705, 711, 726, 729, 730, 734, 742, 749: n = A,T,C or G
  misc_feature 757, 761, 763, 764, 774, 776, 777, 784, 786, 789, 790, 795,799: n = A,T,C or G
cnnncnntcnnatgggnnnntgtanggnctcctccaatctcctggctgcncctgantcgcctaaacanaaaggctggggcgaattcggcacgagattaaagttgaagcctntctaatttttgaaggttgagcactttggttattcatggttttatatgacgatcatcttttatccatcgctgcagttatctattttgacttgaattggaggcagagctccaccaccccagtgtgtcgtctgatttcccagactanagtccagcctttcctgtgcttgcctggcttccctccatgtngcttcctaccccaccatctatacccttcacatccaaaatccaaaacctcacactcatacgagaatccctgntagggtcggtntatatttacacactaaaaatctctaattttgaatttgttgtgcctataaaggaataccangaataccttaaagttataattgattnattagcatctattttangtcatncttgggggantgatggaaagaatccacatagactccaganagatggncnangngtttacctgcccagccttgaaacatttcctctttcctcacannggatgggctctcccataantaanttcatngggcccccnaagctntaaagnaaaaantaaagtgtctttctcatttttaaaaaanngcaacctttgcctgttcaaaatatgtccaatncgaanccccgnaaaatgtttaaaaangcnntctntgggctcnaaatggnggttcaanggtncnncctgacctgncnnttctgcncnaanncattntccntcct

SEQ ID NO: 3676 - DNA, 755 bp, Homo sapiens
  misc_feature 2, 3, 5, 13, 23, 29, 30, 35, 44, 47, 552, 657, 679, 706,733, 735, 738, 747: n = A,T,C or G
tnngngggtttgnggggctttcnaaatgnngtcancgctggctntcngcaagatcccatcgattcgaattcggcacgagagaaagccttacgtgtgtgctgagtgtgggaaggcctttagcaacaggtccaatttgaataaacatcagacaacacacactggagacaaaccctacaagtgtggcatctgtgggaaaggcttcgttcagaaatcagtgttcagtgttcatcagagcagccacgcttgagagaaacagtgtgagaaaacccccctgagggttgggtctgattgtacactgttgcacgcatgcagcagaaaaatatgtatattattgtaaatagaaatgaccacatcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcatangaaagatcatattatgggaatgataatcctgttactgtggattaggtatagtgccaacagtttgaatggtaagacaacataatatatatgatagtgatgaaaaanaaaaaaaaaaaactcgagcctntagaactatagtgagtcgtattcctanatccagacttgataggatccattgttnanttnggcaaaccnccacttga

SEQ ID NO: 3677 - DNA, 883 bp, Homo sapiens
  misc_feature 1, 2, 7, 11, 22, 29, 30, 39, 43, 106, 180, 397, 409, 412,477, 489, 491, 521, 551, 565, 567, 573, 591, 595, 598, 605,626, 635, 652, 654, 658, 677, 678, 680, 681, 682, 701, 716,720, 737, 749, 753, 759, 767, 768, 772, 776, 779, 796: n = A,T,C or G
  misc_feature 797, 799, 801, 804, 813, 814, 829, 837, 842, 864, 865, 871,875, 876, 882: n = A,T,C or G
nngtggntttngtgggctttcnaattccnntaatcgctngctntccgcaacatcccatcgattcgagcaagtcagcaaatgtgggagatggaaaactggcttcctncacccacctaggttctttggctgggctacaaattaaatggacataaaatagattaacaggagaaaaaacacagnaattatgtgtatatgcctgggagtcccacaaaatatgagactcaaaagaagggtccgaagagggaagcttatatagccccctgagccacagaaaggaatagggacctggggcttctggtgggtggtggagacaagttatggaagagtgaggggaggaagtgtagggtgagtaaatgtggtcttgttatgcccataaaatctcttggtacatcacagntgcctggagcanccncagtcctgatagagatactttactaatgtagattttcttgatggatatcattgtgttttacaaangggcagcttttnanagccactcctgtgtctgcaattttctcagnataacccagcccccaaatattgacaaggtnttagtttggggtgngnaatatncctggccttccctaccangttngcnatttttnggggggttgggtaatttgctnccccgaagnccccccaaacccaccangnaaanaaaggggaagggggccaanntnnnggggaaaatttttaaaggnaaattttttccaggnattnaaaaggccatttcctcnaattttttgggnaaangggaanccaagctnngcangggnaanggccttgggaacccaannantnagnaaaaaggtnnaaacctggcattttngggaaaanaatgncaagtttttggaaaaaaacccnnttgtancaanngttttnt

SEQ ID NO: 3678 - DNA, 1090 bp, Homo sapiens
  misc_feature 6, 9, 16, 17, 21, 23, 28, 33, 35, 36, 41, 46, 48, 52, 56,93, 140, 158, 169, 179, 200, 223, 245, 248, 253, 263, 284,288, 292, 300, 336, 343, 351, 353, 371, 383, 385, 388, 390,392, 405, 408, 421, 422, 429, 434, 436, 441, 442, 444: n = A,T,C or G
  misc_feature 473, 478, 481, 482, 487, 490, 498, 510, 518, 520, 524, 525,535, 536, 537, 543, 554, 555, 560, 562, 569, 570, 575, 576,577, 581, 583, 584, 590, 591, 593, 598, 600, 606, 613, 623,635, 637, 664, 669, 674, 680, 683, 691, 695, 696, 697: n = A,T,C or G
  misc_feature 700, 707, 711, 713, 720, 722, 724, 725, 736, 739, 750, 755,756, 771, 775, 777, 783, 788, 789, 793, 797, 800, 802, 803,806, 808, 814, 819, 823, 824, 826, 838, 840, 844, 851, 855,857, 862, 867, 869, 871, 881, 895, 897, 898, 909, 930: n = A,T,C or G
  misc_feature 936, 947, 948, 950, 963, 968, 983, 986, 988, 989, 994, 997,998, 1002, 1019, 1020, 1023, 1024, 1038, 1040, 1049, 1051,1059, 1062, 1063, 1071, 1076, 1079, 1080, 1084, 1089: n = A,T,C or G
tggttnttnggggggnntttngntcgancgctntnngcctngtccngncgcnggancccatcgattcggaaatatacttccttaaatgatggncattcctaaatccatctaggaatgttggatgtatctatctatctatntatctatctatctactgnattaagccccntctcaaaatngtagggtcagaagtatggacngataattcataatcaagttcttnttctttatgcccagaagtctgnatnctgcncagacttgcntacccctagctgcgctaaagntcanaagntttgagcngccactgaagtattgactgtggagaggcggtgtatncctgttnccaatgangngcctttctgtccaggatnagccttatcggnanttncncnaggaagttgcatngcnttcagtccatttnnggcttanagccncncggcnncncacgtgttccttatttgttttgacggagnggtcntcnngctcnatntctttacnctgattctgctntttcatcnangtgnnccttcctcannnttattnagtccaaaggnngaatncngggttannctatnnnggcnannatcttnntnttctngnaatccncttgggntctaataccnttgtcttcaccnancctttttaacccctcttactctctccnttaanaatanacctcnttntatctccncttnnnacnttataantttngnattgggncnannggggaattttncanactagtcctantgatnntctctccgtccttantctntntttatncacanntacncgtnagntnnaanancaaccntctcngggnngngccccttctttnanaganaaccctntatntnagttnggaangngncccggctatntttatcccggttangnnaattcccccanggcacctcttgggaatttaangggatncccccaatttnngngatctggaaagtnttttnggggggcaccctaanacncnnacacnaanncttntgggaaaattggcccanntgnnaaaaaaaaaaaaanangggccctcntnaaattttnggnnggaaaaanttttnggnngtanctccnt

SEQ ID NO: 3679 - DNA, 807 bp, Homo sapiens
  misc_feature 6, 7, 8, 10, 11, 13, 20, 24, 27, 32, 37, 39, 40, 47, 53,60, 62, 66, 69, 115, 120, 121, 206, 317, 318, 324, 330,336, 343, 344, 383, 399, 400, 421, 425, 429, 462, 510, 517,529, 555, 557, 574, 575, 578, 586, 589, 600, 603, 610, 614: n = A,T,C or G
  misc_feature 618, 619, 622, 624, 625, 628, 632, 635, 646, 647, 649, 662,667, 674, 678, 679, 686, 692, 697, 706, 716, 718, 720, 724,728, 729, 730, 733, 737, 749, 750, 751, 752, 756, 775, 786,790, 794, 805: n = A,T,C or G
tggttnnntnnanttcgctnactnaanatcgntccantnnctctgtntacgcnaagcaancnggcnggnctaattcggcacgcagatttcagcctgggcaacatagtgagactcntgttnntaaaaaaaaaaaatcccacaatcctatcacacagagatggcaacacttagcatttgttctggtcacctttggaaggaacttttanatcaatgtcttgcttctctgtgggttcttttgtgactcacacctgcttctgggtatagtatgactataaagttgatttcttgggtaaggcatgatctatgagaggaagctnntaattngatgancatcanggtaatnntagctgggataccttttctttgccctctccaatcaaacntgagaagttgaaaatnnaaaattatgcttttgaaggcnttgntgtnaacctaaaatataactcaagtgatctgtagttntccatatgtgcactgtcaacagctatttgcttttcaaatccaaactantttcatnaaagaaaaccantttggagtgtattcagcttataattngnaagctagacatgaaagnnttnaaaagccnttntagcctagacnacntggcccncatntttnngtnanntcntgcnttntgggaacttgnncnatgctaaccccantaccncccatcntgcnncctcctnttaaantgccntttgaaagngggcaaaacngnantagnaccnnntancctntcaaaaggttgnnnngttncttgcaaaatggaagcccnggccttttaangggncggncttttcctttncc

SEQ ID NO: 3680 - DNA, 752 bp, Homo sapiens
  misc_feature 2, 3, 4, 5, 6, 7, 8, 10, 22, 26, 27, 49, 50, 336, 369, 393,430, 577, 606, 617, 650, 733, 734, 748, 751: n = A,T,C or G
gnnnnnnnanggggggtttcantctnnctgcagccgttttcgttctttnngcagatcccatcgattcgaattcggcacgagaccaaagctgctggagcctgaggcagagaaccagaggccggaggcagactgcctctttacagccaggaatctcagaggatttgaaaaaggtgaaggacaggatgggcattgacagtagtgataaagtggacttcttcatcctcctggacaacgtggctgccgagcaggcacacaacctcccaagctgccccatgctgaagagatttgcacggatgatcgaacagagagctgtggacacatccttgtacatactgnccaaggaagacagggaaagtcttcagatggcantaggcccattcctccacatcctanagagcaacctgctgaaagccatggactctgccactgnccccgacaagatcagaaagctgtatctctatgcggctcatgatgtgaccttcataccgctcttaatgaccctggggatttttgaccacaaatggccaccgtttgctgttgacctgaccatggaactttaccagcacctggaatctanggagtggtttgtgcaactctattaccacnggaaggagcangtgcccagaggttgccctgatgggctcttgccnctggacatgttcttgaatgccatgtcagtttataccttaagcccagaaaaataccctgcactctgctttcaaactcaggtganngaaattggaaaatnaana

SEQ ID NO: 3681 - DNA, 745 bp, Homo sapiens
  misc_feature 2, 8, 53, 130, 330, 331, 342, 365, 373, 392, 396, 406, 422,423, 425, 439, 478, 479, 481, 493, 495, 502, 509, 513, 518,522, 532, 539, 547, 567, 571, 575, 582, 595, 609, 610, 615,620, 630, 636, 637, 640, 660, 664, 667, 674, 676, 679: n = A,T,C or G
  misc_feature 683, 686, 692, 694, 696, 704, 705, 710, 714, 720, 724, 728,742, 744: n = A,T,C or G
cnaatcgntgcgaattcggcacgagcctgaacctgcccatggagacagttgtnttgagggttgccacacacagtgagggcggagcagggtggctgagggcacaggtgcctgggtctgtcccacggggcanggctttggggctgtgatgctctgggaagccagcttgggtcctgggtctacagagggccctggccccggagcccagccagctctgcctctctcagggcctggagtcctgggggagctcagccagctctgcctttctcagggcctggagtcctggatgaatcctgcaggtttttgggttgcaccggcccagggaggaagccnngggtttgtcangtgggctctcctggaggtcctcnagtggcangggtgacgaggggattatntgangcatctgganatgtatatcctgtggnntnccctgcccctctgnttccgatgaagtgtaccgatgaatgaccttgactaaaanntnagtttgccacananaaaaaangggaggnttantgggnttcnaaaatcaagnaatggtngcaacctnggccttcgcagaatggaaantacnaaanacggggnaagatcctcatgnccatttcccatggnnttggnccagnttttggaggnattctnnggncccggcaaaggccccatttnaaanttnatctagncnggnaccnggnctattncngnctaagggnnttgcncttntccttnaacncatngaatcccttaaatnant

SEQ ID NO: 3682 - DNA, 719 bp, Homo sapiens
  misc_feature 3, 5, 8, 11, 20, 27, 33, 35, 43, 86, 103, 149, 199, 210,221, 227, 232, 239, 240, 254, 256, 276, 281, 283, 292, 295,296, 302, 315, 326, 332, 333, 344, 346, 347, 352, 365, 371,373, 381, 387, 392, 393, 400, 407, 420, 438, 453, 459: n = A,T,C or G
  misc_feature 464, 472, 478, 490, 497, 516, 518, 523, 526, 534, 540, 551,562, 565, 566, 574, 575, 604, 616, 626, 634, 637, 663, 670,672, 678, 683, 685, 695, 706, 707, 712: n = A,T,C or G
gtngnggnagngatcgtganccctctncctttngnccaggcancccatcgattcgcaaagatctaatgagtcacaggatgggggangtttttgggaaaggtcnggattagcagagttgcggcagaaagaagtagaggggaatatcttanaaggcacttggacagaatgggggtgatataaaagatgtatgctgacattntggttttggcncctagaaaatntagcanaaagngagaatnngtgccatacatccngntctgcaccctaatatggaantttgncnttccacacnagnnttcctncacaattaacctntaaggcatttnatgccnntgcctccacancnnggaanagtacgacaaacntcctanangactaganaaaatngcccnnttcaganacattancagtacgtgtggntagaactaaaatggctcncaggctcatactggnagtgancaggnatgcaganaaaaangaaaacccccangtgtcantgactgtgaacaggcctantncagangcncttattgngcaatngcccttaaganattgccccaanganncacctgannaccccccggaattgccggaaaagaatacngatgaggagctnacgcttatgngaagatgnatnaaccctatgttcagtgtaaacggggntacaatncnccaaanagcgnanctcaagaacnagccttcccgnnaggcnatcccaa

SEQ ID NO: 3683 - DNA, 786 bp, Homo sapiens
  misc_feature 2, 6, 8, 16, 23, 31, 37, 41, 51, 95, 100, 101, 381, 385,391, 392, 395, 412, 439, 454, 465, 509, 525, 536, 590, 618,633, 643, 644, 664, 681, 738, 741, 748, 762, 766, 770, 771,772, 781, 782, 784: n = A,T,C or G
cngaangntgtgatgnatgtagncgttcccnaggaanccangcgattcggnttggcgaattcggcacgagcccaggtgtctatccacttgctagnatttnntcatgagagttagataccagttttctgctggaaatacagaacatttcctgaaaccgtgtggttgaggtgaaacaggcattttgcagtcttatattttgagtaaggccaaacctgcctagtgttataaaactagacaaaaaacccaggtacccggtcttgcaggatagaaatgtgtgactaaaatgaagcatcgatctgagaagactacaaattagcgggaacctttggacaggagcatgctatacattacttagattaatgttgatatttaaggagccangatnttgatnngtntttgaggggtgcccatntacttcatataagaggctataaactgnacttctttcagttantgcttaatccnagctcaaacaagaaataattgcttattccaaagtagacattggnacatctttttctaggnacgtaatctgngatgaagtctgataaagctccttaagaaattcttatagtacaccctcacaagantgtattcatctacccgtggtttaaaccngaaaattaaaaattntaaccctcgnnggagaaaatttaccaaagtntttaatgggtttcaggncccttaattaaaaaaactttttaacccctggccttggaaccctttaaaccttaattnatnggatctnaaaaacaaatgggntttnttgnnngaaaagtcnnanct

SEQ ID NO: 3684 - DNA, 739 bp, Homo sapiens
  misc_feature 8, 24, 29, 30, 31, 90, 92, 279, 298, 300, 333, 342, 384,477, 480, 481, 487, 590, 648, 657, 660, 676, 682, 712, 729: n = A,T,C or G
tttttggntgtgtggtcgccctcncctannntgcaggatcccatcgattcgctggaaggttactgcaaagacagcctggtgaaattgttntnagtacagaggctttaatgggttctttgaggtcaggtagaggttatggggggagcactacagtgagcatatacccaaaatgaagccagacttccaaggtacgttctcactggagagggagcttaatggtaaagtttaaactttaagggtttaggttttagattaaggcccaggagatccaaggggaangaggagggtaggaaatcananataagaggagctgttgtcatcgcaggtatagtnataattaanatatgttaaactttcataggattttgcatttatttcatcagnttttttttctagattcttaaatctgcatatatctaaatcttataaatttggggaaatgtacacatttacatggtacatttcactcaattttanagnntggctnttcttgtgaaatagaattaaatatatgtgagtaaatcaagacccctaaccatcattaatgtattatttggttatttctggccaaggcccttcttgattctttnaaagtgtgctaagcccattttcttcattacatccctcttattttttgtggccaaattnactaaaatntangtatcttttggtggantttcanatttttgaaacctaccttgttttgaaaatncatcttttaaaaacctnttttccaaaa

SEQ ID NO: 3685 - DNA, 767 bp, Homo sapiens; identical to SEQ ID NO: 545
  misc_feature 3, 8, 22, 27, 32, 37, 73, 92, 93, 95, 108, 156, 157, 225,263, 266, 326, 330, 350, 372, 386, 395, 398, 422, 465, 468,476, 485, 489, 503, 505, 513, 527, 528, 536, 546, 548, 550,553, 554, 561, 562, 564, 565, 569, 578, 587, 588, 591: n = A,T,C or G
  misc_feature 602, 603, 608, 645, 660, 674, 687, 688, 692, 696, 709, 715,721, 740, 762, 766, 767: n = A,T,C or G

SEQ ID NO: 3686 - DNA, 873 bp, Homo sapiens
  misc_feature 14, 28, 43, 92, 179, 187, 193, 196, 204, 243, 258, 263, 276,285, 290, 297, 302, 303, 309, 312, 320, 347, 358, 366, 378,380, 392, 416, 439, 442, 444, 457, 460, 468, 469, 486, 490,517, 529, 537, 542, 552, 570, 571, 580, 593, 596: n = A,T,C or G
  misc_feature 602, 613, 621, 632, 635, 636, 638, 648, 652, 669, 676, 677,684, 685, 703, 711, 712, 716, 720, 728, 744, 750, 754, 763,765, 767, 768, 776, 777, 780, 781, 786, 794, 801, 802, 816,817, 818, 821, 823, 825, 839, 845, 846, 848, 855, 857: n = A,T,C or G
  misc_feature 858, 859, 860, 861, 872, 873: n = A,T,C or G
cgtacggaactgancgggaaatccctcnctgcaagcagcccangcgacgcgaattcggcacgagacctaatttttgagaacagcaagccctntttgaccactctcttcagcctgtgtgttccggctgttttgaagtaatcaaatgctgtgcatggtattttacctgagctgcaacctgntatggacntgaacntcnggataagntgaaagcaagagtccctgagtataaaggaaaaacagcanaacaaaaagcaaacnagggncaaccgcgaaagnctaaaaagncccantggtgangcccnntaaaanaanctagcttncagctgtcaggagctaatactctctgnaggaattgganatgggatnagggcgaacaananagggtgtaaacngtggagctggcatgagtactgcangcaacctgaagagacttttaacntantnaccacagctattnatnatgcggtnngcaacaaaccagcaacnatcnacaagcgtcataaagaagttcagactntgaacaattggngaaaggtngattncagaacccgnctgcaaaaaagccatcanncaccataantaaaaaagaaccncangaacanggggaaacccngtgggaanaaaggaagtanaanntngccacctcangttnaaccattaaaaaccctnggaaaanntggccannagggaaaccccttaaaangcaaaagnncctnggcnaaaaaaanccccggggaatttaancccaangggncccaaaggntnanntggggccnnaannggggnaaaaaaangggggcnnggaaacccccaggnnnaantncnaaaggggaaaaagnaaaaannanggggggncnnnnnaaaaaaaaaann

SEQ ID NO: 3687 - DNA, 777 bp, Homo sapiens
  misc_feature 8, 9, 12, 15, 26, 28, 32, 38, 46, 50, 53, 56, 57, 58, 66,528, 566, 601, 611, 618, 621, 623, 624, 636, 638, 639, 652,654, 658, 659, 660, 663, 665, 671, 681, 683, 687, 689, 691,696, 698, 701, 702, 706, 707, 709, 710, 711, 712, 715: n = A,T,C or G
  misc_feature 721, 725, 728, 733, 734, 735, 738, 742, 745, 754, 756, 759,765, 770: n = A,T,C or G
tgggtttnnggnttngggctttcttnanatgntgtaancgctgctngccncancannntggctggncgaattcggcacgagaaatggggggtgttcttcatagtggatttctttttttaaacataccatctttgtgtatatacatttctctggaaatgtttgtgaaaaggtaaagataacttccttagtgtaattgtgttgaagtggaatgtttctagtgtttgtgaagatatcaattgctggctgatattttaagctggatgaaaaatgtgggtgaagtaatcttaaagggtgatagatttgatatgagaaatttaaagtaatgtgctcagtgcgtagtggtgataaaagaatgtagcctacttgttttccatagactatatttcatcattgttgcataaagtcccttttggccaatttagtgaatgctgctgggtcttcaggaaagaaaatcgtttgtctttaaccagagaaataattgtggggatagaaagtagtctttttcttgatgataaaaattcattttanctttttaaattacagtggtaatagcttgtagtaatagnggtaatatccttggtttttggctaatgatttttantgtgctcccncttaatnttntnncgaattattttnanngtgaccaaacccntntatnnnacntngccttnaacaaatccncncttnantnctctncnccnnaaanncnnnncanctcccncctnccnccccnnntcncctnacncaccccccncnccnctctcnctccnccccccc

SEQ ID NO: 3688 - DNA, 892 bp, Homo sapiens
  misc_feature 2, 12, 13, 14, 15, 17, 18, 19, 24, 31, 36, 39, 40, 63, 64,66, 67, 69, 71, 73, 74, 97, 308, 386, 387, 392, 412, 416,417, 422, 439, 449, 478, 531, 534, 554, 557, 563, 567, 568,577, 579, 580, 589, 591, 593, 597, 619, 620, 622, 624: n = A,T,C or G
  misc_feature 626, 636, 641, 643, 647, 665, 676, 690, 709, 710, 712, 713,718, 719, 721, 730, 733, 734, 738, 749, 754, 758, 761, 770,787, 789, 790, 799, 811, 814, 816, 825, 835, 844, 848, 856,859, 865, 866, 873, 880, 883: n = A,T,C or G
tntagggccttnnnnannngggtntttcttntccantannccgtgtggtctcgttctttctcnnannancnanncttgtcgctgggctcaggcaatncacctgccttggcctccaaagtgccgggattgcaggcataagccactgtacccggccccaactaatttttgtattttttgtagagatggggtttcaccatgtcggtcaggcttgtcttgaactcctgagctgaagcaatccacccgccttaccctcccaaaggtgctcagattacaggcttgaggcactgtgcctggccatgggtgccatntatctaaagagtgatgaacttggtgttaaaccagtaattgaaatcaccaaaattcctaccatcatgagctcagtctanntggangagacagatgaaccaattangcanntctgntgaattttggggttcancagtgcccanaggtggggtgtagtgaagaggaatgccanaattttggagaggtggagcacacgacccacgggtactttctgaggatgtaacncanaagtcgtgatcagaaagganganaggganacanntggggaaantnnctgggaaanancngtcnattccaggcagtcagcttgctnnancncnttgggccttnctttnanaacnccctttgcctttggaatnccttgaacccnaagttttcaacttnaaaagaaattcctttgggnnanngaaanncntatatcacnctnntatnacaaaaaaacnttccnaaanccncttttttanaaaaccttttttccctngnnaggtccccnaatttttaaccntangnaattccccntaacctttgntatttaagnattncccatttnggnatcaanntttctgnggaaccnaantccccccct

SEQ ID NO: 3689 - DNA, 768 bp, Homo sapiens
  misc_feature 2, 3, 4, 5, 6, 8, 9, 10, 11, 14, 16, 17, 18, 19, 20, 21,28, 32, 33, 44, 62, 76, 80, 81, 589, 679, 680, 682, 683,684, 720, 729, 744, 767: n = A,T,C or G
gnnnnncnnnntgncnnnnnnggggggntttnntttttccaaanggcgtggaactcgttctntccgcaacagcccngcgnntcgcttcttctcaactctctgattgcttatataagtgacgtcttctgaaggaaagttcagcattttttctcagatatgataataatatatgctaagatcttggccaggcacggtggctcacacctgtaatcccagcactttgggaagccaaggtgggcggatcacttgaggtcaagagtttgctgccttcaaatcaatcattacttcttagcacctcttgaaatagaaaataaaaaatttggccaggcggtggccaggcgcagtggctcatgcctgtaatctcagcactttgggaggctgaggtgggaagatctcttgagcccaggagtttgagaccagactgggcaacacagggagacctcatctctacaaaaaagaaaaaaaaaaattaattagccaggtgtggccccatttgtacaaaaaaaaattttttttaattagctgggcatggtcatgtacacatgtggtcccagctactagggaggctaaggtgggaggaacgcttgancctgggatgtcaaggctgcggtgaggtgtgattgcaccactgcactccagcccagcaacagagaaagaccctgtctcaaaaaggaaaaannannnaaaaaaactcgagcctctagaactttagtgagtcgnattacgtanatccagacatgatangatcattgatgagttttggacanc

SEQ ID NO: 3690 - DNA, 905 bp, Homo sapiens
  misc_feature 8, 21, 25, 34, 38, 42, 46, 62, 65, 69, 70, 71, 75, 357, 452,472, 521, 525, 528, 532, 544, 552, 557, 560, 562, 566, 567,571, 572, 574, 596, 598, 607, 616, 617, 619, 621, 622, 623,626, 633, 644, 649, 660, 661, 664, 669, 671, 675: n = A,T,C or G
  misc_feature 677, 681, 686, 703, 707, 708, 710, 712, 716, 717, 721, 726,727, 730, 731, 741, 744, 745, 746, 749, 761, 762, 764, 765,769, 773, 778, 786, 787, 798, 801, 802, 806, 809, 810, 813,814, 817, 819, 821, 828, 831, 835, 836, 843, 846, 847: n = A,T,C or G
  misc_feature 849, 851, 854, 856, 864, 865, 869, 877, 885, 889, 892, 905: n = A,T,C or G
ttggggtntttaggtgtgggntttncttttttcnaatngccngggntctcgttctttctcgnagnagcnnngcgnttcgctcaccaaggaacacaaataaacagttgatgaatccatcacatcagtgatgaatccagaatgtgtccatcattttcgtaagtcttagtatgcagagaatctcagatagcaaagcagaaaggatgatgtcacagacgccttgggtacccagcacctggatgcagctgtttgtacacacatactttctgatattatgttgacagtgacttacaccacttcaacctcaggcaggattctatcagtttctttactacagattgatttgtttctttaataatnattgtaattactgtcagtaaaaatctgagtctgactcagcaattagttgctggtaactgagtgtgttgtaatgctggggaaaggatataaaactngtattttgaacagaaaggcncacatgtgggtgagcagtgtttaccaccacagaatttccgtcttcacanaatnganatanctgcacatgaangtatagtnagcantgnangttnntttnnanaaagtaaaagttaaattacccntnataagcctnctggatttnncngnnnttngttctgnatttcctcctntgccnccttcaaattnnaantttananggtntncttnttctnctcaatatctctccccnacanntntngttnntgcnctgannccnnatctcttccntcnnnccngatggtgtatgnncnnggcnattncttcnacccattnntatcttatctntcnnatcnttnnatnntcntntncctcatnggnaacnnttacacnttnnangnttntngggccatnntctntgttcatntgtggggntctnagnatctttttctaan

SEQ ID NO: 3691 - DNA, 774 bp, Homo sapiens
  misc_feature 4, 9, 13, 19, 56, 72, 600, 677, 679, 684, 686, 687, 688,690, 696, 699, 701, 702, 703, 704, 706, 707, 708, 709, 711,714, 715, 722, 724, 725, 727, 731, 734, 737, 740, 742, 743,748, 749, 750, 752, 753, 755, 762, 768, 772, 773, 774: n = A,T,C or G
tggnttttnaggngtgggnttcttttttactaatggctgggctacttgttcttttngcaggcatcccatcgnttcgatctgaaccacatgaagttgagtaaaaaaagcaatttgcagaaggatacatacaaaatgacaccatttatatagtagactgaaagcatgcagaacaatccattgttgtttacgtgtgtaacagtcataggaatgacaaccactgccttcagaattatggcgacctctgcgatggaagagaatgggatcagagaaggatacacaataggctttaactgattttgtgattattgatattagaaatgtttaaaattaagatattaacatttcatgaagctgagtggtgagcacaccagtgttatattctctctatataactttgtgtatatttgaaatgttttctcataaaaagtatttaagcaagtttaggaaagaatattgataaatgaaattggtagagaaccatgaaattacatagatgcagatgcagaaagcagccttttgaagtttatataatgttttcacccttcataacagctaacgtatcactttttcttattttgtatttataataagataggttgngtttataaaatcaaactgtggcatacattcttctatacaaacttgaaattaaactgagtttttacatttcctctttnanaaaanannntnttaccnttntnnnnannnntntcnnccccctncnntntccnctntcnctncnnttctnnnannanatccttnccctcncttnnn

SEQ ID NO: 3692 - DNA, 806 bp, Homo sapiens
  misc_feature 9, 10, 11, 28, 29, 31, 36, 45, 47, 49, 51, 65, 66, 71, 122,127, 372, 432, 466, 467, 471, 500, 514, 559, 573, 575, 607,608, 620, 637, 639, 642, 650, 662, 666, 669, 672, 673, 677,682, 691, 692, 693, 694, 697, 698, 714, 716, 717, 719: n = A,T,C or G
  misc_feature 721, 724, 725, 726, 727, 743, 746, 751, 753, 755, 763, 766,773, 776, 782, 788, 790, 792, 793, 794, 799, 804, 805: n = A,T,C or G
ggtttttcnnnaggccggtttttcctcnngnctctncctgccccngnancnccctctcgccgaannagctnggcggtgggcgatttatttgccctatttcctccatgtacggagacattacnttttntgcccagtcagatttttttcatgctatcttttagtcagatttaatttaatgtgtatttctagtttattgcttctgccatgttttattctttatgaagatccccgagtattgagtgtgccagttaccagattctctcccagctctaaattacctcttcattacttgatctgcaatattggagcctaaccctttaggccaggggtgtccaatgtcttggcttccctgggccacattgaaagaattgncttgggccaatgtggactctatatggtataaaggagtatgtaaactgtggagagaagtanggctattttctacagcagtggtcttcaaattttnnaatngggtaccttaccagaaaacatttgaatanaaaacctcaatatnagtatgtcctaattataaatcatatgtataaatatatatactatntcggcttatatagngntttcaagtctgcttatgatgtaattatatgtnncagaacaatttnaatatactctttttccngntcnccttcaancggtcaatcccnttgnacnggnnaccnacttnccttcatannnnctnncttaaccagtgaaagntnnangnctnnnnaaaaacctctttcccnaanataancntngccctccnttncccattncantcggcnaaaccnancnnnattgnccccnnc

SEQ ID NO: 3693 - DNA, 758 bp, Homo sapiens
  misc_feature 5, 6, 7, 8, 9, 10, 11, 13, 14, 16, 21, 24, 28, 33, 35, 46,57, 64, 495, 507, 605, 618, 677, 683, 687, 691, 692, 698,699, 700, 713, 718, 727, 730, 734, 741, 746, 749, 757, 758: n = A,T,C or G
tggtnnnnnnngnngngggtntcntttnttatnanggctggactanttgttctttcngcagcancccatcgattcgaattcggcacgagataacgcccgtggtgccccatccctataggagctggtgagattgcagcctgctgcctcccctccatcagccacagctattggatttcccacccagaatctttaggtaaatgagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggnagggacggcggngcagctcctctacagcaacttgcagcatctgaagtggaacggccagtgcagtagtgacctgttccagtccacacacaatgtcattgtcaagactgaanaaactgagccttncatcatgaacacctggaaagactagaactatttatatgacaccaactatggtagcacantagcanagtnaccnnatttgnnnaaggagcatgacnccctnctgatttcnaantcangtgatgnaagcntgngaagtgann

SEQ ID NO: 3694 - DNA, 829 bp, Homo sapiens
  misc_feature 7, 9, 11, 17, 18, 22, 48, 56, 66, 70, 72, 73, 90, 95, 105,120, 122, 146, 161, 182, 183, 232, 254, 262, 275, 288, 300,311, 318, 319, 321, 328, 344, 349, 350, 363, 378, 390, 391,393, 398, 407, 408, 414, 418, 424, 435, 458, 470, 471: n = A,T,C or G
  misc_feature 473, 476, 494, 495, 496, 505, 520, 534, 540, 544, 552, 553,555, 556, 558, 560, 565, 567, 571, 582, 584, 585, 591, 596,603, 604, 615, 621, 624, 625, 626, 631, 632, 642, 645, 646,647, 652, 654, 656, 657, 670, 688, 690, 701, 708, 720: n = A,T,C or G
  misc_feature 723, 727, 729, 731, 742, 744, 759, 761, 764, 772, 773, 779,780, 784, 787, 788, 802, 803, 805, 821, 825, 826, 827: n = A,T,C or G
ttttccntntnggcctnnatanggggcttttctaatccagatactggnctggtttncgcacgcatnccancnnttcgaattcggcacgancaaanacaagccttnatggaaaaggaaatncnctcccctccatgtatatggatgangggagcagcacaagncacactcccaccatcctcacnnaattcctggacccatgcggtggctccgtgagctgggtgactccagcctnacctgcacaccccaaccctgcncggggccnttcttcctaccancatgccctcggtnagctaggaattnagatccctgcntgtgaannanggaactnatgtgcacagaatccncaggnntgccatatccttnggcatgatttagatnaagtcgccctgnntncagantgaccccgnngctctncagngagttntcaagccccangaaatcggccttggatgctctcnttacaagacagnntnacncctgggccctcgtgcatnnncttcactgnccccctggatccccncattacccccaaangacagngggnaaacacanngnnanancacancnttgncccctccagcncnnttcacnggcancttcttnnattcaccccgnttcccnccnnnacctnntccccccaanccnnnacaancntnntccccaactacangcccccttttccttgggngnaaaatgctccnttggtancccagttataanaangccntncngcccccctcancntgattctcccgcatncncanacccctanncccaannattnaannaccccaatcccccnnanaaaccctcctttccancttnnnct

SEQ ID NO: 3695 - DNA, 847 bp, Homo sapiens
  misc_feature 1, 6, 7, 9, 10, 11, 12, 13, 14, 17, 36, 37, 49, 52, 54, 56,57, 60, 62, 64, 66, 67, 70, 167, 195, 200, 208, 234, 300,312, 351, 359, 381, 384, 401, 474, 477, 489, 501, 504, 514,531, 532, 533, 534, 547, 549, 561, 570, 576, 578, 589: n = A,T,C or G
  misc_feature 592, 599, 601, 602, 614, 624, 632, 639, 651, 652, 653, 655,658, 664, 665, 672, 675, 676, 678, 683, 697, 698, 700, 701,709, 712, 714, 716, 718, 720, 730, 731, 739, 740, 751, 752,755, 757, 758, 764, 766, 774, 777, 780, 792, 796, 797: n = A,T,C or G
  misc_feature 799, 802, 809, 811, 814, 815, 816, 817, 819, 820, 833, 836,843, 845: n = A,T,C or G
ntaggnncnnnnnnagngggctttctaatttactannggtggactagtngtncncnnaanancntnncgntgtcgaattcggcacgaggggtgacttcctgtgacctccaaaggaagtctcagctctgctagaatgggaccaaagcccagctccaccttgaacttgngtcatagccttgcttcttgttccctctncttanccgggcanatgccttgtcctttgataaaggcttnctgtcaccttctgagggctcttgtgctttttgcaggtggatgccattacctttaccgctgagcctnccgcaattgctntgttcacacgctgtccgccatctgcctgcaagggcccangcagggtnttactcatcattatgtcattgnttnaatagaagcctaatatnttgtacatagtagtcaggaagcccagaaaattgggtatgttctatagatttaccaccattgcttattgctgtntcnctttaataaagnttaacgaaagtnaancaaaccacantaccccccaaagacagnnnngggaaacacactngnggaaagccccancatggcccnccttcnancccccttttanggnactcttngnnatcaacccgggntacccgtccnccacttgntgccccnacccactccagnnntnttnccaaannacaaccnttnntntcccntgggggaaaaatgnntnnttggggtnccncngntncnaaaaaggccnnaatgggtnntcttaaccttnnttncnncatacnantccccacnacnttnaccccaaataantcanncnacntcctaancncannnncnnaaagccctttctncanctacttntnct

SEQ ID NO: 3696 - DNA, 765 bp, Homo sapiens
  misc_feature 2, 6, 8, 9, 14, 20, 36, 41, 291, 392, 398, 402, 416, 425,432, 544, 635, 656, 688, 692, 713, 715, 720, 724, 740, 744,756, 758: n = A,T,C or G
cngttncnnaaacngtctgnggaaaagccccctttntgcangatcccatgcgattcggcctcatctcccactgagcaggtgccatcccaggagatgcttttggtggcgagaccttcccctcctgtgcagtctgtgtcccctgctgtgcccacacctccctcgatgtctgctgccctgcctttccctgcaggtggtatgggaggtggcatgttctaactcctagactagtgctttacctttattaatgaactgtgacaggaagcccaaggcagtgttcctcaccaataactncagagaagtcagttggagaaaatgaagaaaaaggctggctgaaaatcactataaccatcagttactggtttcagttgacaaaatatataatggattactgntgtcantgtncatgcctacagatnattcatttngtatttntgaataaaaaacatttgtacattcctgatactgggtacaagagccatgtaccagtgtactgctttcaacttaaatcactgaggcatttttactactattctgctaaaatcangattttagtgcttgccaccaccagatgagaagttaagcagcctttctgtggagagtgagaataattgtgtacaaagcaagaagaaagtatnccatttatgtgacaacctttntgggaataaaaaatttggtttaaaagttaaanaaanaaacaaaaaaaaaaaacttcnanccctnttanaacctttaggggaggnccgnaattaccgtagnancccaaat

SEQ ID NO: 3697 - DNA, 765 bp, Homo sapiens
  misc_feature 4, 5, 12, 13, 33, 34, 51, 56, 58, 62, 63, 65, 69, 70, 465,662, 765: n = A,T,C or G
tttnnaaggggnntaagtgggtcttctttcaannggccgggtctcgttctntccgnancaannangcgnntcgaattcggcacgagcgtctacatccaggcctccgagtgacggacctgaggtgtctgtttcctgggcaggcctgatgctcctgtttgggtccagggcccctgggggcagaccggtgatccttaccagtggaagcgagccatcgagccattggcagaaatcctgctgaatgtcattcagaaacctcagcccatggtcgccctcctgtgcccctctcctgccggaaagccctgcaacattctagggttgggggcagggccatccacggtttctgggcagagccatggtggcaggagagagatggctgaagcctgagcagcccagagtcccgctggtctaggctggtggtcggggcccctgggagaggagacagggcattcctccccactctgtctncaggctgcctctgggtagcctctagtctgctgttcttcaggaggcctgccataaactcttcggagtttacgtgttgcaccttttcacagacggttccccacagcatcctcagacagctctgtgatgtagcttttaggaggcactcaggtgtcacggctagactgcagctatgagacagatctggcttcaaatccaanagttgccatgcacttgctgtgtgaccttgggcaagtcacttcactttttcttgagcccccgtgttccttcatctgtacaatgggggcttacgatacttactan

SEQ ID NO: 3698 - DNA, 785 bp, Homo sapiens
  misc_feature 2, 3, 4, 7, 8, 9, 17, 18, 45, 56, 58, 62, 78, 79, 85, 86,223, 264, 267, 271, 280, 281, 325, 344, 408, 412, 438, 503,504, 513, 525, 531, 533, 534, 540, 550, 590, 601, 603, 604,624, 629, 633, 637, 639, 645, 647, 648, 652, 655, 663: n = A,T,C or G
  misc_feature 664, 672, 673, 681, 683, 693, 694, 695, 703, 705, 712, 717,718, 721, 726, 730, 739, 743, 744, 745, 748, 751, 755, 763,764, 768, 772, 779, 782, 784: n = A,T,C or G
cnnntcnnngtgttggnnttttgtggggtctttcctttcttaatnggtctgtgatncncgtnctcacctaacacaacnnggctgnngcgaattcggcacgagaggatgttgctgctgtgggccgcaagggtcttggtagcttcctctagggcaggcttgtgttcctgattggggttgggatgggtgggggcatcccctgtggcctcagcaatccagccctgcncatctgggtcccattacacagacgtagacattgaggtctanttngaangacttgccnngagtcctgtaatagagcttggcacttgggtctcttgactctcanggactgggtgtgagggaantgggctccttttgctccctacctgcagtgcctttgaggggatgagggtcttccatcatagttcngaanatgacctgcacattttactgccttanaaatctgctcgttggggccaggtgtggtggctcacgcctgtaatcccagcactttgggaggccgnngtgggcacntcaccaggtcangagacngnnaccatnccggcttacngggtgaaaccccatctctctaaaaatacaacaaaaattancctgccatggngnngggtgcctgcactcccactnctccngaangctnangcccgnannaatngcntgaacccnngaggcggnntcttgcantnaccccataannncgcccccngnactccanccctnngancacanaaanagacttccncctnnnaanaanacanctaatccnnaacnccanccctctnaancnt

SEQ ID NO: 3699 - DNA, 787 bp, Homo sapiens
  misc_feature 1, 2, 4, 5, 6, 8, 10, 12, 17, 18, 19, 20, 22, 25, 28, 32,33, 51, 57, 59, 64, 65, 69, 73, 74, 76, 77, 81, 88, 89,358, 453, 514, 518, 529, 533, 534, 605, 610, 661, 671, 672,688, 701, 720, 732, 743, 746, 747, 750, 751, 753, 765, 783: n = A,T,C or G
nncnnntntntnatggnnnngnctnggngggnnctttcttttcttaaatgntgtggntnctcgnncttnctcnnannagcntggcggnngcgctttgggatctttagatgaatggtatcatacagatgtgtattattgctaattctttgttctcaatcacttgttttcaaggacactaaaatccatgtagcccctaaaaaagataaataagggcaagtcacttttcttcctccagtcacagactaaagaaattatttcagataatatatagcccttcagccatgggagcaggaagtgtttactgctcaagtcagggtctcagttggtaaaataaacggaaacttctggtttagttttngggccttctttcaaataaaaacttcattttctctgggcaaatacattgatttaattttgtattattggtaaaatattcatcaagtcacggtcagnctttacagagtaccaaaacataactttgccgattttttctgtttaagggccagctaggttngttnaaaaagaaaancttnnagccaccaaaaagcctatggcatttctttctcttatgatctttaaaactggttcaagctcatcctgtttgngagtnatttaggtgtgtccctctttgaaaatgggcccccataacacttttttaatnggataaaagnngagaacatggagtcanaatggagcaaaantctgaatatttcacatggnctaaaccctttntttaaatcaanggnnaannanaacaaagttgcnaaaaaagcccaaaacatnattt

SEQ ID NO: 3700 - DNA, 765 bp, Homo sapiens
  misc_feature 5, 7, 13, 38, 48, 52, 53, 55, 60, 64, 66, 355, 390, 403,409, 476, 513, 518, 550, 569, 596, 615, 619, 622, 630, 667,672, 677, 686, 703, 710, 716, 719, 722, 736, 738, 739, 745,750, 756, 759, 760, 764: n = A,T,C or G
tgtgntncggtangggggtcttctttccaggtgctggntatcgtcctntccnnanagccnggcngntcggtctcgctttgtgacgtagcctggtcttgagcgatccttttgccttggccttgccaaagtgctgggattggaggcatgagccactgcacccacccctgttttttatttaagtaaaccattataataactcatttataaaaaggttacttcaagagggctttcaacttaagaattattttcattttgaacatgaaaagttaaatagtaactaagaaactgagaactctgacagtgacctctaataggtaactttaggcaaaagtagacaagtttgtgggtattttgntgttcatgttaaaaggcacctgtacaagaatcaanatatgaatctagntcgtanagggaaggtcttatgcaaataccaaatcatacaagtggttacacatataatagatcatttggtccantaaaagtgggttcagcttgtttattccctacttttgntatcntaaaaacaatgattttttgcatgtaatagaangctttcacttaagatgctnttgagtgaatcagtgaggggttcttanagttagtattcattaattnaacntanaatattanctaaacagttttgggtcactgcaatgcatggtctatngaaanactanatgtttcgnctgaaatatgcttcaantgttgcnactatncanaanggctttttatgttntnnaatttnaaacntgccanttnnattnt

SEQ ID NO: 3701 - DNA, 794 bp, Homo sapiens
  misc_feature 1, 4, 18, 19, 28, 32, 40, 55, 60, 379, 395, 400, 589, 600,634, 643, 644, 650, 663, 665, 670, 677, 681, 682, 688, 689,691, 700, 701, 708, 709, 722, 727, 728, 730, 732, 741, 749,759, 761, 764, 765, 793: n = A,T,C or G
nagntttttttggggggnnctttctttnggtngcgctggnctacttgttcttttngcagnagcccatcgtattcgaattcggcacgagattcaagatgagatttgggtggggacacagccaaaccctatcggttgccaacatttacagtaacagtgttaggtgaacagttgtccagtctcctgttttgtcggacactgtttctagcaccttccaggcagaatctcatgtatccttcactttcgaaatgggtactatttcatccccacttttatcaatgagaaactaaagctcgaagaggtcaagtaagttcctggccaaggtcagctagcaggctctagaggcctcgttctccttagaggcagccttgccagggcccangcttggcaggctgcanggcangtgcgggcatgcccatggtagaggtgggaccattgaggctcagagagggtaagtgatgagccctggcgacacagcggggtgggtccagagtccggcctgcatcttctggagctggccagtggacaggcctttcccgttcacagccccggggctgctgtgcccaccaaggcggatgtgcctaccgaatcncactcctctgngtgtgtcccttttcaggcccctacatcattcganggaatggcnncccccnacgacttcccttncnaccantccaccntttnnttacanncntacttccannccccagnnctcttgtaaaagncccanncnancttccctanccctggantttttacccncnttnnctcatccacccctcttttctcccccccnt

SEQ ID NO: 3702 - DNA, 830 bp, Homo sapiens
  misc_feature 5, 22, 23, 24, 25, 26, 27, 29, 30, 31, 32, 55, 56, 59, 65,70, 71, 127, 137, 138, 174, 194, 208, 222, 245, 249, 252,254, 258, 268, 269, 271, 272, 292, 293, 295, 300, 306, 315,316, 324, 333, 335, 342, 345, 351, 367, 369, 370, 376: n = A,T,C or G
  misc_feature 378, 379, 385, 386, 403, 404, 406, 428, 431, 432, 434, 435,457, 460, 462, 463, 469, 473, 474, 478, 480, 497, 500, 503,504, 513, 523, 525, 526, 528, 529, 540, 544, 551, 553, 560,563, 564, 565, 572, 592, 593, 605, 610, 611, 620, 631: n = A,T,C or G
  misc_feature 635, 656, 657, 658, 663, 673, 682, 686, 687, 690, 691, 694,696, 698, 699, 700, 702, 704, 710, 723, 724, 727, 728, 729,735, 736, 738, 742, 748, 751, 753, 756, 759, 766, 769, 792,793, 797, 801, 809, 810, 812, 815, 822, 826, 828, 830: n = A,T,C or G
tgggntttaggcgccgctttcnnnnnngnnnngctggcggacttgtccttaatcnnaanagcccntgcgnngtcgaattcggcccgagcaagcagaaatgtgggtggtgtgactggggtttggtgangggctgctgnngctggaatggagggctgccacattaatggaaatggnaaatgaggcacgtaaggttngactggaggcatancgcccatgttgccngctttattaaatcactcttgcantatncananctanggcctgatgnnannagtgactgtgtcttgcactnntncaacntacagngggatgctnnaagaatgngcactgcananaggactngtnctatantaaccatatgtatgcntnncgtaanannatcgcnngctgactatctctaatnngngcggggaacgtgatcacattcncgnncnnttacatggaggctcctctcccngangnntctaanctannagangnccatgagtatgaaacantgnctnncaccacttnaacttacccnanntnncccaatatctnttgnctagctntngattctntgnnnagccttnactggaccctacttagacanngcctttcacacnctcannaacgattcntgtagtaaatnctantaacgcttccccctacacctnnntatgnatttatcgcncctctattncttnnccnntcncngnnntnantgaacnttacctccccttnnaannntccgcnncncttncaaccnttnanttncancatttcnctnatccttctcaccggggcattttnntctngggntccgggtnngnttntactcantgcnantn

SEQ ID NO: 3703 - DNA, 759 bp, Homo sapiens
  misc_feature 4, 5, 18, 26, 30, 36, 42, 43, 46, 52, 58, 59, 64, 77, 78,600, 666, 669, 690, 698, 701, 702, 703, 704, 705, 711, 713,718, 720, 724, 725, 727, 728, 729, 732, 734, 737, 738, 742,744, 750, 752, 757: n = A,T,C or G
tgtnntttgttgggtgtnctttctancatncggggntctcgnnctnccgcancagccnngcgantcggactgacagnngtgccaacatggcattctgtttttgaaaagttacatgacactattaagtattgaaaatgttctaactagaaaaacgattttcttaatcatagtttttattgtggggtgtgtatgtaagttttaacgtgcaaattaacatatagaagtcactttgtgaggtttcatttaaatgtatttctcagattttgctgaatctgtaatagccattgaaatatttaagtaccttggctgttcctggcatcaataaacagatttttctttccctcctcatgccatacaaaagttgacaatagctttatcaccacaggaagaaagctgaccatcattgccctttatttgggcccagttgccatggttacagccctttagctaaattgggaatggtaaccaaaataacatttgcataacattcccttgttctgcccacctctttgcacatcttcaaatcaaggttttggtctgatcaccatactatgctgtagcctacttttaggaagtactttaggctaaatagatttgttncatttatgctaaatgctctcctggacactaccatactcagcatattcctggaaatctaacgcaatnatnttaccttttaaaacacccggnctccaacnggnnnnntacctntnacccncnctgnncnnnatntnttnncctncnttatcnantaaangc

SEQ ID NO: 3704 - DNA, 765 bp, Homo sapiens
  misc_feature 1, 9, 12, 17, 21, 25, 26, 35, 40, 41, 42, 43, 47, 95, 324,585, 599, 618, 636, 642, 655, 677, 700, 715, 720, 724, 731,756, 762: n = A,T,C or G
ntttaactnacnggctngganaccnnttctgcagnaagcnnnncggngcaattcggcacgagattctcttagtgatgggctggaggaagtttttnaaagcagaaatgaaagcttacatggaattagtcaacaatatgctgttgactgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttanaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctgcttgctttctgtaggagaattgaacagcactattttgaagatcgtggtaaaggcaggctgtcatagagtatgtgttaagtctcangagtcttaactttnggaaatatggttttacttnaatgttacattagatatngggtgntacgaatttttanaaccaaattactggctttttgnaaccttcaaaatattataatggnatcttaatggaatgngcctntaanattgggnaatttggggtattacaattaaaaanaaaatnccg

SEQ ID NO: 3705 - DNA, 757 bp, Homo sapiens
  misc_feature 4, 12, 14, 178, 199, 205, 226, 232, 244, 261, 279, 284, 290,294, 311, 316, 334, 335, 352, 353, 367, 383, 389, 400, 408,422, 423, 429, 432, 440, 445, 476, 480, 485, 508, 510, 527,539, 541, 569, 573, 576, 583, 607, 609, 612, 615: n = A,T,C or G
  misc_feature 624, 627, 642, 664, 667, 668, 669, 673, 685, 690, 694, 704,705, 723, 753, 756: n = A,T,C or G
gaancagctctntnctttttgcaggatccctcgattcgaattcggcacgagagttgctgtcagtcttggtgtggaaaggagacgcatctatgacattgcaaatgtgctggagtcgctgcatctggtcagccgggtggctaagaatcagtctggctggcatggacggcacagcctgccnaaaaccctgaggaacctccanagactnggagaggagcagaaatatgangagcanatggcctacctncaacagaaagagctggncctgatagattataaatntgganaacgtngaanagatggtgatccagatncccangaacaacagttactgganntctctgaacccgactgnncctcttcatctgcnaacagtggaaaagacnagtctntgagaattatnagccagangtttgtcatgctgnncctcgnctncaaaaccnagatngtcactctggatgtggctgccgaaatactgntcgnagacngccaagatgccccagaccatagnanatttaaatgtaagaatnttcacctgcatnancttactagcacataaagggtgggatttnatgngtngatattntctgcttccgagattaaaaatctntntantgnttgttgacntangcatggaagtgcccnaaactcctgccttttaaaactntcnnngagnccatttccgtanattcncacntgattaaganncaatggtgaagtttgggnaaaaccgccacttggatgcaccggaaaaanatnt

SEQ ID NO: 3706 - DNA, 750 bp, Homo sapiens
  misc_feature 684, 733, 739, 747, 748: n = A,T,C or G
gaagcagctcttgttctttttgcaggatcccatcgattcgaattcggcacgagacattgtgttgcatcttataacttgtatagattgagctgattgaaataagattttgttccaagtattatctgatagaatacaagatgattcaaaattatatagatatttaaagcttttctgctgttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagccctggatgttaatgtgattgatcagcatgggcatatgtaaaatgnccttttctgggtggctctctatgccaatggggtcagatccttacacccntaattnaaccagtnngt

SEQ ID NO: 3707 - DNA, 742 bp, Homo sapiens
  misc_feature 5, 12, 13, 14, 19, 279, 306, 338, 342, 365, 423, 431, 438,440, 459, 464, 543, 559, 564, 578, 589, 592, 602, 603, 604,607, 611, 613, 616, 620, 625, 632, 648, 650, 651, 656, 672,678, 703, 714, 732, 733: n = A,T,C or G
gaaancagcttnnnaaccncttgcaggatccctcgattcgaattcggcacgagggatgggtgccctggagccaggcaaggcaggaggccccagaaacttggtgggggagataacggaggggatggagcaggaggaatcctgaaaaccggactgggagagatggggccgagtggacgatgcccagtaccagcgggcgtctgagactgaaacattaattctgaagaagaagaaactagacagtcagacctccaggactaagatgaagtgagccgagagganatcgtatcataagaatgcttctgtcgntagccgggtgcagtgctgtgtgtatctagttncagntacttgagaggctgaggcaggangattgcttgagtccagaaagtggcagttgcagtgagtggagatcgcgccactgctctncagcctgngtggcanancgagaccctgtctcaaaanataancaaaaacaaaatgcttctgtcagttaacaatctttattaaaagggtttttagtctttctttctcaacttgtatgttaanttggttgacaaatgcnaattnacgtctttattatnctttctttctnaanaaaaaagccnnnttntggnanaanctcnacctntgaactntgtgagtcttattacntnnatccntccatgataagatccnttgatnatttggacaaacccacttgaatgcnttgaaaaaaangcttttttgggaaatttnngatcctatc

SEQ ID NO: 3708 - DNA, 759 bp, Homo sapiens
  misc_feature 2, 3, 15, 16, 29, 37, 47, 48, 55, 194, 605, 641, 644, 697,702, 717, 736, 755, 757: n = A,T,C or G
gnntagctagctacnnaaactctttggcnaatcccantcgattgcgnnttcggcncgagaactgacctaagcctcagtttttcagatctgtagtacttactttacatgattgctctttgaattgaataacataatttatgtgaaaacacttaattatgaatgctgtaaaactatcaaagccattaatatgtgtnatagtagcatcatacattttgcagcataatccagagaacaaggagttgttaacaagggagaggaagataatctggttgggctagtattatactctcaggtgctactgacttcttagatgaccttcaagatgttagtacaactctctacttggagatgctattttctggggatgttaatatccactctattcacaaaattttaagaaaagtcaagtagcatggatgaaactctccaaagttctgcttaaaactaaaatatcttagttgtcactgaagccacagatattttgtgaatgcagcatgttcccaataggcagtccctcttagcctcacagtccaagctggcaacaggatcacattccagggaatgaacagaaaggctggcaggcaatcacaccgctgatatcttangtgtgtgggccccccattttttttttgagatggagnctnactctgttgcccaagctggagccttttaaactatagtgagtcgtattacgtanatccngacattgttaggatncattggatgaagtttgggncaaccacacttggaatgcngncg

SEQ ID NO: 3709 - DNA, 765 bp, Homo sapiens
  misc_feature 2, 14, 17, 36, 42, 43, 59, 68, 71, 606, 670, 692, 693, 695,732, 765: n = A,T,C or G
gnaatagctaggcnatnagatctcgttgcaggatcncatctnnttgcaggatcccatcnattgcgaantcngcacgagggaccccctaattttgtacatgttgatgataggaataagggcttcgtttattttcactgcatgctctctatggaaagaggatgtgctaagcaaacaagcattgtaaacaatatttcagaggcaaggttttggcctgctttaaaaaaataaaatgtttgcaagtacaattaaaaaccagtataagggacaggggtgggatgaaaacctgtctctaagattacgaagcctgcgttatttcccctaaatccccttcgaggaagatttgaatccctcatcaacaaattttcattgattatgtttctattatatatactgtagactctatattcacgaatgtaatcatactcattcagaaaaatataggaagagaaaatgagtatgacctgtagcctgaatttcattataaaagatttaaaaatatacattttatattaaaattgatgtaatcttttaattatgaagtctttgattctttagatgttttcatccataacccaagagcaagatcttggcatcagttttttccangttatgtctatatcatctattattacttaaaagtttggagttacatataggatatattgatatntagagagttataggatatatgnnantttttttcaattccagtcccccaacccgagcaaaganccattttttatggaacttaaaaaaaaaaaaaan

SEQ ID NO: 3710 - DNA, 790 bp, Homo sapiens
  misc_feature 1, 5, 8, 12, 13, 26, 28, 32, 33, 35, 39, 94, 438, 488, 510,531, 566, 576, 585, 598, 634, 636, 664, 668, 672, 689, 690,692, 695, 698, 702, 713, 717, 723, 728, 736, 737, 741, 762,790: n = A,T,C or G
ngtanganactnnacgggaaatcccntntctnnangaanccaatcgatgcgaattcggcacgagccccagccagccttcagggtccccttgttnttgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggacaggcggcagaggcctnagtgcggcaaacacagccccagagcctgtgtggcaccagcagcatcttanagccccaggtatatgctgagancttatctcacgctgcctccantgtctggggggcccaaaatgatggcacaagggcangtgggcctgnaaggggccncaaaatgccctgnggttcaaagggaagggtggcccaccaatggggcccnanggtcttaaccccaaggaacccctttggntctnggtnccttaaacccttggcanntnacnggnaagnacctaatgggngggnactggncccangggccccnngtgnacctttgggggggccaaaatngggaaagggccccccctgaaaaaaaaan

SEQ ID NO: 3711 - DNA, 762 bp, Homo sapiens
  misc_feature 1, 4, 15, 18, 19, 26, 27, 30, 39, 50, 52, 55, 96, 98, 616,626, 635, 638, 643, 656, 685, 704, 705, 710, 713, 740, 743,745, 746, 757, 762: n = A,T,C or G
nacnaagatatcctnatnnctggctnnccntttctgcangatcccatcgntncantgcggcccgaggctgactgttggtcatcttgccagatcttntntgatgtcttttgcttcatcctgctgtgcatcttgcaggaaagtagatgctcttggtcatttgagtaatccgaatcttgttatttccagtcaactcagttggatttctgggatgagaattagaggagtcccattgaaaaactggaatgagagatgagaagtttgctgaaaacagaacatttttttgtgtgtggattgatttgcctcgtatacctgccttgtactttaaccacatctttgcagtttaaaatagaacacattatttcttcagattcacttattttgactacatcagtaatgctcttacaaggctgcatgacagatttatggtgacatgctttaggcagttcaaaatccttaaacctatattcagctccttttttcctagaaagtaagtcatcttaattttcaatctttctttctttttaatcttttaatgattttttgggggagaggaatcttggcagttagattcttcaagcttggctacaaatgggttaaaatataagtggtgaaaatnttatactttntcctatttngantttgnctgctcatttggnttcttcccatggtctcaagtatacaattnccaagtttattggggctgnntcacntgnttccatttctgcagggaaaaggctgcnttncnnaattggggttnggccn

SEQ ID NO: 3712 - DNA, 796 bp, Homo sapiens
  misc_feature 392, 437, 505, 522, 524, 556, 559, 594, 611, 617, 620, 629,640, 646, 659, 681, 683, 686, 706, 707, 720, 727, 743, 759,767, 780, 782: n = A,T,C or G
ttgttctttttgcaggatcccatcgattcgccagagcgagcacgcgtctggcggctgctgtcgttgtgttctaccccgtactgacccaacaccacaagggctttctctggtcccctgtccctaagacaataatcgctttctgacaaaggagcctgcacatttgggtgagcagacccaagctgtttacagctctttcttgtcctgccatccagtagcagttagtcttcatccccacgtgaacaaaatgggaaggagccgtgaggagaggagtgaggcaacaggcacccgaagtccctcgtccttccctctgtgtgctctgaatatgtccttgtccttcctgacccatctctgaccagctgggaacctgcttggggtccccctcaaacctgtgnctggggtgtgggctcacagatccctatcagcctggttcgtggganggctcttcctaaagggacccccatctctaagtcactctgaaagggagttgtggagaggagacgccctncaaactcttcagaagtntntgaggacttgaactgggtcactcgggatctgngtncgaaatccttcccaacccttttcttttgggggagntttccttaaccctgctngcttgnaanccaccaaanggtttttgggnggcctntcctttttcttcnattttggttttaaaagggcaantngtnccaaaaaagcccatttcccnngaaatgcccaaanaacccangggggccttaattttnttaagggggaaagggnaaggttcnggttttcccaatngntttcccccttcccg

SEQ ID NO: 3713 - DNA, 748 bp, Homo sapiens
  misc_feature 4, 5, 6, 11, 13, 15, 16, 27, 35, 36, 38, 41, 42, 46, 51,53, 96, 100, 244, 249, 264, 272, 372, 401, 402, 445, 461,484, 496, 501, 503, 507, 508, 519, 527, 530, 578, 621, 625,632, 661, 666, 667, 674, 678, 689, 690, 692, 699, 738, 740: n = A,T,C or G
gacnnntgtgnangnncgtggaaatgncctttctnnanganncccntgcgntncgaattcggcacgagaatacacacaacatataagacatggcantttnctgtttatgttatcaggtttaaggcttctggtcaacagtaagctatgagtagttaagtttctggggggacaaaaatttggttgtcaactgatgggggggcggtgttggcacccctaacccgtgcactgttgaagggtcaattgnactgnatttatatatgccancagctctncaactgtggtctgcagatctcatgaggtctcctttcaggggacccacatgggcaaaactatattcatactactactaaagccatttgcattttccactgngttgatatttgcctgatgttgcaaaagcnntggtgggtaaaactgccggtaccttagtgcaaatcgagtcaanggcactaaacgtatanttgccattagatcctctcttcancattctgtgctngcagntnaaannttaataagccngttttacntangaatgtccttaatgaagcaattgaaatgactaattttattaaaatctnaagccttgagtatatatctctttcaatattctatggaaataantggnaactatncattaagcatttctgcatgcaaatatggnactgnnttgaagnaaanctctgcgggtnncnaattgcnaaccttgaactacccattgatacttggatgtgcaggctncnggacaacc

SEQ ID NO: 3714 - DNA, 741 bp, Homo sapiens
  misc_feature 4, 5, 23, 27, 28, 36, 37, 41, 43, 732, 737, 741: n = A,T,C or G
tttnnatgctggttgtcgttctntctnnaagatccnngcgngncgaattcggcacgagcccagaatgaacatgcagcccccccaagtaatcctgtgatcccagggtttcaagatagacttttgagtttttcacagtctgtcttaactcagcaagataacttgggacttcagaaacagttggatctacaaagagaagttctgcattatagccagaaagcccaggaaaaattgcttgtacagagacaaacagcattgcagcagcagatacagaaacatgaagagactttgaaggatttctttaaagacagtcagataagtaagcccacagttgaaaatgatttaaaaacccagaagatggggcagctcagagactggtttcctaatacacaagacctagcaggaaatgatcaagaaaatattaggcatgcagataggaacaactctgatgataatcatttggcttcagaagatactagtgccaagcaaagtggtgagcatctggagaaagatctggggagaagatcctcaaagcccctgtagcaaaagtcaaatgtggtttggacttaaaccagcattgaacttagtgctatacaagaagtagagtcaccagcaattggcagaacttctatactaggtaaaccaggtatttatgaagacagagaccccctgcgagtcttaattaagcccgagacaaaggtttttttgggagcccctggccatggatcccgttangttgncttn

SEQ ID NO: 3715 - DNA, 735 bp, Homo sapiens
  misc_feature 3, 4, 11, 12, 14, 15, 16, 31, 33, 34, 36, 99, 119, 120, 127,137, 149, 159, 167, 169, 172, 181, 182, 188, 197, 199, 217,223, 224, 231, 234, 236, 237, 241, 243, 249, 250, 253, 259,268, 271, 276, 278, 279, 285, 294, 295, 297, 298: n = A,T,C or G
  misc_feature 301, 302, 305, 310, 312, 316, 320, 323, 324, 346, 351, 358,367, 372, 373, 383, 385, 386, 406, 407, 411, 414, 419, 429,430, 437, 442, 451, 452, 456, 463, 467, 469, 476, 477, 478,480, 486, 489, 492, 499, 500, 501, 503, 504, 508, 512: n = A,T,C or G
  misc_feature 519, 527, 544, 549, 551, 552, 556, 559, 562, 566, 570, 572,576, 580, 581, 610, 611, 613, 645, 646, 660, 663, 671, 675,677, 683, 689, 706, 711, 725, 734: n = A,T,C or G
tgnnagagtanngnnnggtacttgctctttntnnangtagcccgtgccattccggagggcactgccctcctggaagagatgcattaggatcggtttgcncagtaatacctttacatgannccatttngagaatgatnacgggccaaagntaacgggtgnactgttangncancatggactnngagaangcaagggtnanggtgaccaggtctggcanagtaannagccttncgntnnaagngnacctgnnccngacccncagaggatngtnaccantnngactgnaggaatganncnngtnnggntgatntntctncatngannccataatctaatgcatgattangaganccaaatnggctgctcnttaanngacatcccanannctatctgatcctaatgcggnncatnctngatancttagtgctnntaaacgncgtgntcatacatnnactnatgcttnggcnanccactcnnngntgttangtnacntatgtannncnngacngganacttctnctctgtgnagcagtcatcacatctntacangnnctangtntantatngctntnaacncggnntgtagttgatactggagcatggctttctnntnacactgcattgctgtcacatcttggctgagcnnagtaatgtccgtcnagncttaatanatcntngaatgntgggcnatcgcctggagttccangatcntttggagtccgtcnacttttatnt

SEQ ID NO: 3716 - DNA, 752 bp, Homo sapiens
  misc_feature 3, 5, 24, 30, 67, 167, 223, 258, 433, 459, 471, 479, 487,513, 533, 537, 548, 559, 565, 566, 591, 593, 595, 596, 603,605, 607, 627, 628, 647, 648, 652, 665, 678, 723, 731, 732,738, 750, 751: n = A,T,C or G
agnangcgtgtgaagtatcgcccncctaanagaaggcgggcgattcggcacgaggccccagggcatncgggggatccctgtgattttggtgagggtgagcacccaggttccacagggctctgtcctgggcaggccagcagatgcagtgattgcaaatcctccttgtncaaatggaacaggcacgtgcatttgtggcacactcagagctgctggccactagtgngctttggagaatcagttgtctcccaggcggggaangtccctcagacataaaatactcacccatttagaggaatgacaacagcaaaggaaactatattctgctaatttactggtaagagaggaaaaactctgtcatgcatacacatgacagaggctctgcctaaagagagaggcagcacgatacagatattagcaaatgactactctccangaagaaacacaccagccaggaacggnactcacacctgnaatccagnactttcanaggccactccggtaggatggcttcanaccatgagtttgagactagnctgngcaacctggcngacttcatctntaccannaaatgaaaccatgcattccaacctncnannagatcantnangagacccacacctgggagtnnccagatatttcaaaggctnngcangaaggatctcttnggcccaggaaaanggaaggcttgcaattgaactatgatcctaccacttcactttcagnccggggcnnccaaanccatgacccctnnt

SEQ ID NO: 3717 - DNA, 771 bp, Homo sapiens
  misc_feature 5, 13, 18, 22, 26, 31, 37, 50, 58, 73, 93, 96, 593, 673,678, 704, 712, 714, 733, 759, 771: n = A,T,C or G
tctangagatggnatgtntcgncctntctcnaagagnaaaggcttggcgnattccggnccaagatcgagaccntcctggctaacacggtgaanccncatctctactaaaaatacaaaaaattagctgggcatagtggcaggtgcctgtagtcccagctactcgggaggctgaggcaggagaatggcgtgaacccgggaggcggagcttgcagtgagctgaaattgcaacactgcactccagcctgggcgacagagtgagactccgtctcaaaataaaaaaataaaatgggaatatcaatagggcctatttagtagggtggaagtatagctctaatgagatggtccatactggtcccccagcacataggaagccctcaagaaataaaggctagtggtaacctgcacagtgatgggaggacaggggctatgcagaaaaacttggagcaaagaaacgagagcaaatatgggaaaataacaatttgtgtggggttgaacatatggttgttcatcgtactgttttttcaaattttctgtatggttgaaaaaagtgataattttttgggggaaaatctggcatgttcccctgcacctanggtatatcaaaatgtattgacaaaatccaaattaaaagccaaactcaaaaaaaaaaaaaaaaaaaaaaactcgagccctnttaanaactattagtggagtccgtatttacngtagaatncnggaccttggattaaggatncatttggatgaagttttgggacaaanccccaactttgn

SEQ ID NO: 3718 - DNA, 744 bp, Homo sapiens
  misc_feature 3, 4, 9, 10, 11, 12, 13, 14, 16, 26, 27, 41, 91, 95, 122,510, 558, 634, 682, 697, 707, 719, 720, 724, 725, 726, 729,732, 733, 742: n = A,T,C or G
agnngcggnnnnnngnaaatgccctnnatgcaggaacccangcgatccgcctggtggtagttaccacaacacatgcctcattaagaaacantttncatcagagggaatgcctgcctccctgntaccagctctgcagatgtgcacatatcttcctgtcgtaagccaatgggacttaaaccttacctcttgtgttttggagactatcttttatttttttttttttgagagagtgtctccctgtgttgctcaggctggagtgcagtggtgtgatctcggctcactgtaaccttcacctactgggttcaagtaactctcctgcctcagcctcccgagtagcttggactacaggcgtgcaccaccacacctggctaactttttgtatttttagtagagacggggttttgccatgttgcccgggctggtctcgaactcctgaccttaaatgagcctcctgcctcagcctcccaaactgctgggattacaggcgtgtgccaccatgcctggctaatntttatattttcagtagagacgagggtttgccatgttggccaggctggnctcgaactcctgacctcaagtggtccacccaccttggcctcctagagtgctgggattacagggggtgagccactgngcccgggctcttttgctttcttaaaagactttggtcgggtatttgggntggatggagtattgngtctgggtgngggtaattcganncctnnnttngtnnggggggtanag

SEQ ID NO: 3719 - DNA, 755 bp, Homo sapiens
  misc_feature 5, 7, 8, 596, 735, 755: n = A,T,C or G
tcaananncagctcttgttctttttgcaggatcccatcgattcgctgagatcggccactgcactccagcctgggtgacagagtgagactccgtgtcaaaaaaaaaagtcccaaactgtttggctttatttaggcagtaaatattctacttcgggatgacctgtcatggagccagtaaggcctctacaaatcacatcccaaacaaatacaactcagatgagcaaagtaaggcccagatgaaatgacatctcgatctcttctatggcagaaactcagcaagacataatgaaacaaagatagctaaagttcattatttaatgctctactcccaagagaattatgggactttaaggctactcactaacatacaaaattaccatgcagatatggggggaaagtccatgtccagaaaaaacttggtttgcaaaccttagaactatgtcattgcaggattatgtgtgtgtgcccgtgtgtgtgctcacaggctttgaagagttttatgagtatccattatccaaaatgcttggaaacagaagtgttttggattttagattttgaaatatttgcattatacttaacaagttcaagttcagcatncaaaacccaaaatgctccagtgagcatttcctttgagcatgtcagtacgcaaaaagtttcagattttggagcacttaagatttaggatttgggatatcagcctgcataatcaaaccttcttcattcaggaatgtaaaangaggtttaatatgagcttan

SEQ ID NO: 3720 - DNA, 771 bp, Homo sapiens
  misc_feature 5, 11, 31, 48, 542, 680, 701, 702: n = A,T,C or G
agcgncgccgntgaactgaaatcccctttcngcaggagcccatcgatncgaattcggcacgagatcacctgatgtcaggagttcgagacctttttggtcagcaaggtgaaaccctgtctctactaaaaatacaaaaattagccaggcgtggtggcgtgtgcctgtagtcccagctacttggggaggctgaggcaggagaatcacttgaacccggaggcagaggttgcagtgagctgagatcttgccactgcactccagcctgggtgacagagcaagactccatctcaaaaaaaaaaagaagatggaattagctgagtttcatggctgcttgggaggttttttgcagacaaagactccctctctcacccagactggagtgcagtggcgtgaccctaactcactggagccttgaactcctggtctacggtgatcctcctgcttcagcctaagtagctgttattggcatgagccactgcccctggctcacatggctgcttaaatggaagagttagcagttgagactgagaaacatgaaggactangtaagtatggggctcccagatagagggcagcccacaaacgagataagcagaagctgcccaaagggggaaggaaagacagcccagacaggggaatgttaagaagaagactcaagccaactcaaggggtttaataaaaanggagcctaagctctctttaanncattcacccaagccatatgggatttcagcaaacttggccctgtcccaagggacctcccttttggcaagg

SEQ ID NO: 3721 - DNA, 778 bp, Homo sapiens
  misc_feature 2, 3, 4, 11, 13, 16, 18, 92, 372, 398, 425, 527, 544, 554,576, 602, 605, 606, 608, 609, 610, 611, 612, 614, 615, 617,618, 619, 620, 621, 625, 650, 653, 655, 672, 677, 685, 697,704, 705, 706, 707, 718, 725, 733, 734, 735, 742, 743: n = A,T,C or G
  misc_feature 745, 746, 772: n = A,T,C or G
tnnntttgacncnttncnaggctacttgttctttttgcaggatcccatcgattcgaattcggcacgagctgggagcgagacggtggcccggnccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggancagattccaaggccaggtggccgcanggacgatgcagatgcagagcccacgtnacatgctcgctccaggggtggggctgggctgactctggccggatcccaagcctgtggctagcagcactggggacaggaatggctggtcccttgaggaggtcntgacaggctcaacctgntggtctggangggactcggaaataaattgtancagctttccttgccaaaaaaaaaaanatnnannnnncnntnnnnnaaanaaaaaaactcgagcctttaaaactnttngngaagtcgtatttacttngaatnccaaaacnttgattaggatncctttgnnnnaattttgggancaaaccncaaacttnnnaatgccnntnnaaaaaaaaagccttttattttggggnaaaatt

SEQ ID NO: 3722 - DNA, 765 bp, Homo sapiens
  misc_feature 16, 23, 51, 265, 320, 322, 327, 398, 427, 432, 478, 506,532, 570, 571, 572, 577, 589, 592, 600, 613, 616, 618, 626,633, 642, 643, 649, 661, 666, 684, 687, 692, 694, 700, 705,706, 707, 712, 729, 730, 734, 736, 738, 739, 740, 741: n = A,T,C or G
  misc_feature 748, 760, 763, 764, 765: n = A,T,C or G
tgcatacacacgcttnggaactngccctctttctgcaggatcccatcgatncgcgctctccctttatagtttctctataaaaactggttttaaaattagtggaaaagggcaggttgaatcaaggtgaatcaatctgaaattgagcacacctgcctgccatcgctgttccttcaactgagtgctgcacatcatgggctctgtctgtgagagaaaaatcccggtgcttggtgtccttgcatgacatggagttttgcatgtagatcantttaaaatgtacctcttgtttacataatttgcataattttaaaagataatgttgncnaactntggaaatgttaatgttcagactgaaaatctccactacatgtaactctcttcctctggatcactggcatggnttataatcccagccagtggtttgaactgntccantgtcaactgccatgtgctctgcttcaagggggaactagccttttgngaattttttgccataagtatttgttacnaatattttagcaaatgctttctattnctctagcttgtgcatatcttggctgggcgttacagaannnatagngtacccattatnttncttaccgnggaaatgaagggntantncctttccncttttantccggtccnntttttnactttaatgtanagggnggttgggataaagggaanggngatgnangaagcnttaannnacctnaaatttcttgaaccccnncaangncnnnngggttcntttttaaccccnaannn

SEQ ID NO: 3723 - DNA, 811 bp, Homo sapiens
  misc_feature 2, 5, 7, 8, 9, 10, 11, 17, 23, 26, 36, 37, 39, 40, 44, 49,52, 88, 95, 584, 598, 618, 670, 678, 683, 706, 743, 754,767, 770, 780, 793, 796, 802: n = A,T,C or G
cntgntnnnnnttcaancctggnaancgcctttctnnannagancggtncgntttagaaatagaactcctgtagatgtgtagaaagantgatggnaaagagaaaggactgatgtccttcttttcattgaaaaagatattgtttaggtcctacaatggcttaggtatggtttgagactctggggttacaaagcaaagaaaacctggcctctgccctgctcagagaacagcagggatacagcatgttagcaaataagtatatagtgtggaaaggtctgtagtcaatagcagtcattttgacaataggaaaaggaatgtgtgaaacttctgggtctgtgtgtgtgttggggttggtgggtcaagggaggggatccaaagatggtttcactaagaagggaaaaacaccggacctgagacttgaatgcaagtagaattttgccaggcagatgatctgttcttccaggtagataatccatcctgggcagacaaaaccaggctgtagaaggaacaccatgtgtggagcaatagaaatatctcattggtactggagtataatgcatgccaagaaaccaggcaaggtagacanggggccacccgtgnaaggaaacctcttgaaatanggggaatggatattcatcacattttccattgtttaaggaccaaattgggaanaaagtttnaatantccaagaatgttaaggaaaaagnttaaatgggaaggggaagaccaaatttccaaggtggnttccaagcccnaaggggattgacncanttcccttaanttttggaaaaggnccnggggtntttgggaaa

SEQ ID NO: 3724 - DNA, 771 bp, Homo sapiens
  misc_feature 40, 316, 319, 388, 429, 436, 437, 443, 485, 531, 536, 566,589, 635, 659, 660, 661, 663, 671, 675, 680, 690, 716, 743,746, 748, 749, 753, 754, 763, 765, 767, 768, 770: n = A,T,C or G
gagattttccttaactgcaatggctactcgctctttccgnagcccatcgattcgctgggtcatgaaataacagattaaaaatgttctctggtaattttaattaaacatttctgtaaatggaaggaaaagaaaaagatttcagagagtctgatcaataatagcttgtgggtcctagtgagtggagcagtgtataaagaggtaaggtttttgagggaaaaaaatactatgtcaaatggggggtgaatgataaaaatcgctctcattttcctttttttcacctttcatcttcatttatggaatttctatacaataaatntgnttggcatttaataacagtgcctctcccccggaatactgtttttattttatcttacttaacaaaatattntgtagtggttctgtgccaagtgctgttctaagcactttgcnaatattnnttcacntaaccctataaggtgggtcctgttttatgcctctttgttcgnttgccagcaattaatgaaactgaaacagtgcttgtccaagacaccntaagnagtaaatggcatagctggaatttggccctnaagtcagtcctcttaaccactgngctcttctgtctgctaatggaaaacccttataaagtggtgaaccanaaaaagccagaggtctgggtttannntnccattttnggcnttttnaaaaccgggntttttgcctcttgtccccccaagaanttgggggttttcaatggaacctttggntcncnnccanngggggctcnancnncng

SEQ ID NO: 3725 - DNA, 768 bp, Homo sapiens
  misc_feature 3, 6, 9, 13, 15, 17, 19, 24, 30, 37, 38, 52, 69, 77, 83,85, 89, 127, 166, 189, 190, 191, 198, 200, 201, 256, 260,264, 267, 275, 297, 298, 316, 317, 320, 322, 329, 338, 339,364, 368, 370, 373, 374, 391, 405, 425, 427, 431, 437, 447: n = A,T,C or G
  misc_feature 448, 459, 468, 469, 476, 481, 485, 496, 510, 519, 521, 539,553, 568, 571, 586, 589, 592, 598, 616, 628, 633, 641, 644,646, 650, 653, 661, 663, 670, 673, 674, 676, 692, 695, 696,702, 708, 711, 714, 715, 719, 727, 728, 731, 735, 736: n = A,T,C or G
  misc_feature 750, 753, 765, 766: n = A,T,C or G
acngcncgnccancngntnggaantccccnctctgcnngaagcccatcgatncgaattcggcacgaggngaggcatnttggcntnaacntgcgctttttacagaagttatgtgccactgtggaaatngctggaaatacaaatgcaaaagaaaacacaaatctctgncattctgcagaaacagcattctnnngaccccntnnggcttattctatagatgtatatccttgtgcttacagaaacttgatcatattattntatnactngcnggttcatntaaaaatatcatgaacatcttnngtgacatgacatgtctcnnctntnaatgagngcatagacnnccaaactacaaatcttccatactcngtgnanagnncctccactgcagtccancctgggcaacacantgagactccgtcgcaaaaangncaanagacgngctattgacnncaattttgacnttggatganngtggcantaatntgantgccgtaacancgaatgcaggaggngagaggaananacccggagcccaagttgnattgggaaagtggntcaggccattggtantgnaaaaatcataattcncangantttganatgggagaaatgcgggcnggacttgaccgnatctnactgaaancgnanactncancgggaagntncaaggcnaanngntcattttaaaccccanggnnttccangctggnaanganncccngggattgnnccnactnnccttccaggcctgnaanaacaaaaactgnnct

SEQ ID NO: 3726 - DNA, 743 bp, Homo sapiens
  misc_feature 3, 19, 21, 29, 88, 556, 573, 574, 624, 640, 721, 739: n = A,T,C or G
gcnttcctaaaccctttgntntcgctctntgcaggatccctcgattcgtaaagttacacttaaacagtgatacatagattgccagatnttttttggaagggctttgattaattaggcttcagggaaattgtgaataaaaacataaatcttgcaatagggtaggggaaagaaaataatcccactcctgaagtgatgaaatgaagagtggctagagaggagaaaagaaccaggacaggtgatatattagcaactgtcagtgtgaataatccagggtatgacatttctaatttagcctcacatttaaggtcatttctgattcaacctcaaatgatccttctagcctactgctcccctaaatattaatatattctttgtgccagtcacagtgtattaacatttccctgaaaacatcttaagcattttttttaacctatgtgacttttgccttcttccatctcaaccttttaaaatcttacctacctgtcccttacttcatcaaatgtttctaattatttagaaacaacttctaaatttcctaatatatatgtatatctgngttgagtatgtatgtgnnataactaaattagagctaaaatattcttttattagtatgaaaatttgtgnaattagttgatttatnccttcatatatctctgggagaaaatctcttggtcaagcctggtagccctcagagaactttaaagttttattgattctaatnttatgtatgtatgcatgnatgc

SEQ ID NO: 3727 - DNA, 737 bp, Homo sapiens
  misc_feature 3: n = A,T,C or G
gantcagctctgttctttttgcaggatccctcgattcgtgaaggacctgcctgcggctgctttacagtttgtttgtttttttttaaaataagtagaagatatacactaaagtaatgataaatgtatagtatagtaaatacacaaaccattaacagttgtttattttcaagtatatgtactgtacattaattgtgtgtgctgtacttttatacaactggcagcatggtaggtttgttcacaccatcttctccacaaacctgagaatcgtgttgttgcactgcaagtcattaagttaggaattgttcagcttcattataatttgtgggaacataagatgtccttaaatagcacataactgtaatgtgttttttttaacatcttggttttttcagcagctatgttagtatccagcagataactggcactctggacatttgatgggtgaaaatattcacggttcattcttttcttcgaatgagccccaataatcattgcctcctgaattcctctatcaatattttgcctatcatttgacatttttagacatttaaaacttcttagtaagataggacattactgtaagagcatttgtctgcatatactatttcagtttttttcccctttgtctgagttaattctctatctactggtcacagtaaagagttccataacatactacacttgcctaaacagatttaacctctggcagctcatctgactgaacacagtaagtaagg

SEQ ID NO: 3728 - DNA, 769 bp, Homo sapiens
  misc_feature 3, 5, 13, 14, 16, 20, 21, 26, 27, 31, 36, 38, 51, 84, 86,121, 127, 139, 225, 244, 327, 329, 342, 345, 347, 355, 373,421, 445, 454, 471, 489, 490, 497, 505, 510, 512, 536, 548,576, 587, 588, 605, 626, 638, 644, 646, 671, 674, 675: n = A,T,C or G
  misc_feature 676, 678, 696, 714, 716, 726, 738, 743, 744, 748, 758, 760,767, 768: n = A,T,C or G
acntngttctgtnncngaannccctnnctcnaaaancnaggcggtgcgttntcagccacctccactgactcctacctccaaagntnatactttttagaccttattttcctaaggatgaggntagtangagggctgcttnccctcagcctggattactgctttggcctagaagatgaagatggcatatgtggttatgccttgggcactgtagatgtgacccccttnattaaaaaatgtaaaattncctggatccccttcatgcaggagaagtataccaagccaaatggtgacaaggaactctctgaggctgagaaaataatgttgagntnccatgaagaacangangnactgccanaaactttccttgctaatntcccttctctgataaagatggacattcacaaaaaagtaactgacccangtgtggccaaaagcatgatggctngcctcctgncttcactgaaggctaanggctcccggggagctttnngagaagngagaccanatgananaagaattctggaatcttacagcangttaagatggtnttgaaattgcaaaaaaaggaaggatttncaaaaggatgnnggctattactttggtcnggaaccctggggaccaattcnttgacactgggnaactgntncaaaaagtctcttaactgcaccctnggnnnantgggtaacttgaagggcntccataacagtcaagccncnagaaatgggnaccaaaaccatnccaanngganttcgcaaccnanaaagacnnt

SEQ ID NO: 3729 - DNA, 746 bp, Homo sapiens
  misc_feature 4, 7, 218, 458, 536, 570, 620, 629, 735, 745: n = A,T,C or G
gaancanctctgttctttttgcaggatcccatcgattcgaattcggcacgagattgaattttctgataattgaagcttattaattgtctaaaattatcttaagatattttctgatgtacatcattttaaaatgagttgcacacatttctattctgtttcaacatattcaatataattttcgctcttgttcatctgttggtattcattatataattcanacgtggtctcaggtctggagacatgtgaagttattgctcctacactgagtgtttccatgtcattatgccttaatccttatttagacacagctatgataccctctttacaacataaaggataagcaaaaggatgtataaatgtatcctgggctggaaagtggcattattgactggccattggccatcagcaaaggggcctgagtggaaggatatgaaaggatgggtgtaatgtagatgacnggttgatgggtgcagcaaaccaccatggcaggtgtatacctatctaacaaacctgcaggttctacacatgtgtcccanaacttaaagtatagttaaaaaaaaaaaggatgantggtgagcacagctgacacaccccacgaatatctggggggctttgagaangttgctganatccagtaatcatgtggcaagtttcagttatttttattgagacctcttggctcaataggctgttgaagtccttggaactccatcaaaggtgggtttcccaatcctncatgactgcng

SEQ ID NO: 3730 - DNA, 749 bp, Homo sapiens
  misc_feature 3, 7, 8, 10, 17, 29, 37, 92, 97, 415, 457, 472, 475, 505,524, 545, 547, 562, 599, 603, 630, 634, 651, 665, 666, 684,690, 691, 697, 704, 709, 720, 724, 728, 734, 738, 745, 747: n = A,T,C or G
acngcgnncnctgaacnggaaatcccctnttgcacgngatcccatcgattcgaattcggcacgaggtgatagagatcatgccgcttgggttnttttnttctccccctcgttgtaattcagcaggcttcccagtgtgccctgcatcctcatctgtgaggccgacttcactatcattcccacttataggtggaggagactgaggcacagagctcccaaagccccacagctggcgagtggcagggctagcgtgcgatgtccactagactggtgtctgacgcagaagctgcgcttctcacccctgggatctggaagataattctgatgtgtgagatccaggagaatgcattgtttaaccagaaaatgttttgtaactgcatttttgtttttgacagaaatgtgactgcccactgaatantgagcattggaattagagaccatctagctgccggggctgggntgggtcatcttgcgnccnttaagactgaattgggatgctggattccantcttaaaaaccggcatggngacataccacaaacagggtancntaaaacaacaaaatntttttcacaattctgaagggtaaaaggctgaaatcanggcntgtgggcacggtgagctccttcttgangcanactggtcccgttccttnccggaacctccggnnggcaacaagcttgccctngggggnnccctgncttggancctgngttaaccccanactnttgnccccgncttnatggggnancc

SEQ ID NO: 3731 - DNA, 742 bp, Homo sapiens
  misc_feature 5, 24, 93, 96, 593, 600, 610, 624, 655, 713, 729: n = A,T,C or G
gaatnaatcgcttggctactcgcncttttctgcaggatcccatcgattcgtgtggccccaagagtgggaggagtgggctgtcagtaggccacnttntaaatatctgtgttctggctgacccccatatgctaggatactggagatgaggaactggagaaggtgcttaaagagcacatctgtctggtagaggacacagagctgtccttcaagcatttgaacgatgttctcatttccctggaatcttctcctctccaggctcacatctctagctccttcaatgattcctcttgcgacatcattttagttctcttccccaacctagtctttttgcttttaatgaatgatcactgatgtatagccctgatgacatctggtgtccacagtggtgcctgatgctccgggtgaagttgaagtttgaccagtaagagggaagaaagaatggctcctccctcatttcagagaatacatcctagtcacaagtgcccctaatgtcactcaggtttttgatagctacattccctcactgatccagtagaatacactaccaactgatgcaccatcttgattaacaacagcaagccttcccttccttnctcaagnatctctcctnacatggcttccatncagatttgcttttaacctgccactttggaangggccccccgagatcattttaattaaacacgttattagaactgggttaataaggctancctctatgtctctgcnaatatttccaagc

SEQ ID NO: 3732 - DNA, 755 bp, Homo sapiens
  misc_feature 1, 7, 9, 18, 22, 38, 550, 602, 656, 659, 661, 700, 707, 747: n = A,T,C or G
nggtttnangaccttggntaangccttttctgcaggancccatcgattcgaattcggcacgagctcttttcttgcttagtgatggcatccattttaaggaacaaacctggaaatgctgagcaaagaacacatacccttcatttccaaaggttcatttcccactcttactttagattgacaatgagttgtagttcaaaggctgccctgcagggaagctcatataccctataatttaaagggcctcagacgactcttgggaaacttggtaaaacattctatttagagacatgcctgctgatatgacatatatttttatagttatacccctttattgctgggacataaaacctgttttcactcaaaatgttcctgctttcagaaaatagaacaagagacatgcagaaaacagtgattctattattgtgtattatgacttttgttttatagttctcttttccaactcatctcttttccctgcagctgtggaatctggacagcaaaatcttgtggacgtttattccactaagcccagggatgagatggcactcangttaaagaactaacattttctgaaacccttcattactttttaccagcatcangccctcttaagttccaagtggtaagaaacccttcattcaaatctttacttccgncantncccatttccaagcccttctattatgaaccaaaatttcangaaaccnctagggatgccccttaagaaattggggttacatggttggncccaaaaa

SEQ ID NO: 3733 - DNA, 717 bp, Homo sapiens
  misc_feature 2, 6, 9, 10, 15, 17, 18, 63, 66, 579, 601, 608, 635, 653,671, 691, 705, 710: n = A,T,C or G
cnaaanatnnctggngnngcgcgttttgaactatcaactagatctgggaagatagaacaggcnttntcagattgccttgtttacaaagtgtcatcacgaaaagtgttcctctaggaaggcataatatgtggcctgatggatttgatgagtagattgtaaaagggttgggattctggcagaacaagaagagataactaattagtggaattaactgagaaaagagttcattagcatgttggctattagactctaataaaaatgggtgtgaaaagatgggatttggacctagaggcagtcttagagccataatcctttttttctccttttgtgaaagtgacaggtacttctggtctgagtccataaatcagctatatctaaatggaaaactatatcccactgggatggtaatcacccttttgatagaaaggttagaagccagattcttcaacagaaatggaacttatcaatttaattaagattcctcaacagtagatttttaggtcagtggaacccctgtgtaaagcgatgtgctactgcatgcctagaatcctatatcactgatagctgaaaaagaggcanagcacttaccattttcattagnctgtatncccttggaatgtaagccctttttgaangggaaatctactcaggangctgaagcccggaaaatnacttggaacccaggaagcanaaggtttgcttgtnacccnaaaattt

SEQ ID NO: 3734 - DNA, 717 bp, Homo sapiens; identical to SEQ ID NO: 3733
  misc_feature 2, 6, 9, 10, 15, 17, 18, 63, 66, 579, 601, 608, 635, 653,671, 691, 705, 710: n = A,T,C or G

SEQ ID NO: 3735 - DNA, 744 bp, Homo sapiens
  misc_feature 9, 15, 31, 32, 35, 36, 38, 42, 46, 47, 94, 411, 474, 478,492, 508, 581, 585, 587, 600, 625, 646, 689, 731: n = A,T,C or G
gagtacgangggcanaactggaaaccccatnnctnnangaanccanngcgatgcgaattcgggcacgaggctcttctctgtgccctttatccgntttttccagctcacagcactgacaaccggtatcatctccaggctctccggcacctctatgtgctggccgcggagcccaggcttctagtgcctgtggatgtggacacaaacacgccctgctatgccctcttagaagttacctacaagggcactcagtggtatgaacaaaccaaagaagaattgatggctcctacccttcttccagaactccatcttttaaagcagattaaagtaaaaggcccaagatactgggaactgctcatagatttaagcaaaggaacacaacacttgaagtccatcctttccaaggatggggtnttatatgttaaactccgggcgggtcagctctcctacaaagaagatccaatgggatggcaaagnttgntggctcaagactgntgctaacaggaactcngaagccccgggctttcaagccagaaacaatctcagcattcacttctgatccacacttctggcatttgctgaanattncngcaagccaactgngaacatggggcagaaaacaggaaantctggaactcttttcttcagnccccatgaaaggggtacccaggagacccaaaaaagttgcccgncatacataacaatggacaggctataagaaaacttgggaaaanaaaaatgtctgat

SEQ ID NO: 3736 - DNA, 764 bp, Homo sapiens
  misc_feature 2, 8, 22, 583, 649, 650, 654, 661, 675, 720, 727, 732, 741,748, 752: n = A,T,C or G
angttatnaaaccctttggacncgctctttttgcaggatcccatcgattcgaattcggcacgagatcacgcccagctaattttttgtattttttagtagagatgggatttcaccgtgttggccaggatggtcttgatctcctgatcttgcgatccacccgccttggcctcccagagtgctgggattacaggcatgagccaccacacctggccacagaagggatcatttctaaatagcatagaatcacagggagtacacctcatgtgacttcacgtttagagtcagcatttgctcataatgaattacatatcagtaaatgaacatgacatgcttcaacttcaataatattaaacaaaactctttcagtgtgcttattcatagacgaaaaacagggcctgaaaacccagtgtgacttgggtgtcatatatcttcagtttggatgcactatatcagtgctaatcaataaaggccaggaatgattttggagtataatgtccagccttaaatcttaaatgaaagtgaaattcaaacacttagcccagcagtagaagaacaaacactagtgagacaagtataaatttgntaagacgaacatgggccagatcccattatctaatatatggggtccctcgacagtatgtaccgtctnngaanaggaagnaaatattcaaggtncccaaatggagccatttccttcaaaagacaggcccaaggagcttntgaaaanaaaanccaagtgtnggccaanaaangaagggggccct

SEQ ID NO: 3737 - DNA, 723 bp, Homo sapiens
  misc_feature 2, 3, 5, 6, 7, 8, 9, 10, 11, 12, 14, 15, 18, 663: n = A,T,C or G
gnntnnnnnnnngnnctngtctttttgcaggatccctcgattcgaattcggcacgagatttcctgaggtctccccagccaggctgaactgtgagtcaattaaacctctttccccaataaattacccagtctcgggcatgtctttattagcagtgtgagaatggactaatacaagtaccattaataaatttcacaacgtagattaaatgtgcaaattccttgaaagacacaaattaaaaaatgacctgagaagaaaagaaacttgaatagatctgtatctattaaagaagttgaaattataattagaaaccttttgaacattagaactccaggccccttgttgtgaattctatcgaacatttaaagtagaagtgaggccaattttacataagctcttttagacaataaagaaggaacatggtttatgtgattattaccttgatgttaaaaccagacttaagaccttacaaggaaagaaaactgcagttactcatgaacatagatgcaaaaatacctaataaaagtttagcaaattctatccagtaatatataaaaatgacaattcatcatgttcaaatgggggttattttaagaatataagggttgctttaacatctgaaagtcagtcagtattaattaaccatactggtattaataacctagnaaaaccattttggagcatttcaatagatgcagaaaaagaaatttgacaaaaatggcccat

SEQ ID NO: 3738 - DNA, 738 bp, Homo sapiens
  misc_feature 79, 498, 540, 552, 584, 614, 629, 642, 668, 675, 698, 708: n = A,T,C or G
tacaagctcttgttctttttgcaggatcccatcgattcgaattcggcacgaggagaggccatggcccgccagaccgtantctcagacacagagctgagtattgttgaatcatctgtgatcagcttgctgcaggaggcagaaagtaaatctgaacttagtcagaacatctctgcccgggaacattttgtatttaccgatattgatggccaagtgtatcatctcactgttgaaggaaactcagtaaaagacagtgctcggattccaccagatggaagtatgggtagtattacctgcatcgcttggaaaggtgatacattagtgcttggagatatggatggaaatttaaatttctgggacttgaaaggcagagtatccagaggaatacccacacaccgaagttgggtgaggaagattcgttttgctcctggtaaaggaaatcaaaaattaatagcaatgtacaatgatggagctgaagtgtgggatactaaagaggttcanatggtgaacagtttaagaagtggcagaaatgtgacctttcgnatattggatgtngactggtgtccgtcaaataaagtgatcttggnctcagatgatgggtgcatcaaaagtcctanagatgtctatgaagnctgcgtgctttanaatggatgaaccaagagttacccganccttgtntggggccccctatctccttgttncaagggcctntcttgccttgaaagccctttttattacacc

SEQ ID NO: 3739 - DNA, 710 bp, Homo sapiens
  misc_feature 15, 67, 593, 596, 598, 600, 602, 603, 605, 606, 607, 608,609, 610, 611, 612, 613, 614, 615, 616, 617, 619, 621, 624,625, 627, 628, 629, 630, 631, 632, 633, 634, 635, 636, 637,640, 641, 644, 646, 647, 648, 649, 650, 652, 653, 654: n = A,T,C or G
  misc_feature 655, 657, 660, 661, 662, 663, 664, 665, 666, 667, 668, 670,671, 672, 673, 674, 675, 676, 677, 678, 679, 680, 681, 683,684, 686, 687, 688, 689, 691, 692, 693, 694, 695, 696, 697,698, 700, 701, 702, 707, 708, 710: n = A,T,C or G
gtttaagcagctctngttctttttgcaggatcccatcgattcgaattcggcacgaggggacgtccangatcaagaggccagcagattcggactccgctgagggctgtttcccgatccatagatggtgccttctcgctgtatcctcaatggtagaagcacaaacaagcaagctccttcctgcctcttttataaggactccaaccctgttcatgagggctctgcccccatgacccaatcagctccaaaggccccacctcctaatactgtcaccttgggggtgagaattccaatgtgaatttgcagggggagtgggggacacacacaaatttcggggccataccacccttcaccacaccctcctgcgctcagggtggcttgcagtccctggcccttctggtgggcatttggtatgtcctttctcttggggtgatttctgatgtttttactctatatagtgaaaagctagggagagcgggtcttctcccccctccctctccagtcccctcacaatcccagatgggttctaatgcagctgctggggcctgatgccctgagttgtttgtgattcaataaagaatccataagaaaaaaanaantncntnnannnnnnnnnnnnnangnaannannnnnnnnnnnaannggnannnnnannnntnaannnnnnnnnannnnnnnnnnnntnntnnnntnnnnnnnntnnntctcnncn

SEQ ID NO: 3740 - DNA, 702 bp, Homo sapiens
  misc_feature 3, 11, 17, 37, 60, 65, 85, 409, 414, 439, 440, 444, 450,476, 479, 505, 511, 516, 531, 548, 571, 577, 594, 595, 597,612, 629, 638, 647, 650, 665, 669, 694, 699: n = A,T,C or G
gtnatgttgcnatgctntttgcaggatccatcgattngggaaccaggggctgcagaaccngcccntccccaatgaggaccccctntggacgcccctccccatggagaacaccaggagccacagaccccagaccacagagcacacaggggagggcacggggcggccggggcagggtgtctgctgcctcgtttatgggatttgctccgcgtctagcacactgctgcctgcagtgctcctgtcccctgcagtggctactctgggcctacgggcctaatcctggttggcatgaaaatgtcctgaggctactgtgacaaatttccacaagctgagtggcttaaaggaacacatttgttctcttacagttgcaggggccagaagagtctaaaaacagtcagcagggctggttccncctgnaggcttataggggctgaatccggtnnctgncttttntagtatctggagggcgcctgcatccnctngcttatggcccctttcatcaccaaanccagtngtgtnacatctttccacctnttcctgaccctgacctncgccctttctcttaaaaggaccntgtgtnactttgggcctacctanntnatttagggtatttantatttaaggaaccctgnattttaatnccactggcnagnaccttttgccaggtnaagngacaaattccaagggttttaggatnaaaantgg

SEQ ID NO: 3741 - DNA, 709 bp, Homo sapiens
  misc_feature 11, 17, 32, 37, 38, 40, 52, 63, 77, 98, 103, 110, 114, 117,118, 120, 125, 130, 135, 154, 157, 167, 170, 172, 190, 191,192, 195, 205, 209, 210, 212, 224, 225, 226, 236, 240, 245,252, 254, 258, 274, 282, 285, 286, 294, 300, 304, 345: n = A,T,C or G
  misc_feature 349, 351, 359, 367, 368, 371, 373, 386, 403, 406, 409, 410,411, 414, 416, 417, 418, 423, 430, 431, 432, 435, 438, 440,444, 446, 448, 450, 454, 486, 495, 496, 501, 502, 504, 505,506, 517, 520, 523, 525, 526, 527, 528, 536, 541, 542: n = A,T,C or G
  misc_feature 547, 551, 561, 570, 574, 592, 596, 612, 621, 625, 628, 648,655, 656, 660, 665, 676, 684, 695, 700: n = A,T,C or G
gtcaaagctgntctcgnatgctgcggaccctncatgnncnagtgccttccgnaattgacccangctgggagctattnacacatgtccatgtgggatanagagngcatganagcncannancccancctgntggtnacacttgctcatctgaggnctnacctggatancananacctaatccatggggacnnnaancacctaatgngctnntntgtaaccatccnnntgggtgaatnaccngaggncgaggantngacnacctctgtgacccacnctgggatnaannggtgctantataantcgntgctggcttgactcctgtgcctaagtgatcctcctgccttnactngngactagtnaggactannggncnacaccggcacacntggctaattgcttaaantcncannnttntnnntgganacgggannntantgngnacgncnangntggncatgaacttttggccttaagcagaccttctgntgcggcctnntaaanngnnnggattgatccnctnagncnnnnccatggcncatannattanctanaggtttaatnttaggtgantttnaccgtatattgaaatgcncaantcttaactgccagccnttaaagaantccnatngagatgtaatccatatactntagaaanntgtncatanttcaccatgcnttatttgnagggtgaccanttcangggttattt

SEQ ID NO: 3742 - DNA, 709 bp, Homo sapiens
  misc_feature 1, 9, 620, 677: n = A,T,C or G
ngttaaganacagctctgttctttttgcaggatccctcgattccgaattcggcccgagggctattaaaaatgtaatcagtgtgaaaattcatgccatctgaatcgtacgagtatgtaagggatttgagttccttacagaattttctgtaatttagtacttcaagtgacttataaatgtatatacttctctctcacaaaagtgttaggagaaggaaaatcttaaatactagcttgatttcttaatttaataacaaaaaacaattctcataacatgtatcacctaacatgtcactttcactttaaaagtctaaagagttgaggtttatttcttttcttttaaagttgatgtttatgttggtgatttcgaaaagatcagatcccccgttatgaaggatcttaaccttgtcttttagatctccatgagaaatgcagtacatgtagcattagccatatttcttttttagaggcctatgtaggatatttataacctgtaaaagtttgatgacttcatgctcaggagaaagcaagtaattacctagccaagccaggtgggtgttcaggttagtggtaaacagaaaggagatgttgaaagatttcatatctaaagggtaaaaacacangagaagtatatagagataaacatgtaaagtataagactggtacatagtaagctcctncgaagtggcagccattggtattatttttctgg

SEQ ID NO: 3743 - DNA, 710 bp, Homo sapiens
  misc_feature 4, 18, 84, 113, 116, 407, 564, 574, 590, 591, 618, 625, 637,640, 671, 675, 688, 697, 698, 699: n = A,T,C or G
tgtntatagcggctctcntctttttgcaggatccctcgattcgaattcggcacgagctctcaaatagaaatgggagataagaantatatctgtgcaatattaaattgaaaaanggnacccataaaaagtgtcaaaggcaaataatttgctctagatcacaaaactagttagcacaaggctaggattataaccagggtctaggaaaaaatcctgaaggtgatttaactgagtgttaggccctgtcaagccacctgctaaggctcatggtctttcagactagcttcaacattccaaatcaggcaatagctacaacggaaagataattggacggggaatcctgagatcagagtcctagtttggctttgtctcttgtagcaggattttttaaatcaggggcagctctcttntcccatcccagccatgaatctttcaaccttagtggtcaccaacttgactccattccttatatcaagccttgtcctgtcaattctcccttaaatgttaagttgcatccatttctaaatatatccatggccatcaccctagtgaaaagactattacctnacaccccgcnctttgatcttcccccnncttttaagtgactcaattccttatatnactgccncaagattaacanccntgtccatctttcatttctctgctgaaagatntcanggggtcccctgantccaaatannngttcgatccct

SEQ ID NO: 3744 - DNA, 708 bp, Homo sapiens
  misc_feature 2, 5, 16, 19, 20, 659: n = A,T,C or G
gnttntcaagtgacangannagctctggtccctcgattcgcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgtgcttcctcttcactccagtgctgatcctcctgctctctctggcagcttccacctcacccgcccctcttccacactataaccagtatggttggtgctggggcattgactcagcccccctgctttctgcatttgtaatagatattaatatgatttcctaaaacagaagattttgttgctttctttgaacttgtattgaaaaccatacagtctcactgttttgctttaattcctatccacactataaatggaagaaaaaaattaatagcttctgtttaatctgatgaatgtggctttttttcccttcactttaatgttcaagaagttggnggctatttcatagattcttctggattaatctgggggtccctggtatctg

SEQ ID NO: 3745 - DNA, 709 bp, Homo sapiens
  misc_feature 45: n = A,T,C or G
tttttacatcagctcttgttcttgcaggatccctcgattcgccgnattgggctatggaattggaaggcctgttttggagtactctaaattaaaaaaaagttatatttgtaaaataaccaccacaagattgcctgattcacagttcttctgagtattggcgtaggtaattatttaagatgtttgataaattgtaaaatgctttttacattttttaaggaatcaattgaactactggaaaccagtatgtagtattcttggcaggtctaggtttcataatcctaatttctttgcagcccactattcagaaatgtagtgattaacagagtcaagaatgtttcaggatatttttggctacaagtaacaatacctaactaaaagtgacttaaataataagcagtttgttatttcacagaatgagaagctcagagccagagagttacagggttggttcagcagttcagtttcatcaagaacataagacttgcttactttaaagctcctctgcatgtcagcagagggctgccccaattttagataccaacatctggccaaagaagagcagggaatgcttctttaagtacttattagggagcaaaacttccttaaaagtctcataggaggtttttccttaggtctcattggatctcaatggctcttgcatctagaaaaaggccacattccttactctggcatttaagtttttataccg

SEQ ID NO: 3746 - DNA, 752 bp, Homo sapiens
  misc_feature 5, 6, 9, 10, 18, 23, 28, 31, 32, 69, 97, 102, 118, 142, 143,146, 156, 182, 187, 192, 196, 209, 233, 240, 273, 289, 294,302, 319, 338, 355, 388, 400, 455, 459, 474, 476, 486, 519,524, 526, 541, 586, 594, 596, 602, 604, 612, 614: n = A,T,C or G
  misc_feature 618, 707, 711, 733, 744: n = A,T,C or G
ggctnnttnnccttgttnctttntgganctnnctgatccctcgattcgaattcggcacgagaggagatngggacagagcatcctaagattcaggagnttttnctagtcacagggagcngtgctattcagaggccccaaggtnnganggagtttggnctgtccaaggaacgcaagaaggtcantgcanctgangcanagtaagtctgaangagagaggtcagggctgagatcanggaggtngtctgaggcccctctgagggggacctgataaangggtttgaattcattntgaantgtaatangtccatattagaagcanaaactataaaaggagttangctgataaacctagggntcataacagcacgaaaaaggcaatagataatangacacaagcaanaaaaaattcacgtgattaaaataatacacttgcagagcttacaaagagaaatgtnagtnatccaggaaatctantngcatctaagncttcattcatcttaccagataaatgaaatgctnaaatntnagttgcttgcatacntaacacacagatattcttttatatacacacattcatgtcataaancatgtgangnttatcnanaagaattnanaatncttgtgatgagctttacttaccataggtcatattataatgattaatgagggcatttgaaatgtatttcacctatcttgagatttgcaanatgngtatgaaacatgtcatatcatnactatgcactntaaaagag

SEQ ID NO: 3747 - DNA, 757 bp, Homo sapiens
  misc_feature 16, 18, 27, 30, 293, 305, 309, 334, 344, 367, 382, 391, 402,403, 420, 425, 429, 433, 439, 449, 461, 464, 467, 470, 472,475, 483, 490, 520, 526, 536, 562, 563, 570, 576, 593, 627,629, 644, 732, 738, 742: n = A,T,C or G
gtcttcttcaagatgnancgctttcgnccnttgcaggatcccatcgattcgaattcggcacgagaccattttattttttgggccattaccctttaccccttattgctgccaaaaccacatgggctgggggccagggctggatggacagacacctccccctacccatatccctcccgtgtgtggttggaaaacttttgttttttggggtttttttttttctgaataaaaaagattctactaaaaaaaaaaaaaaaaaaaaaaaaaaaaaaaaaaaaaaaaaaaaaaaactcgancctttaaaactntagngagtcgtattacgtaaatccagacntgataagatncattgatgagtttggacaaaccncaactagaatgcagngaaaaaaangctttatttgnnaaatttgggatgctatngcttnattngtanccattntaagctgcantaaacaagttancancancantngcnttcatttnatgtttnaggttcagggggaggtgtgggaggtttttnaattcncggccgcggngccaatgcattgggcccggtacccannttttgtncccttnagtgagggttaattgcncccttggcgtaatcatggcatagctgtttcctgngngaaattgttatccgntcacaattccacacaacatacgaacccgggagcataaagtgtaaaaccctggggtgcctaatgagtgagctaactcacattaaattgnggttgngctnactggccgctttcaa

SEQ ID NO: 3748 - DNA, 750 bp, Homo sapiens
  misc_feature 5, 11, 14, 94, 638, 663: n = A,T,C or G
cttanacaaantcntgtgacttgctctttttgcaggatcccatcgattcgctcagattaagggtttgaaaaacaaaccgaaaaagatgggcttnataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagagtttcgctcttgttgcccaggctggagtgcaatggcgcaatctcggctcactgcaaccgatacctcctgagttcaagcgattctcctgcctcagcctctcaagtagctgggattacctgcgtatgccaccacacccagctaatttttttttttgaatttagtagagatgggatttcaccatgttaatcangctgatctagaactcctgacctcangtgatccacccgcctcggtcttccaaaaggactggggattacaggcgtgagccactggacccagccgctaaacttttaataaggatt

SEQ ID NO: 3749 - DNA, 751 bp, Homo sapiens
  misc_feature 2, 4, 5, 7, 11, 15, 22, 26, 96, 611, 627, 647, 652, 695: n = A,T,C or G
cntnngnagancctntttgacnagcnctttttgcaggatcccatcgattcgttttgccctgctaaaatgatgcttagcctgaaaaatcggattttnacttctcaaatttatttttccaactcagtaattaaaaaaacatttacttcctgcctactgggttgtggaatattgtcaggatctctgggttccaggtgagggatgcagaatgcagggaaagacaggtcccctgccctccagaagtcggtggcgccttttcagagtaacacacactggagcagacccctggaaaaggacagtccactggtggaccatgaccttggtcaaaagagggaccaggtctggcttgctcactgttttgcacccaagaagtatttgctcagggaatgagggggttagattcctcctcattcattaccattcttactaggcagaggcctcattgggattaaaagacaggaatgtaactctctgcccactgatagggaatgtgtgtttgctctttgtatcccaggggtgtgatacctctttcctgtggtcactctgcacttaagatattttggggcctggcacggtggctcacgcctgtagttccaacactttgggacgccaangtgggcagatcacgangtcaagagatcgagaccatnctggncaacatggtgaaaccctgtctctactaaaaatccacagattanccaggcgtggtggcaagtgccctgtaatcccacttcttaggaaaactgaggcagga

SEQ ID NO: 3750 - DNA, 753 bp, Homo sapiens
  misc_feature 337, 352, 353, 354, 359, 364, 366, 371, 377, 424, 499, 554,570, 603, 611, 617, 621, 626, 627, 629, 634, 635, 640, 649,653, 657, 660, 662, 674, 678, 680, 687, 688, 690, 691, 696,697, 700, 704, 710, 712, 715, 716, 717, 721, 723, 728: n = A,T,C or G
  misc_feature 740, 742, 748, 753: n = A,T,C or G
tttttaatccttgctcttgttctttttgcaggatccctcgattcgcagagtcaacatggagcatctcactgtgaaatgatccatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagttcagtgtttcttgtatgcttgaaaataaagtatgtactgntttgaatgtgaaaannnctatntaaananactcnagcctntagaactatagtgagtcgtattacgtagatccagacatgataagatncattgatgagtttggacaaaccacactagaatgcagtgaaaaaaatgctgtatttgcgaaatttgtgatgctatngctttatttgtaaccattataagctgcaataaacaagttaacaacaacaattgcnttcattttatgttcangttccaaggggaggtgtgggaggttttctaatnagctgtcnactatncccnttgcnntnttatnncaccnaatttttgnttcntttnaananaccctatttccnggcntngccctanncnnggttnnaantgcnttcccntnaannnatcntncttgntttggccttccnanaatgcngggan

SEQ ID NO: 3751 - DNA, 781 bp, Homo sapiens
  misc_feature 3, 5, 6, 14, 91, 101, 102, 408, 456, 509, 533, 546, 552,560, 563, 564, 572, 574, 575, 576, 580, 584, 592, 596, 601,615, 616, 618, 620, 641, 643, 649, 651, 653, 655, 656, 665,666, 667, 670, 672, 675, 676, 677, 678, 679, 680, 681: n = A,T,C or G
  misc_feature 682, 687, 688, 692, 694, 698, 699, 702, 709, 710, 712, 715,718, 720, 721, 722, 725, 730, 731, 732, 733, 734, 735, 736,737, 738, 743, 744, 745, 746, 747, 748, 752, 754, 755, 759,760, 761, 762, 763, 766, 768, 769, 770, 771, 772, 778: n = A,T,C or G
gcntnnaagacccncttggaaattccccttttgcaggatcccatcgattcgaattcggcacgagcagcggcgaggtctgcgggaggcatgntttttagctnnggacgagcgccggcggggccccgcggcaggggagcagctgcagcagcaacacgtctcttgccaggtcttccccgagcgtctggcccaggggaatccccagcaagggttcttctccagcttcttcaccagcaaccagaagtgccagcttaggctcctgaagacgctggagacaaatccatatgtcaaacttctgcttgatgctatgaaacactcaggttgtgctgttaacaaagatagacacttttcttgcgaagactgtaatggaaatgtcagtggaggttttgatgcttcaacatctcagatagntttgtgccagaataatatccataatcaggcccatatgaacagagtggncacacacgagcttattcatgcatttgatcattggcgtgcccatgccgactggntaccaacatcagacatttggcccngctcaaaggttcngagctngctaaccntanngggagacngnnnaacntggncaaatganatantcaangccacatttacggnncnanaacaacaccaccaaacttggngngcgaanananannccctctttnnnatncnggnnnnnnnngaacnncaancncaannaanaagcctnnanaangcncnnnganccaannnnnnnnnaaaannnnnncaancnncccnnnnnccntnnnnnaagganccc

SEQ ID NO: 3752 - DNA, 699 bp, Homo sapiens
  misc_feature 1, 25, 48, 119, 120, 128, 398, 472, 540, 572, 575, 583, 602,604, 613: n = A,T,C or G
ngttaagacctgctcttgttctttntgcaggatcccatcgattcgaanaattttatggacttctatggatatttcttgatgcttagagatttgtttttttaattgcaaatgtgaattgnntatttacnaatgctattacatatggagcgggcctgtggtgtatggcactattccttggactaatggtacccaggttccattctctgctcagctcggtggctctagacaaagcccctaaaatgctgtctgcttcagtctccttaatggtgaagtggaaatgaatacctactgtcacttaactcatggagatgctggactgataattagatcatgtaatagcactttgagctgtattgaaaaatatgttgtctcaaattaagtagagtctatggttttgnaaatataaatatattgccagaaaatacatcactgggggagcaaaacatgtagaccaaatataacagggattagnaacatcagtaaacatagttgggaaaagatggcactaaagaaagccaagaagaaagtgttgctcttgtnaaccaaataaaaaaaaaaaaaactcgagcctntanaactatantgagtcgattacgtagatncngacatgatnagatcattgtgagtttggacaaccacactagaatgcagtgaaaaaaatgctttattgtgaaattgtgatctatgctttattgtacc

SEQ ID NO: 3753 - DNA, 729 bp, Homo sapiens
  misc_feature 7, 10, 13, 32, 38, 50, 54, 62, 67, 82, 83, 86, 87, 88, 89,92, 94, 102, 103, 105, 106, 109, 111, 125, 136, 140, 144,147, 155, 185, 186, 205, 211, 212, 234, 237, 246, 268, 271,278, 290, 295, 297, 303, 304, 306, 311, 313, 319, 321: n = A,T,C or G
  misc_feature 322, 328, 330, 339, 340, 355, 358, 364, 374, 400, 431, 452,453, 462, 463, 469, 471, 478, 483, 495, 496, 499, 506, 512,516, 522, 524, 532, 545, 547, 553, 554, 557, 558, 561, 569,570, 576, 579, 589, 597, 607, 611, 613, 622, 623, 624: n = A,T,C or G
  misc_feature 625, 627, 651, 653, 654, 669, 671, 683, 686, 690, 695, 700,707, 708, 709, 717, 719, 720: n = A,T,C or G
ggatccnatngcnggatcccatcgattcgaancccgcncgagtctaggcntganccattgcncccancccaggtttttaatnnaannnnaancntgctgagnntnnaangngaaaagaggccagntgtggtggctnctgnctgnggncccagctnctccggaggctggcgcatgaggatcatttnngcccaggctgcaatgcaanggcacnnatcacggctttctgcatccttnacntgctgggcnggacacggagaccctgtttatnaangatgaantgctggagtacncaatngnatatgnnanataantncaactntnntaaagnanctgtatatnnaatgagtggaagcanatntggcanactgttaatngtacatatattgaaactatagctttnacacttctttgaccacaacgggtatatgtancacttgatatgatgcacaatnngtgcaccanntatatntntgtcttntgacntgggttttgacnnagnttcactntgcgtncagncttgangntgctactnactgaagatcggngnaaaatnntcnnctncactgggnngattanaanatatactggngttatcantggaagaaangttntntacccaaannnntngaaccctcttttaaaaggattggntnnagtaaattttaccgntnggttcccctacnttntttncaggnttccnttttggnnngagttttngnnccaaacccc

SEQ ID NO: 3754 - DNA, 751 bp, Homo sapiens
  misc_feature 3, 596, 618, 630, 703, 735, 745, 747, 749: n = A,T,C or G
ganggctcttgttctttttgcaggatcccatcgattcgtaaatgttgaaattaactagacaaagtagttgaagtcctgatgaaaagattgttcagttcttcttctcctgtagctcagaacctgtttggatcatacatttaaatgtagaaatataaagcttttagaagaaaacataggtgaaaacctacaagacaaaacttggtgaagagtttctccatgtgatgcaaaaacatgatccatagaagaaagaaatctgtaaattggactttatcaaaattaaaaacatttgctttgcaaaatgccctgttaagatgatgaaaaaacaaactacatactgggaggaaatacttgaaaactgcttatctgacaaaggactcttatctaggatatataaaaactaaaaactcaatagtaaaaaggcaaacagtccaattagaaaatgggcaaaagatattcatttcgccaaaaaggttatacggatgtcagctgaacacatgaaaagatgttcagcatcactagcccgtcagaggaaattgaaaaatgacatattacccacacacctattagaacagttggaactcttgcttgaaccccangaagtttaaagacccggcctgnaacaaccaccangccaaggaaccttgtcttaaaaaaaaaattaaaaatttaaaaaaattagcggacccaattttggaaattggcntgggcaaaaggaatttttgaaagaaaaatcangaacttcttnantnac

SEQ ID NO: 3755 - DNA, 720 bp, Homo sapiens
  misc_feature 5, 6, 7, 8, 9, 10, 13, 15, 16, 17, 18, 19, 24, 622, 647: n = A,T,C or G
tgggnnnnnnttntnnnnntacangctacttgttctttttgcaggatcccatcgattcgaattcggcacgagaagatgtttgattcttcagataacttttgaaatgtgctataaagggcctagtttaaaaggaacttcttttgaaaagcaattaacagttgataaagggttaaataaaaattatctagtaaggaatttcttattggaatgtaaacgtggttctaattttaaatagacagtgatataaagaataaaaagtaaacagtgaaattgagttctccagggaaaaggcagacctgtttagtaaaaaaaggatgcttttttcagtgatgtctttttttgagtgcatatgtgtgtgactcttgaagaaatccatgttcagatttatcagatgattgaagtgggtgttctgaataaagaaagctgtgaggcctgaggcagtgacgtatcaggaaacatattttattggagatttggaagctatagtaaaacataatggcaataagccaacttcccagtggtaaacccacagtggtggtttagttactaacctcttgatgaccgaggaggttaataattggatattgcagagcagcaatatgtaacctgtgtgtaatctcanggccctcaggttaacagtttcagtnagaagctaagagaacactgacaaaatttagcttaccatgactagctgccagttttatgtgggcctgtgttccc

SEQ ID NO: 3756 - DNA, 715 bp, Homo sapiens
  misc_feature 2, 3, 4, 6, 7, 8, 13, 14, 17, 18, 596, 653, 679, 683, 685,715: n = A,T,C or G
gnnntnnnttttnnatnnacaggctacttgttctttttgcaggatcccatcgattcgaattcggcacgaggtcagaatggggaaagtggcaggatgcaggcaaacatgttcttaatttagagacagatgaaggctcaggactttcctaggcagataaaagaagaaagaagctgctttttgaaaagagggatcaagattaggacaaaaagggagattcagccatcagcagaacccaaatgagagcctacaaagagacactgtctactcagagtacatcttcagacatccagggtcccaagctactgtgtttactgttagcccttagccattgttaagtcttactgctttataactcttctttaagaatatattaatagtaaaattacttactcctatatatacaacgaatccttaattatcaaaaacatttatagtcatcacctcatgattcagtttgcccttctctagtccaaatgaattgaagtaggaattcataggaccgttcctagtgaagaaagattttagtgctatttaaagaaagtaaaaagtatattctcctctgatagaaattttcattctgataatattttatttgnatctttttttaatgtcatggcaagaaatgcaagttgatgggcaagggacaatggctnacacctgtaatcccacactttgggangccnanatgggctgatcacctgaggcaggagttccn

SEQ ID NO: 3757 - DNA, 705 bp, Homo sapiens
  misc_feature 4, 5, 6, 7, 8, 9, 12, 14, 15, 16, 19, 355, 392, 517, 528,551, 580, 621, 622, 624, 630, 634, 655: n = A,T,C or G
gttnnnnnnttntnnntanacaggctacttgttctttttgcaggatcccatcgattcgaattcggcacgagggcatctggactaatagtgaaagagtggaatagtgtgaaactgcatgctacagttatgaatacactattcaggaaagaccccaatgttgtttgagaacttctactttggctccctaaagctgaattcaattcacatctctcagaggttcaccgtagacagctttggaaactacgcttcctgtggacaaattgacttctcctgaggtggatcttggaaagcactagaaactaaacatcttcaccaggtgctgaagaaaagtgtcttcgttttaattgccaagcanggatgtggacatttggatggtgacttccctgggtggntccccatagattcaccattgcctctaatggtgtctacacccgtcatactaccagctgagatggtggtgggcataaggagaatttgtgcctatacccttagtgggtctggttttttcttttaattnttaaattgtcntaaaatctcataaaacatactgncttcaccatttttaaagtgcacagtttantaaccgttactggtaatccttcataatgctgtgtggcccgnnancgccgncatnttcataggcttctcacttggnaaaatgggaactggcccattaacaagaattccactcctccaaaaaaaaaa

SEQ ID NO: 3758 - DNA, 714 bp, Homo sapiens
  misc_feature 4, 5, 6, 7, 8, 12, 17, 226, 569, 594, 642, 652, 673, 699,714: n = A,T,C or G
gttnnnnnttcnatatngacaggctacttgttctttttgcaggatcccatcgattcgaattcggcacgagaatatatcacatcatgtaataagcctctcagagatgtagcattgagcagattaaggcctcatttatagaagaattccaccctggccatgtgggcctgaaactctggagggctttaacaatgtcttgaggtcattgtcatttaaagagatgactcantggttttatttagtagaaataaatactaaataaataatctccacagattatccagaggggtaagttgaaggatgttgacagataactcagtaaattgcgtctcaaatattaataagtttattctatgccagcaccaaaaatatttcagagatgcttttaggcttctctcaagtatgtcgggaacagaaaaggattatagaaatatttatagtaggcataaacttgcacaaaagctcaaagtaccttaagcaagcttgttgcaattattcttttggagaactggattaagtaattatttcttgttgcctctgactatttaacctcctactaaactgcccattgnttaaatgtctcttatttagctctgnttttatcactccttaaatttaatattctcaaggccaaaattatagcantgatggtcangacatctttgaagacaattanattctgagaggataatttatatgtanaattaggaatattcn

SEQ ID NO: 3759 - DNA, 710 bp, Homo sapiens; identical to SEQ ID NO: 3743
  misc_feature 4, 18, 84, 113, 116, 407, 564, 574, 590, 591, 618, 625, 637,640, 671, 675, 688, 697, 698, 699: n = A,T,C or G

SEQ ID NO: 3760 - DNA, 717 bp, Homo sapiens
  misc_feature 2, 6, 9, 14, 16, 18, 55, 442, 478, 554, 582, 599, 603, 612,625, 638, 644, 658, 661, 667, 671, 676, 696, 706, 707, 708,712, 714, 716: n = A,T,C or G
gnggcnttntgtanangntacagctacttgttctttttgcaggatccctcgattngcagtcctctgcataaagctgagagatgcctacagctgagagtgaagcaaaagtaaaaaccaaagttcgctgggaagaattgcttaagacccacagtgatctaatgcgtgaaaagaaaaaactgaagaaaaaacttgtcaggtctgaagaaaacatctcacctgacactattagaagcaatcttcactatatgaaagaaactacaagtgatgatcccgacactattagaagcaatcttccccatattaaagaaactacaagtgatgatgtaagtgctgctaacactaacaacctgaagaagagcacgagagtcactaaaaacaaattgaggaacacacagttagcaactgaaaatcctaatggtgatgctagtgtagaggaagacanacaaggaaagccaaataaaaaggtgataaagacggngccccagttgactacacaagacctgaaaccggaaactcctgagaataaggttgattctcacaccagaaaacacatncaaagcccagccaggcgttgatcatcanaaaagtgagaaggcaantganggaagagangagactgttttanaagaagattgaanaattgntgcagccttttcantgncatgtnactngaagnaatgggcaaaggagatttanaggggaattnnnaaanancnc

SEQ ID NO: 3761 - DNA, 740 bp, Homo sapiens
  misc_feature 24, 112, 633, 689, 697, 699, 701, 703, 704, 706, 709, 713,717, 720, 722, 723, 726, 730, 732, 733, 736, 738, 739, 740: n = A,T,C or G
attttatgcttgctctgttctttntgcaggatccctcgattcggctgggctagcagaaaaacctcaggcatctgtgaggacatgagtttacacacgctgagactcacagatncaaaaatgcaacccaattccacccctgaattgaggggagtgcatagaagtgaatgtcccgtctttctgaggtctgttgattttgtaattagtaaacgaagggtgcatttctgatttttttttcttgtgtgctagaattcattgctagtaaaactcaagataatagcgatgagtaggaggtatcaaagatgaactgtagagggacagtttaagttacttaagaatcgtcagcaagatgaaatctacttttagcagaaattgggtttttttgtgtttttttgttttgttttattttctaaaagtaaagtctgcaccttgttcagcctgttagtggaggtctgagcaagtaaaagatgggttggattataaacttacaaacacaggatgttctgtttctcaaacgggagaaattaagaagagatgcttgtattcaggagacggcatagctactcaaaatccttgatatcttgctatggttagtcttgtccaactgtgctatgtgacctactatggctttatgangtaaatttagtatatgtgtcactatttgaaaatttacatatagttatacataatgnatttaagngncnanngnacngaancctnggngnnaanattngnnccntnnn

SEQ ID NO: 3762 - DNA, 710 bp, Homo sapiens
  misc_feature 4, 5, 9, 10, 16, 33, 77, 93, 418, 443, 513, 678, 687, 688,689, 692, 693, 694, 695, 701, 709: n = A,T,C or G
cttnnaatnncagctntggctacttgttctttntgcaggatcccatcgattcggtcagatggtagaaaatgaaatanttaaatagataccatntgagttctgggagccaggtgaagaagtgtttgtttgtttttgagacggagtctcactctgttacccaggttggagtgcagtggcctgatcttggcgcactgcaacctccgccttctgggctcaagtgattctcctgctccagcctcctgagtagctggggctacagacgtgtaccaccacacctggctactttttgtatttttagcagagaggggatttcgccatgttggtcaggctggttttgaactcctgacctcaggtgatctgcccaccttggcctctcaaagtgctgggattacaagcgtgagccactgtgcccggccanaaggagtgttttgagaatggctaanagaagataggttgaatagctatgcctacatgtcactaattaacatctcagagatctctgctacaggttgncgacctcatttagtctaatatttttccaatggcatgagtataggaagataaacggggaatgttttgaagtaataaaaaaattccatccataaagaagaacaacatgtattaagctttgtgcaccaaacaacacaacaggaagacacataaggcagaaccttttanaaaaaaaannnggnnnnccaaanagcaggtnt

SEQ ID NO: 3763 - DNA, 710 bp, Homo sapiens; identical to SEQ ID NO: 3762
  misc_feature 4, 5, 9, 10, 16, 33, 77, 93, 418, 443, 513, 678, 687, 688,689, 692, 693, 694, 695, 701, 709: n = A,T,C or G

SEQ ID NO: 3764 - DNA, 713 bp, Homo sapiens
  misc_feature 4, 5, 7, 45, 118, 282, 331, 375, 403, 442, 476, 483, 493,537, 565, 571, 604, 613, 620, 623, 633, 643, 651, 659, 664,665, 669, 678, 680, 682, 686, 709, 712, 713: n = A,T,C or G
gttnntngatcagctcttgttctttttgcaggatcccatcgattngaattcggcacgaggtaccacatctagatacgaggtcagagttcagatgcctaaatattgtagcttgtgtttngtccactgttgggggaagagtgaagagatttgacataccataatgttgattagcttgtgatggtttggcggcagcttaggccagagcataaagtaaaaaggaaaagtgttcacagacaatgaaaactgggaccaagtggtgaatactcaaggcacacagaccangcaaggatcccagtggccgtggatgagtctcaggctggctctgggccantggaacacacctcagtgtgggtgaaggcctagccagggtagcanagggcagggctacagaacagcagcccangtggctgtggccgacctgacattctcctgtgaaaatcangtgcccaaccagcactaacctagatagatggcancattttntttctttaangacaggatcttgctatgttgctcaggctgactttgaactcctgnccttaaaggatcctccctcttcagcttnccaaancactggggttacagatgtgagcccttcaacgtnagtgccatngggctanaancctaaccccncattgcttgntgatcgtnacgctcgnaatcnntttnataaacggntntncaanccttgagcttttccgggttaagnaann

SEQ ID NO: 3765 - DNA, 702 bp, Homo sapiens
  misc_feature 12, 14, 28, 41, 48, 67, 93, 113, 197, 210, 224, 231, 234,253, 254, 256, 257, 274, 276, 278, 280, 281, 288, 304, 305,312, 316, 320, 321, 324, 332, 334, 336, 339, 344, 345, 346,349, 359, 360, 361, 362, 364, 365, 372, 379, 383, 385: n = A,T,C or G
  misc_feature 386, 388, 395, 397, 398, 400, 403, 417, 421, 427, 436, 452,455, 469, 483, 490, 491, 512, 520, 526, 534, 553, 558, 568,571, 582, 586, 592, 594, 598, 614, 627, 630, 640, 646, 649,654, 655, 657, 679, 680, 683, 697, 702: n = A,T,C or G
gttactcctctnanatcagctacttgangatccctcgattngaattcngcacgaggcgatttatttnacagagttaaggggccagtacacttnatggtataaaattatctttntcaggggatgaaggcacaaggagaaaattacttgaagcttggagatcttctctggcaagcaatttacaaattctggtgttcttngatctggctcccngcccagacaaccanggagttnttnatgttctatcctcatgtgnnannactatacgcaataattngncntnngccatanaggagggatccgatanntgacatngctntccnncanatatactncncntgnaatgnnnctnataatgcatnnnntnnattcctntctaggntacncnnanttatatntnntnggnaactcatttaacancaanttcacngcattcccntggggttacatatacnctnaagactatgctganactgtgcaccatgnctacatnngggaattggatggggtgcttnacggactnccttgnatgcaagnacttaccagacgtttccanccaanctgacattgntgnaatgcattacncacntggtgntncaantttactacacctcganaggaccgttcacnggnatttaacctntcaaanatngttcnnanggttacaaggtccccaattgtnnganccttggggctttgncaacn

SEQ ID NO: 3766 - DNA, 708 bp, Homo sapiens
  misc_feature 2, 6, 11, 12, 15, 707: n = A,T,C or G
anaccntttannctngttctttttgcaggatcccatcgattcgaattcggcacgaggtatactttgacactgagaacaaagagacagttatatctggaatgggagaattacacctggaaatctatgctcagaggctggaaagagagtatggctgtccttgtatcacaggaaagccaaaagttgcctttcgagagaccattactgcccctgtcccgtttgactttacacataaaaaacaatcaggtggtgcaggccagtatggaaaagtaataggtgtcctggagcctctggacccagaggactacactaaattggaattttcagatgaaacattcggatcaaatattccaaagcagtttgtgcctgctgtagaaaaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaagccttggcaaatgcaacattatgtattcttgaacctattatggctgtggaagttgtagctccaaatgaatttcagggacaagtaattgcaggaattaaccgacgccatggggtaatcactgggcaagatggagttgaggactattttacactgtatgcagatgtccctctaaatgatatgttgggnt

SEQ ID NO: 3767 - DNA, 715 bp, Homo sapiens
  misc_feature 2, 3, 4, 5, 6, 16, 17, 22, 25, 663, 667, 678: n = A,T,C or G
gnnnnnttctaatgcnnggctnttntgcaggatcccatcgattcgctcccattcccggaaggaggagacagttactgtctatcccgcagacgtggtgctctttgaagggatcctggggcagaatgaggtggactatcgccagaagcaggtggtcatcctgagccaggatagcttctaccgtgtccttacctcggagcagaaggccaaagccctgaagggccagttcaactttgaccacccggatgcctttgacaatgaactcattctcaaaacactcaaagaaatcactgaagggaaaacagtccagatccccgtgtatgactttgtctcccattcccaggaggtacgagacctgttccagatgaagctttttgtggatacagatgcggacacccggctctcacgcagagtattaagggacatcagcgagagaggcagggatcttgagcagattttatctcagtacattacgttcgtcaagcctgcctttgaggaattctgcttgccaacaaagaagtatgctgatgtgatcatccctagaggtgcagataatctggtggccatcaacctcatcgtgcagcacatccaggacatcctgaatggagggcccttcaaacggcagaccaatggctgtctcaacggctacaccccttcacgcaagangcangcatcggagtncagcagcaggccgcattgacccgtcttcatcggaccc

SEQ ID NO: 3768 - DNA, 724 bp, Homo sapiens
  misc_feature 4, 10, 20, 133, 136, 144, 152, 185, 215, 229, 238, 252, 253,284, 287, 293, 299, 308, 319, 325, 328, 331, 336, 340, 349,368, 370, 371, 379, 389, 390, 411, 412, 413, 439, 448, 452,461, 468, 471, 474, 477, 480, 501, 502, 505, 506: n = A,T,C or G
  misc_feature 516, 518, 520, 524, 525, 529, 532, 533, 534, 535, 544, 552,555, 556, 559, 560, 561, 562, 563, 567, 576, 606, 612, 615,618, 627, 629, 635, 636, 645, 656, 660, 662, 666, 677, 678,679, 683, 694, 704, 707, 713, 719: n = A,T,C or G
gggnctttanatctataggntacaggctacttgttctttttgcaggatcccatccgatgcgcaagtaagaaaacatggcggctatccttctctcacatcgaaaaggaaattttgaacaatcatggaaaatctnggncgtgctgngaaaacanagaagagaaatgttgcaggaaagattgtttaanactaatgaaataccttttagaacagctganagaaaggtttaacngacaaaaancatctggataaatnntcttcttatcatgtgaaaactgccttctttnacntatgtncccagnaccctcaanacagtcagtgngaccanacnganctggncctntgctttganaactggatgacattcttgntnnattgcctnaggtcagatnnacttgagaattagttcatccnnncttcaatctatcctcttgcagaattntttgacatntacntcagcaatntttgctntancanagnccnatgtaggatatctatgacctnncanngtttgatgantncntgcnnctgnatnnnncgagagatntcctaacnatnncannnnntaanttctggtantgctcaacagattggaaaaaggggccaganctgtgnctnaanggttaaaancncaggannagtattttncgtaaacatgnaaangnttangactgttcatnnnttgntcctccgaaantgggcacccnttnttattnattccnctgcg

SEQ ID NO: 3769 - DNA, 748 bp, Homo sapiens; identical to SEQ ID NO: 541
  misc_feature 7, 17, 19, 21, 156, 372, 453, 505, 555, 613, 649, 654, 656,666, 687, 727: n = A,T,C or G

SEQ ID NO: 3770 - DNA, 815 bp, Homo sapiens
  misc_feature 2, 7, 14, 22, 192, 318, 479, 497, 516, 545, 601, 617, 633,634, 643, 656, 696, 719, 726, 728, 732, 738, 743, 751, 781,784, 786, 804: n = A,T,C or G
tnaatanagctctngttctttntgcaggatcccatcgattcgaattcggcacgaggtcttcctgtgcagggtgctttggtagccatcagagaggaaccaagggcaacatcttttcttcccaggcgttcttctctgggtgctttattctcttctttttctttatttcgcccccacccccatcccctgcctttnttttttttttttgtatagaaacagatccatttcttggtaatcaaagcacatttgtttggtcttcctccaaccctttgcatttgatttctaaacattccttcatatgcctttaatgaaagccagcanttatcccatgggccctacttgaatttatctgaggcagctacagattgccctgcaagatgagtttttggagataaatgaaataactggacacacactcacacaagtaacaccacagcagacctcggagtactgctaagtgtacctgtgtcaaatccgcacangactcaatatagcaattnattcttgatgtatgcaatngcccattggaaattatttttaacagagcnccacttaattaatttggaataggattatataatattagaatctttggggtatgggncttttaacccttcttnccatgggggaaacttnntttcccttnccctgaatggtgngaaattgggaccatttttaaaaagcctttggtcccggtgnaaccttttggcattacccatttnaaaccgnangccnccaggntttanagaaaccntgaaatttgaagaaaaaaagggccccaatnggncnttgaaattttttaacccnatgggtggccc

SEQ ID NO: 3771 - DNA, 756 bp, Homo sapiens
  misc_feature 4, 9, 10, 11, 12, 13, 14, 15, 16, 363, 402, 438, 465, 625,638, 649, 673, 683, 729, 753: n = A,T,C or G
tggnagtgnnnnnnnnttttataaagacaggctacttgttctttttgcaggatcccatcgattcgaattcggcacgagccaggcttgaagttatctctaatttagaggttagggacagtgacacaggaaagaggctctgtgctttatatctggagatgtgggatcataaaaacgtctttttaatctgatgatcattaaaacacccggtgatgtggcacagctgctaatcggaatacatttccatttctgcggggattgagcatgtcttcggaaccctctgcaatagctttagaaacaaacgttccttttatcaggtgagaaaactaccctatggcatgcctccggatatgtagttcttcctangctacaaaatatcagaggttaacttcaggcaaaatgatnaaactagcagtagtatttcctattactatctgcagnttgcttcaaaatttcaaaaaggtttcngaaaaatcactaaatacgaagggcacacttcattcatttattccaaggaatctatttggtgccagacattgcatggaattgtatggatttttaaaatgaaatgggggctctctcttaagcagaccatggcaaggaaacttgaaaactccgacgcatccangggacgaagactnacatttacatngagatactactcgggattcacaanacacgacgtntccatgacgctcggtcaacacttgcatttttacctcatgggattcnggtcctctttcatttaaaaggcgnggc

SEQ ID NO: 3772 - DNA, 712 bp, Homo sapiens
  misc_feature 2, 3, 6, 7, 8, 9, 10, 11, 12, 19, 497, 524, 535, 626, 677,678, 688, 699, 709: n = A,T,C or G
gnnggnnnnnnntttttanatcagctcttgttctttttgcaggatccctcgattcgaattcggcacgagattgaactctgaactttggaaacctgaatccttcaggaaagagtttggtgagcaggaagtagacctagttaattgtaggaccaatgaaatcatcacaggagccacagtaggagacttctgggatggatttgaagatgttccaaatcgtttgaaaaatgaaaaagaaccaatggtgttgaaacttaaggactggccaccaggagaagattttagagatatgatgccttccaggtttgatgatctgatggccaacattccactgcccgagtacacaaggcgagatggcaaactgaatttggcctctaggctgccaaactactttgttcggccagatctgggccccaagatgtataatgcttatggattaatcactcctgaagatcggaaatatggaacaacaaatcttcacttagatgtatctgatgcanctaatgtcatggtctatgtgggaattnccaaaggacantgtgagcaagaagaagaaagtccttaagaccattcaagatggagattctgacgaactcacataaagcgattattgaaggaaagagaacccnagcctgggcacatatttctgcaaggcacgagaaatagggatttttaaaagnntagaaacagncaaaaaccacnaccatctatntga

SEQ ID NO: 3773 - DNA, 752 bp, Homo sapiens
  misc_feature 1, 3, 5, 11, 12, 16, 677, 703, 704, 708, 723, 728, 745: n = A,T,C or G
ngnanaacagnntttnagatacagctcttgttctttttgcaggatccctcgattcgaattcggcacgaggccaattccaggccctcctccacgcagtgtgccaccaacagacttctctcaactgattgattgtccagagtttgtaccaggccaagccttttgctcacatacagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcgtggaggagatcgaacaggcacccacatgtctcgggcaaaaatcacatcttgaacttgctaaagttatcaatgatggcttatattattatgaacaggatctatgggtnggaagaagattgaaaccaaacccacnngccntaaaaggggcaattncttgngaaacgccctttctcgntatgaaa

SEQ ID NO: 3774 - DNA, 751 bp, Homo sapiens
  misc_feature 4, 6, 7, 8, 10, 11, 16, 20, 212, 432, 536, 661, 667, 710,724: n = A,T,C or G
gagngnnntnntttcnaatnacagctacttgttctttttgcaggatcccatcgattcgttatagctgtgtcggtctagcattttctttgaagcatatggaacatgttctgctactcgagataatgaacatttccttctgcctcaaggtacaatcagtttatgatcctgggagagcaagaagcaaggagccagcaagtctggacacattccanaggccacgaggggttttatgtcctgagtcctggattccatccaagccatgaggggttttatgccctaggcttaggttgtagtgcggcggggcagccttccacccttaagcacagaacctggtgttccataggccacaagaagttttaaactctggacccaggacatgttccaaggctcttttcatattatgtcagactagcaagtcttgcctcagctttnctcccaacaattggactgatgggttgctccactgggcacaagcatcatgggttcttaaaacaaggccctgaacaagcaccaaatatgttcctgtcaccacactncactagcccttcaactataaacatgcataggagtcacctgggggccttgctaaataaaatgcaacttctgattcaataagtcttaaacaggaccagaagattctgcgtctcttggtgagttcccnagtgangcagacaatgcccagttcacaaactcacattttgagatacagnacctgggccatttnggttcccaatgtgcttgataaccctgg

SEQ ID NO: 3775 - DNA, 755 bp, Homo sapiens
  misc_feature 3, 11, 13, 31, 633, 650, 660, 679, 688, 694, 707: n = A,T,C or G
agntgattccnantgaaagcccttgtctttntgcaggatcccatcgattcgaattcggcacgagatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggangtcacactttctctggnaagaacccgncaccatgaactggctggangagaacgtncacganggtctgcaagcantgggatcccgggacccagccgtgggaacctgtgaagaaccggcggaag

SEQ ID NO: 3776 - DNA, 849 bp, Homo sapiens
  misc_feature 2, 4, 425, 465, 544, 554, 605, 615, 616, 626, 628, 633, 665,666, 669, 672, 683, 687, 701, 702, 726, 740, 742, 750, 752,753, 756, 761, 769, 773, 793, 796, 804, 823, 836, 848: n = A,T,C or G
ananatcagctcttgttctttttgcaggatcccatcgattcgaattcggcacgagatgactgagtgtataccctagttaaaatgatcaggggagacttaactgaaaggggtaattgagctagatttgaaggatgaggagtagcagactagtcaaagaaagggagagaagaacatacctaaacatctgatcaccagtgactgagaaagttatcaggatcaagtggaaagagaaaggactagcagagttacaggttagagaaacaggtaaaggctactatggacggcataatagttgcatcccatgttttgtctcttaagaacagttgcaaactattgaaggttttaaagctgtgtgttgggccgggtgtggtggcttgtgcctgtaatcccagcactttgggaggccgaggcgggtggatcacgangtcaggagtttgagaccagcctggccaatatggtgaaatnccgtctctattaaaaaattaaaaagtagcccaggccgttgtggcatgccccctgtaagtcttcaactatttttgaaaangcttgaggcnagaaagaaattcgctttggaacccccggggaaagtggaaagggttgccaantggaagcccnnaaaaatcggngnccacnttgcaatttcccaaacccttggggccgaaccnnaanccnaggaaactttnggtntttaaccaaaaaannaaaaaaaaaaaggccctttttttngaaaacttttttantnggaaggtncnntantttanccgttagnattnccccggaccattggatttanggnattcccantttggattgaaaatttttngggaacccaaaancccccccaaacnt

SEQ ID NO: 3777 - DNA, 855 bp, Homo sapiens
  misc_feature 1, 3, 8, 11, 12, 13, 21, 24, 460, 478, 499, 537, 587, 589,614, 628, 638, 654, 655, 658, 671, 672, 676, 680, 683, 708,720, 723, 724, 730, 754, 771, 777, 803, 806: n = A,T,C or G
ngngtganccnnntttttatncanacaggctacttgttctttttgcaggatcccatcgattcgctcaagtaggtttttatttatttattactttattttattttattttattattatttttttttgagacagagtctcactctgtcacccaggctggagtgcagtggccggatctcggctcactacaagctctgcctcctgggttcacgccattctcctgcctcaacctcccgagtagctgggactacaggcgcctgccactgtgcccggctaattttttgtatttttagtagagacagggtttcaccatattagccaggatggtctcgatctcctgaccttgttatctgcccgcctcgacctcccaaagtgctgggattacaggcgtgagtcaccatgcccagcctcaagtaggtttttaatgaatttcttatacttttaaaatacaacattatggcantaaaagactattccactncttttctaatctggagattgnattgatttttctagtggtaattttctggctcatacctncagtaccaatgggtgaaataggtgggtttaaagtaggaaaattcttcgtncnggttttccaaaactttgcaggaatnaaaggcccccctangtccattttncacccatttaaaggcnntanttaagcctttttnngggnggtnggnaagtttttttccaattctttgggcnttcaacttgggnaanncccttnaaacccttcttttaaaagccttcnaaagtgggaatcccttncccaanccttttaaactgggccctggaaaatnaanttttgggggaacaaattaagggccattggccacccaaacccatggcccc

SEQ ID NO: 3778 - DNA, 727 bp, Homo sapiens
  misc_feature 1, 7, 9, 10, 12, 16, 19, 20, 32, 37, 66, 78, 85, 92, 96,101, 105, 113, 123, 127, 132, 133, 137, 139, 145, 154, 164,169, 174, 187, 191, 217, 229, 233, 237, 239, 240, 241, 253,258, 261, 267, 277, 286, 287, 290, 305, 306, 308, 314: n = A,T,C or G
  misc_feature 319, 325, 327, 346, 348, 351, 352, 360, 370, 371, 381, 384,410, 417, 418, 423, 444, 448, 450, 454, 459, 482, 483, 513,514, 516, 521, 530, 534, 542, 548, 551, 560, 572, 591, 594,596, 619, 644, 646, 647, 657, 661, 662, 697, 699, 714: n = A,T,C or G
  misc_feature 727: n = A,T,C or G
nagttangnngntttntanntctggttctttntgcangatccctcgattcgaattcggcacgagancgattaacactnctaaagngtcaagngctngggtntttnggcttagntgtgctgccntcgnggaanncatntntggggnaatggtgtnatacacctcnattanaaatnagcacatgatggntggncaccgtggctcacgcctgtaatcccngcactttgggangctnaggngnnnggatcacctgangtccngantttganaccagcctgnccaacatgnnganacctcatcccttctnnanatatanagaantagctngncatggtggcgcacgcctgncnttnnagctactnaagacgctgnngcaggagaanctnttgaacccagtaggtgaaggttgcantgagctnncatcncaccattgcactccagcctgngccncnagancgaanctctgtcttatacatgcaaaaannaggaggttggattacttgaggtcatggatnnanatcantctgaccancatngtgaaacnctatcnctncttaaaatnttaaattagccnttcatggtgacctcacgcntgnantcccatcttctggggaggctgangcaggagaatttctagacctgggangnngagttcagcngcannacggccctggatccacctgggcacaaaacgaactntnctcaaaaagaaattnacccttaaacttn

SEQ ID NO: 3779 - DNA, 759 bp, Homo sapiens
  misc_feature 1, 3, 4, 8, 12, 32, 641, 673, 693, 720, 748, 758: n = A,T,C or G
ngnnggangctnctttcagctcttgttctttntgcaggatcccatcgattcgtctgggaccaataatgttttaaaaatatattcatttgagattcagaaaacttgcacatcatttgctactcctatcatcttaacagtgaagaaaactgaggcctagagacattaagggggttgcaggtccagagacatgtctcaagaaagcattgctgttaaaatgtgcagttcgtgggttttcagtccatctcttaagaaaccaagtcaatcttcccctcaggaaaaagaaaagaagtagcaataagcaatttgttaatatcactacttcttatcaaggtaaaaaatgcctcataatcaggcatacccatgggccttgtttcacaaaggcactaagatgaggcaatgtaggtcccaaaaaacaaaaagacagttttttggagttgctgaggttgacaaccctagttttatactttggtaataccagtgaccttggaattacaagcttggggttaagaactcaagggttcattaagactccctggaacattctggaaaaccagctttagagtcttcattgaactcaaatctcagcaccacagttaaatgagtgagtcaaaaagaacataagtttaaagaaatttaaccanggaaccagatgtttctcttcacaccacactgntttaacatccagtattcgtngacctttttctttcccccaccatcctntggatttaccttaggctttccaaaggcnttaatgaaant

SEQ ID NO: 3780 - DNA, 843 bp, Homo sapiens
  misc_feature 3, 4, 5, 6, 11, 19, 36, 455, 481, 507, 542, 558, 569, 572,575, 620, 621, 623, 625, 626, 629, 641, 646, 647, 650, 659,662, 666, 679, 680, 687, 695, 697, 701, 702, 703, 706, 708,710, 711, 712, 716, 717, 725, 731, 733, 734, 735, 738: n = A,T,C or G
  misc_feature 739, 740, 742, 749, 751, 761, 762, 767, 769, 770, 780, 783,784, 786, 794, 797, 798, 809, 813, 814, 818, 833, 834, 836: n = A,T,C or G
tgnnnnaatcnctaatgcnaggctacttgttctttntgcaggatcccatcgattgggaattcggcacgaggctatttgtgttttgttgcactgttttttttgtttgtttgtttgtttatttggttggctttttggagagggaaatgggggtgaaatatttttttattgttgaatcattttgtgaatgtccccctcaaaaaaagctaatggaatatttggcataaagggcatttggtggttttatttttgtttgagggggattgtcagaaaatcccttttctctcttacgtctaactgactagggaacaattgttgatatgcatagcattggaatacttgtcattatatactcttacaaataacacatgaagcaagaatgaccaatattctgataattggcactggatcacaaaatgtgataaaactttaaatgtataaaactttatcaaataaantttattttcccctttaaaatgtattnctttagaggcattacttttttaaaantattggtcaattcctgacatacgatgtgaaggttnacaagttggatttccnagtattccaanatnaanttccttgatttttcaattaaggcaaaaacgtcaaaatcccaaaanngntnnccnataaaccaaaanttgcnnttntttaaaaanggnttangccttttaaatanngaatcanttaattcntntatnnngcntngnnnttgnnaaaattancccctntnnntannntnccctttntnttaaattttnngggtngnnctggaaaaanatnngnccccttgntanngggcctccctnggcnnttanagaaaaacccaactnntngggggcg

SEQ ID NO: 3781 - DNA, 766 bp, Homo sapiens
  misc_feature 5, 6, 7, 12, 32, 40, 41, 54, 62, 63, 181, 208, 217, 220,248, 255, 258, 267, 334, 335, 350, 352, 358, 362, 364, 369,371, 373, 374, 375, 376, 379, 384, 385, 386, 387, 391, 392,396, 400, 402, 404, 421, 424, 431, 439, 442, 455, 460: n = A,T,C or G
  misc_feature 467, 471, 477, 482, 491, 496, 499, 502, 507, 512, 516, 520,524, 536, 537, 541, 549, 550, 565, 573, 574, 581, 591, 608,613, 619, 621, 632, 633, 634, 641, 657, 658, 659, 663, 667,668, 690, 697, 700, 706, 717, 718, 722, 725, 726, 727: n = A,T,C or G
  misc_feature 741, 744, 748, 757, 759, 760, 762, 763: n = A,T,C or G
aggtnnntaatnttctatacagctacttgctntttccgcnngatcccatcgatnggaattcnncacagagatgacctccaatgtggccagcgacgagatcgcacagcacgcgctgcagctgaggcagggggctttggagatgagccgtaaccgtattgccgaaaacctgggggatgtccanataagtgacaagatcaccatctcaaanaacttcaanganaatgtgattcaccctatcctgaaagctnacttccnganggatgagtntctgggacggatcaatgagatcgtctacttcctccccttctgccactcggagctcatccaagtatcnnacaaggaacttgaantnctgggncctnanaggcncncnnnnggncaatnnnnatcnnctcngtgncntnataaacactgattctcngtntgataantacgatanacnatatcattctgtnatacncaaagangtgncaccanccctnttctcactnttgantanctntggcngtctnttanggtnatanagtgagccctannaaantcccattnntacttgaagcatacnttttggcnnaaaaacnaggttcttgntatcaatagctcctaanagtcnaaattntncattttaaacnnnctgttanaaatttttttcaagcnnnttantgannattcctaatgtaaaaccttttnaaaaacnaancctttnaaggtaaaaannattnttnnnttcttttcaaaacnttntttnaacccaagnanncnncct

SEQ ID NO: 3782 - DNA, 749 bp, Homo sapiens
  misc_feature 3, 7, 8, 12, 559, 580, 637, 646, 656, 659, 696, 715, 744: n = A,T,C or G
ggngtgnntttnagatacagctacttgttctttttgcaggatcccatcgattcgaattcggcacgagcaaaggccgtcacaccaaggtcaggccaggagcctaggctaaaggaaacttcaccaccggggacatcagctgctgtggccagagaagagaacatgaaagcccacatcccgtgcctgcagccacccactttgctgtcacttcccagctgaagtgaggagggactgttcagaaacatcgaactgagcaaggtctctgtctacctcatggaaaacctgatctggaaatgacacttggaataaaataagattactcttccattaaaaggaaatccacccaaaagagagaaatagtggtatatttcagttttacataataatttctagagataagataacccattgcattagttgattcagttaccaatttagctaagtgtgagggagaacatgggccttgactttttttctttcagaaaatcaagtttgccatattgaaaaatgctgtcagctctgccaccggttctgtcattaatcatgggaaagagctgatcangttttgattgtttcttcagangcacttttgtcatgtaatgcatatatttcaattaaaatatgcaggagaatgcaaagntaataattnagggaaaatnatnaagtgttgccattggctattaattactaaaaaaaaanaaaaaaaaactcgagcctntaaaactatagtgagtcgtattacgtaanatccc

SEQ ID NO: 3783 - DNA, 770 bp, Homo sapiens; identical to SEQ ID NO: 515
  misc_feature 7, 11, 12, 675, 703, 749, 753: n = A,T,C or G

SEQ ID NO: 3784 - DNA, 904 bp, Homo sapiens
  misc_feature 34, 108, 214, 249, 340, 356, 357, 367, 406, 417, 425, 433,437, 443, 446, 447, 450, 452, 465, 470, 474, 477, 478, 485,486, 491, 495, 506, 521, 534, 537, 542, 551, 552, 553, 554,555, 558, 559, 560, 563, 568, 574, 576, 585, 587, 588: n = A,T,C or G
  misc_feature 590, 593, 598, 599, 601, 604, 609, 614, 632, 633, 634, 638,644, 645, 646, 647, 649, 651, 653, 657, 659, 660, 665, 671,673, 675, 676, 677, 678, 679, 680, 689, 690, 691, 696, 708,714, 722, 723, 728, 729, 731, 734, 739, 745, 748, 751: n = A,T,C or G
  misc_feature 753, 757, 760, 767, 768, 777, 779, 780, 781, 782, 787, 788,789, 790, 794, 795, 796, 797, 803, 806, 810, 811, 812, 813,814, 819, 820, 821, 822, 823, 826, 833, 838, 840, 842, 844,849, 850, 853, 857, 859, 860, 861, 862, 865, 867, 870: n = A,T,C or G
  misc_feature 871, 879, 881, 888, 892, 895, 897: n = A,T,C or G
ctacttgttctttttgcaggatcccatcgattgngaattcggcacgagaggtaggcacctggcatgtcagttgcctgaatttgaaagttttcacctgtatgttttggncgataaaaataaaaatgtaatttatatatctgaatcaggtctgtatgttatgatcaattgctcagcaatttcgggcagttggtttgatggttatgtagtaatgtancctgagagcagaaatacagagcctctgggctaganaaagtataaatggcatcctaggctatgtagggttcagctcttcagaaggaactttcatttttcattgtgacacatcgactacatgttgtanaagaacatagtttcannaattcttccngttagaaacatacgtttcctcaaaatatttcactttcangcattgggtanaaaaagtncccatgtnattngactangcnnatntnctttaaaaaatangccantttnctnnaacccanngatanatanccccacgtttntttaactattttcangtcattttaacantcnccctncattttctnnnnnccnnnggnttaanttctcnancctattttncnncncanaaacnntnccnttctnacctnaatcatattttcccactnnncctnaactannnnananancatntnnattcnctcatncnannnnnnttggcatannntttanactataggcatnaactcnttcatatnnatatnntnctncaatntacatnatnttngnctanatnttcatcnntctattctncnnnntcatnnnntaannnnttcccnacnttannnnntatcnnnnntanttgttcntatancncntntatcnntcnatantnnnnatntntanntatcttancntatccanaatncananacacgcc

SEQ ID NO: 3785 - DNA, 771 bp, Homo sapiens
  misc_feature 2, 9, 10, 11, 12, 513, 650, 672, 675, 684, 694, 706, 714,724, 737, 748, 751, 758, 765: n = A,T,C or G
tncttcaannnntggtctcgtctttcccaggatccctcgattcgaattcggcacgaggcagaagccaattccttgtgaaaagctgactgccatcagtaatctcaatagaaaagagatatgttttctggagtcataaaggaattcaattcctagggtttttgtttttgtttttgagatgtaatattgctctgttgcccaggctggagtgcagtggtatgatctcaccttactgcaaccaccacttcctgggttcaagcgattctcctgcctcagcctccccagtagctgggattacaggcaccagccaccatgcctggctaatttttttgtatttttagtggagatgtggtttctccatgttggccaggctggtctcaaaatcctgacctcaagtcatctgctggccttgacctcacaaagtgctggcccagccgagatttgttttctaagatactttgtgtcatgaacagttcagtttagtgtcatgaactattcacttcatatttttcttgnattaactggttaaatttttaaaatatcttgtagtaactctttaaaatgtatgtaaagtaaatggctgcagaaaggttttttagagaatccctgcttccatcagtaatacagcaatattacccccaaaaaaaaaaatnaaaaaaaaaacttcgagccctntanaactatagnggagtccgtnttacgtaaaatnccaggacntgataaggantccattggatgantttgggacaanccncacttgnaatgcantggaaa

SEQ ID NO: 3786 - DNA, 755 bp, Homo sapiens
  misc_feature 3, 8, 10, 11, 15, 18, 20, 91, 92, 93, 687: n = A,T,C or G
ctnttaantnnctcnttngnctacccgttctttttgcaggatccctcgattcgaattcggcacgaggtactttgagtgtttgggggttcannncacacatgcaattttgcttaacaaaagtattttataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccagagaggaaactataaagtaattacacatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttggttttcttttgctattggtaatattcaaaattaaagtgttcattggtacctggtggccttaatgcatttattgnagacagcattgagatgatgaacaaggggttagcaatagccaactctataataattttgcctaaatacc

SEQ ID NO: 3787 - DNA, 748 bp, Homo sapiens
  misc_feature 3, 5, 6, 8, 11, 22, 24, 165, 167, 202, 208, 225, 233, 250,324, 369, 371, 434, 481, 507, 520, 524, 563, 575, 602, 624,660, 670, 708, 710, 726, 737: n = A,T,C or G
ttnanntnatnttgctattgcntnttgcaggatcccatcgattcgaattcggcacgaggcctcatccatggatcagggaggcacgccagggagtaacccagttctgcccagcaagctacaccccactaactctgggccctgtctgtgctatttaacatttcattnanacaggagctcctgggaagaagcttggctcagtatncttggnagatcacccctcaaagnctccctcnggtatattctaagtgangacggatcccatatatacctcacttaggctttactctgctctgcaagcacaggcaagaccagctacatctttgnacgccacccctggttcttagtaggccaagaacctcagaaactggnanggcactaagagctgtattttagaaactgtgttgaaattacatttattcagctttgatctgggngggccctgtacctggcactgctacaagtgtttcaagaaggtgcgaangagatatttttacaggcaaaatagantatatttcctctncagnttcatttgactgcttgtttaaaaaaaaatatgaaagatngtacagagagtncccatatcccctcatctagttctcctntattaacatctgccattagtgnggtgtatttgtcacaattaataaacccatagtggtnaaattattgntggcaaaaatccatacttcattcaaatttcctctggtnantcctaatggccttttntgctattctanggatcttatcc

SEQ ID NO: 3788 - DNA, 784 bp, Homo sapiens; identical to SEQ ID NO: 542
  misc_feature 3, 4, 5, 6, 7, 9, 69, 86, 110, 114, 122, 132, 134, 136, 139,141, 156, 157, 163, 164, 177, 178, 185, 192, 194, 198, 200,214, 245, 247, 252, 256, 268, 274, 279, 280, 286, 292, 295,307, 309, 315, 319, 320, 322, 328, 334, 374, 384: n = A,T,C or G
  misc_feature 400, 408, 409, 411, 423, 424, 426, 427, 449, 451, 461, 463,468, 474, 475, 496, 518, 528, 536, 543, 545, 555, 564, 606,613, 619, 633, 641, 650, 657, 674, 729, 734, 741, 747, 753,762: n = A,T,C or G

SEQ ID NO: 3789 - DNA, 765 bp, Homo sapiens
  misc_feature 10, 11, 13, 27, 31, 606, 652, 674, 686, 695, 700, 739: n = A,T,C or G
ttcaatgttnntnaaactctttggaancagnctcccatcgattcgaattcggcacgagaacagatagagacttggtcttaaaaaaaaaggaaaagattttgaaacaaaaaattagctgggcctagtggtgtgtgcctgtgctcccagctacttgggaggctgaggtgggaggatggcttgagccctggaggttgaggctgcagtgagccatgattgtgccactgcgctccagcctgggtgagagagcaagactctgtctttaataataataataataataataaagtggtcaggaagggacccccagggaggagcataaacctctccagtggctgtgatttgtcagtaaggacatggggcatctggcggacaaatacccctacagcgatagcattttccgggcatttgtgggtctcaaggcgccctgcttgccctcagtggatgctttgtccagcccgcaggcattttatccagcagacaagcagaagcagcagttttgtcattcgagccggcttccctgccatggtacattacgtgagcaggcggctggctgtgctgtgctctgtggagatcacacgtgagattcgacagcactcgcttctgcangcttctctttcctgggttcttttaagatgaagagagaaccccgaanaggcggggcttgcggaaaggcnctgggaaaaagnaatggaatnatggnctttaacaatggtgccccgtgaactggaatggttctgantggcttgccagaactcttgagtcact

SEQ ID NO: 3790 - DNA, 751 bp, Homo sapiens
  misc_feature 2, 7, 13, 14, 17, 82, 93, 432, 497, 499, 500, 501, 506, 508,509, 510, 512, 513, 514, 515, 516, 519, 520, 521, 523, 546,549, 559, 594, 604, 617, 631, 632, 641, 664, 698, 733, 747: n = A,T,C or G
ancgtgncttatnnacnctttggaagacctccatcgattcgaattcggcacgaggctattccgaatagccccaggtgatccnttttacaccanttttagcaatggaagtcagcacctctgctgggccaaggccatgcttccccagcctgtggctgcgcctctgctgtctctccgggtctcacctgggcgggaggctcctctggaggccaggacctgccttgtgagggtgcccttgtgggagaggcgcttgcccaaacctgctgttccccgggggctccttggtggcccccaggactggagctctctgcccagagtgcccctccccagaggttaggactcccatgaccctgtcccctgcccactgtgacctggggtttgcatggtttccttctttcctagttgtggtgaaatcatcacttgtgtgtttcgttnttcctgttctctgctgatttaccgatgtatttaatgtaaagtaaaaaaaggaaaaaaagaaaaangnnnaaaanannncnnnnnaannnanaaaaaaaaaaaaactcgagcctntanaaactatagngagtcgaattacgtaaatccagacatgataagatncattgatgantttggacaaaccncaactagaatgcanngaaaaaaanctttatttgggaaaatttgggangcctatggcttatttggaaccatttaagctgcanaaaacaagtttaccacaacaattggcattcatttnaggttcaagttcangggg

SEQ ID NO: 3791 - DNA, 750 bp, Homo sapiens
  misc_feature 1, 3, 8, 11, 12, 13, 15, 20, 33, 85, 96, 98, 103, 107, 109,113, 139, 144, 211, 264, 463, 531, 566, 573, 579, 621, 632,643, 650, 661, 667, 673, 679, 682, 690, 691, 737: n = A,T,C or G
ntnctttntgnnntnaaacnctttggtaagcancatcccatcgattcgaattccggcaccgaagggccttccagatcgtgctgtnccacctacctntnccgantttngncttncagatcgtgctgtcccacctacctgnacatntgccacagttggccctgggccaaccccacgaagggcctgggcctaaccccttggcctggcccacttncagagggaccctgggccgtgtgccagctcccagacactacctgggtagctcangggaggaggtgggggtccaggagggggatccctctcccttggggctgcccctgtggagggggatcccgcctctagaactatagtgagtcgtattacgtagatccagacatgataagatacattgatgagtttggacaaaccacaactagaatgcactgaaaaaaatgctttatttgtgaaatttgtgatgctattgctntatttgtaaccattataagctgcaataaacaagttaacaacaacaattgcattcattttatgtttcangttcacggggaggtgtgggaggttttttaattcgnggccgcngcgccnatgcattgggcccggtacccaacttttggtccctttagtganggttaattgcncgctggcgtantcatggncatagctggtnctgtgngaaaanggtatncgntcacaatnncacacaacatacgacccgggagcataaatgtaaacctggggtgctnatgagtgactacc

SEQ ID NO: 3792 - DNA, 757 bp, Homo sapiens
  misc_feature 15, 331, 462, 484, 638, 652, 655, 659, 660, 666, 699, 700,718, 721, 751: n = A,T,C or G
ctatagacagctacntgctttttgcaggatcccatcgattcgaattcggcacgagagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgnaaaacagatactataatatttccttttattttagtgttatttagctttattacagatttctatttttgtcaaaacttcatggttcctttcaagatcttttttgccaaaacattttgatactatagcattgncatttgaaagtaagtgttctanactataaaaccaatgaacttctacatgagccctacagacaggcatgtgtagaaggcaatttatcaaacctattgcactggcatgaaaagtgtgtataataattttgctagccccaaagcaagctagttttctttgcttgcttccttttctttcnttttttccttgctnttnaagnnttgaancttttttaaacatggttgaggaattctctaggnnggattccttttgggcgtnatntaaacccccttctttttgggtttctggaanacccgg

SEQ ID NO: 3793 - DNA, 710 bp, Homo sapiens
  misc_feature 1, 6, 12, 13, 14, 34, 37, 42, 43, 46, 47, 49, 51, 57, 65,78, 93, 110, 117, 162, 166, 168, 186, 192, 193, 198, 203,213, 215, 251, 253, 255, 258, 265, 272, 273, 274, 275, 277,298, 302, 306, 308, 312, 317, 322, 323, 327, 353, 357: n = A,T,C or G
  misc_feature 358, 359, 370, 396, 412, 414, 425, 431, 481, 482, 484, 493,494, 495, 503, 508, 510, 511, 533, 535, 544, 555, 567, 573,577, 578, 583, 584, 587, 588, 594, 604, 605, 606, 616, 623,625, 627, 629, 630, 633, 635, 649, 659, 664, 667, 671: n = A,T,C or G
  misc_feature 676, 680, 685, 690, 698, 706: n = A,T,C or G
ncgctnctaacnnntggcgctatgcttggcgctnganccctnngtnngnantcggcncgagggtnaagcttcattcantgtccattcacccantactggtttgattctanggcctangaaaataggactgagcaaagcccttgtccagatggaacttatgtnttanangggaaaacacaccatatncaggtnnacagngtacnatcacgaaangntaaatgtctatgaagaacattgtgcagacggcgatngngntanatagggnaaggttnnnnangacagcatagcttgatgtacnagcnagananacanatagngaaanncctntccatactaagggaatgggaaataangctnnnttttgccttgntgaccttcaaacatgagaattgctanagctctgtgccaaggntnaagagtggaanacaatntaagcttcagctacatcacttacggcctataggccacactgaactgtgcnngnaaaactcannntgagccangctcncnncttaacatatttaaaggttctntnctgtgcgcngcaagaagacnacaggacaggtncagctntgtnnccacnngannttgatnttgacttcannngtacatattntgggctnantntnngantnaaaatgcgctatcncccataagtntggantcntgancatantgtngggcntctgncacaatgngtattatntcaa

SEQ ID NO: 3794 - DNA, 749 bp, Homo sapiens
  misc_feature 3, 8, 13, 32, 643, 656, 691, 718, 719, 721, 723, 727: n = A,T,C or G
ggntatgnggctntaaatatacagctctcgtngctctttttgcaggatcccatcgattcgaattcggcacgaggttaaaagaataaaaaaggaataattgaagccttcgagacatatgggatactataaagccaccacatatttgaatcatttgggtcccagaagacagagaacaaaaggattggaaaactcatctatttttttgttattaaataatagatgaaaacttcccaaatctatcaaatgatttagatatccagaaacaggaggctccaagatccgcaaacatatacaatgcaagaaagtcttctccttggcacattatagtcaaactatctaaagtcaaagacagaattctgaaaaaggcaagagaaaagtgcctagtcagttgtaaagaaaaccttatcaggctaatagtgaatttctcagcagaaaccttacaagccaggaaagaatgatacattcaaagtactgaatgaaaaaaatgctatccaagggatactatatctagcaaaaatattctttgtaactgaaggagaaataaagtcttccccagaaattgcttaagggagtcctaatcctgggagcaaaatgactacatttaccatcatgaaaacttatgaatgtgtaaaacctgctaatnaagcaatccacanaggaataagggaaagtaattaaatggtcctgtacnggaaaaccaccaaaccaaaattggaannanancttnggaaaaaaactcggcctttaaa

SEQ ID NO: 3795 - DNA, 748 bp, Homo sapiens
  misc_feature 2, 3, 4, 7, 8, 9, 10, 11, 12, 13, 14, 15, 16, 20, 24, 423,485, 575, 581, 587, 595, 644, 651, 713, 742, 748: n = A,T,C or G
gnnnggnnnnnnnnnntttnatanatacaggctacttgttctttttgcagggatcccatcgattcgccctgccctgggtctggccggcggaagctctgtccaaggtccacacacctccaggtttacgccaacatccttgtgccctccccaccttctcttccaacgcattaggtgcattgtttaattgaaatccaaccaacaattgtgtgtcaaggctggtttggtgcagtggctgggcaaattaattttgggccaggatgggggtgggttgcagtgagggtagggaaaatgtcaggagtaggaaggttcgggggttaagggaagggaaggaagaccagaactggccatcctcttttataatccattagtagcaccatggctcatttgaaatgaaaatattacacttattccccacccaaccgnagtgaactttctaggtaattgttttgaaaacaatttttgtatctgtgaaagtctttgctttntctttccaccttctagaaaagtctgctaccagtttccttactgaatacagccatactcagcccctctcgcatccagcccgtcagggtcanggtcanggtcangcttcctnaagactagcaccgcattgtctgccctcttttgcgtaggatttttctctnaacccangggacattgccttggactttctctacaaatgcccttagatgttagaacacaaatgattctgnttgtggaactctggctttttgcctatttncttttn

SEQ ID NO: 3796 - DNA, 749 bp, Homo sapiens
  misc_feature 2, 3, 4, 8, 9, 10, 11, 12, 13, 14, 15, 16, 24, 532, 623,645, 663, 691, 738, 739, 747, 749: n = A,T,C or G
gnnntggnnnnnnnnnttttatanatacaggctacttgttctttttgcaggatcccatcgattcggccaagctcagtttttcgccttgaatatgaagatgctagaaagagctctgcatttaagcagagccttgtgcaattcccggaccaaatgctgaaactgcaagagtgccctttaaaagaccttcttaggcatgtgacttgttctctaccagaacctttgggcaacatgaaggaagtcaaaggcatttactggcttgctgttgctgcctgcacagcacctgaccctcaaccagcgtgtttgctcctgcttcagtcaactttatatgctttggtcctgtcagataatctcggctcaatgagcatttttcatgctctacctctctctggtctacaggagattcagattggctttggtggacagagtgttcgattcctgagctctgcagagggtcttctgctcactgtattcagttacaacaaatacctctctcaacagctgtgtcgtgacctcctgtgtgtcctgatgccanacctgatgcccgctgcctgcgctaatcatcccttgctccacaagatctggttcactttctcttgattggaaaacagaaatccctgatttantttttgccaaatgggagttcangtgtcatccaaattccanactacccttgggtgacatgattactttnttcatggaaatatggaagtcaatgtcccttccctggcaaaagttcanntactggtntn

SEQ ID NO: 3797 - DNA, 762 bp, Homo sapiens
  misc_feature 7, 422, 682, 702, 711, 722, 741, 751, 758, 762: n = A,T,C or G
ttaatanacagctcttgttctttttgcaggatcccatcgattcggagaactagtcaataaggaacaggatcaacggccactccacccagtggcaaatccacatgcagaaatctccaccaaggttccagcctccaaagtgaaagacgccgtggaacagcaaggggaggtgaagaagaataaaagagaaagaaaggaagaacggcagaagaaaaggaaaagagaaaagaaagaactaaagttagaaaaccaccaggaaaactcaaggaatcagaagcctaagaagcgcaaaaagggacaggaggctgaccttgaggctggtggggaggaagtccctgaggccaatggctctgcagggaagaggagcaagaagaagaagcagcgcaaggacagcgccagtgaggaagaggcacgcgtgggcgcanggaagaggaagcggaggcactcggaagttgaaacagattctaagaagaaaaagatgaagctcccagagcatcctgagggcggagaaccagaagacgatgaggctctgcaaaaggtaaattcaactggaagggaactattaaagcaattctgaaacaggccccagacaatgaaattaccatcaaaaagcttaaggaaaaaggtttttagctcagtacttccccagtgaccagattgagccattaccagattcccgaaaganggaacttcctgggtccattnttttaccanggaaaaattcngccaaggaacccttaaccntttaagtttntttaaanggcn

SEQ ID NO: 3798 - DNA, 761 bp, Homo sapiens
  misc_feature 1, 3, 4, 7, 8, 9, 10, 11, 12, 13, 14, 18, 19, 23, 27, 61,682, 708, 738, 756, 759: n = A,T,C or G
ngnnggnnnnnnnntttnnaatntcangctacttgttctttttgcaggatcccatcgattngaattcggcacgagatcaccttggagctccttgagtgagttctgatcaagccattacactcttttcatgtagacctgcctgtaagtgtagacatgcacactcagctgaccttactgttcaaaagctggagaaaaagaaacagctttcatacagtgcaaactgtctacgtctatgtaaaagaatttgagaaacatggcagtagccattgctaattaatctgggtatgtgtaaatagtttaacttgatttttgactctggtgtttggatctattttaagatcgatggagttaattgcttcatgacagttcttatgaaacatgcttttttatatccttgtgccaatgttttgtttacagatctttcaaaatgaattcactctgagaaataatgaaatgacaattgtgtggcacatgttaggcgttagataaattgggagttctcttcttttgtaagattagctttaaatccacaattaatttcagttaggagagaataagcatccataccctatctctttaaccctgattacaactagatacccccggacagaagacaaagcaaccacccaaagacttctgaaaaggtagatagtagccaggcagactggggaagaagaaattnaaaaccctgaacaccaattttggcantgaggtttacctgggtttaatatatttctncccaaaacttggctcaanaancg

SEQ ID NO: 3799 - DNA, 854 bp, Homo sapiens
  misc_feature 5, 6, 15, 54, 67, 392, 396, 409, 410, 446, 448, 461, 474,480, 493, 496, 498, 511, 514, 515, 517, 520, 540, 541, 553,556, 559, 561, 566, 567, 568, 569, 570, 573, 579, 582, 583,589, 595, 598, 600, 607, 616, 624, 627, 628, 630, 632: n = A,T,C or G
  misc_feature 633, 643, 644, 645, 646, 647, 649, 650, 653, 656, 658, 659,660, 669, 670, 671, 672, 681, 682, 683, 688, 689, 690, 691,692, 693, 695, 696, 699, 700, 701, 702, 703, 704, 705, 706,711, 712, 713, 714, 717, 719, 721, 725, 726, 729, 730: n = A,T,C or G
  misc_feature 733, 738, 739, 740, 743, 744, 745, 746, 747, 748, 750, 753,754, 755, 756, 757, 758, 759, 760, 764, 765, 766, 767, 768,769, 770, 771, 779, 780, 781, 783, 789, 790, 791, 792, 794,795, 799, 800, 801, 802, 804, 811, 812, 813, 814, 817: n = A,T,C or G
  misc_feature 820, 821, 822, 824, 825, 827, 828, 829, 830, 832, 833, 834,836, 837, 838, 839, 843, 844, 845, 846, 847, 848, 849: n = A,T,C or G
ggtgnngggaaaacnggcttttatacatacaggctacttgttctttttgcaggnatcccatcgattnggcctcagagtctctgatcaagcagattccacgaatcctcggcccaggtttaaataaggcaggaaagttccgttccctgctcacacacaacgaaaacatggtggccaaagtggatgaggtgaagtccacaatcaagttccaaatgaagaaggtgagtgggtctggcgggttgctatgggtgaaggtgttggcagggtctaaatcttatccaagtctctaaatatgccagtaagagcacccaccaggattgaaacttttggagtaaccctggtcttggcccgggtccaagtacctgctcaccaggccactgggggaggaaggacangccnatctgctatttgnncaccaacctgacttgatcctctcttccctctcccangngttatgtcttggntgtaactgatggncacgcnaagatgacagacnatnancttgtgtttaacnatnnanacntggctggtaacttcttgggnntcattgtttaantanacnanttggnnnnnaangttccnggnntttatnttattnaantnaaccctnattgttccnataccccnaanngncnntttttattannnnngnnccnttntnnnattaaaatnnnntttttatcnnnattannnnnnanntannnnnnnnaatannnnctntngnaagnnatnnttngaacnnnttnnnnnnanttnnnnnnnntaannnnnnnntaatctcnnnanatttgnnnntnngtannnncnttttgtnnnnacnttnnngnntnnnnannncnnnngtannnnnnnatccc

SEQ ID NO: 3800 - DNA, 751 bp, Homo sapiens
  misc_feature 4, 5, 7, 11, 14, 17, 106, 159, 160, 213, 222, 253, 292, 302,334, 365, 379, 418, 425, 428, 463, 469, 514, 547, 553, 558,563, 568, 580, 587, 593, 597, 607, 621, 630, 633, 640, 644,645, 665, 669, 679, 683, 684, 685, 686, 693, 697: n = A,T,C or G
  misc_feature 702, 703, 704, 715, 723, 728, 731, 738, 742, 744, 745, 749,750: n = A,T,C or G
tttnncngacnctnttnaactccctgcaggatccctcgattcgaattcggcacgagcacaagaaaatgaaattaaaaaataaatcaagctttcatatgctcaactncattggaccactgcaatcctggtgacatattgcgggctgaagaaacccattgnntatagtcctcctgtcactggagatatgtgtggtgagaaagagaaatggccacnttgcaatancagtgggaagcaaatgcagaaagcacccagnaaaggggaagatctaggtgacagaggccatctactcttntggattcatntggttctggcacacagagaatggagcttttgnggcaataatttctctactgatgtgagcaagnatacttctttctanaattagcaaattattgctaactatttgtaagctaaaatntaaaatnagngtttaatgtaaaatttcaaaacagaagggataatncatggntcctatacatcccataggtagtaatgcattgagctaggctgtggntactccctcagtgtgatttgtgttcacataagntcttanttggngttgnactgntattattaaatntcaagtntgacantaangccacagcangactttagagctcnaagacattngtnacacaancttnntggcaacttttttcaaaacnttgnacactttatngggnnnnaaacttncccnttttnnnaaaccagatcnttggggcntcaanctntttgaanccgnanntgcnnt

SEQ ID NO: 3801 - DNA, 773 bp, Homo sapiens
  misc_feature 1, 8, 13, 21, 46, 52, 53, 78, 94, 96, 101, 157, 158, 204,216, 245, 250, 251, 303, 324, 362, 369, 404, 412, 433, 434,435, 447, 454, 475, 485, 511, 528, 549, 562, 578, 584, 593,595, 602, 633, 647, 648, 650, 651, 661, 662, 683, 685: n = A,T,C or G
  misc_feature 688, 691, 696, 706, 708, 711, 713, 727, 728, 729, 730, 733,738, 739, 741, 743, 744, 759, 762, 767: n = A,T,C or G
ncgaaagnccaangccggacnggacgggaacaccctcccatcgatngcgaanncggcacgaggaatcttccttaaagnccagagcctcccttantntgganttttgtcctgcccaagccttctcgcggggagggaactccttctgtctgccgcctgnnacatccctgagggagaaggtctgtgagctgagcccacatcactcgntctgctgcccangtgggcttccatcttcactgaggaaaagncattnngaactccccggcgactgcaaattaagtaatcaaggacagatgggactgggtngaccattccaaggagtacagntactggaagaatctggaagcaataccgagcacatctgntggcatnaatccattggagcaataatgctggacgtagaaagnatgtcgcntttttaaaaaaacatcatcannnctgagcatacgnagcaagngaactctaacttggaacggangataaattcntctaaaaaacaagagaaaaaaccctncagacaaaattatgcancgagagctttaaaaaatatanatcccacagcatnagggaaaacactttgnctggcnatgcccacngnactccanccctgggccgacagaaccgaggactcccggncccaaaaaaaaaannannaagaaagacnngcattaaagggagaaaccagncnggnccngggcnagaaaaaacnanaananggcaaagaaggcannnnttnaaaannantnnaaagaccaaagcagncanagganaaaacc

SEQ ID NO: 3802 - DNA, 639 bp, Homo sapiens
  misc_feature 3, 4, 8, 15, 22, 32, 59, 79, 103, 105, 109, 121, 149, 155,161, 170, 186, 187, 208, 232, 236, 237, 244, 270, 277, 279,281, 285, 286, 289, 291, 293, 296, 299, 307, 310, 313, 316,330, 343, 345, 363, 364, 368, 371, 379, 381, 384, 390: n = A,T,C or G
  misc_feature 400, 411, 412, 414, 415, 416, 439, 450, 458, 462, 465, 476,485, 494, 505, 509, 514, 520, 533, 541, 544, 552, 572, 576,577, 578, 591, 602, 608, 616, 617, 618, 628, 631, 638: n = A,T,C or G
gannttcnactaatngcttggntctcgttctntatgcaggatccctcgattcgaattcngcacgagaaggcctgtgccngaggggttggccagttgggagccngngtcntcctcatcagcntatccccatgtcctctatgcccctaatntgcttnctcatnttggagggnttggggagaagttggnngtgccacccccacatccctgnggaggtgttcacccagtctgaganccgnnagcactnaggcagggcctgatactggacctgtntgagctnananctcnntgntngnaanganctgagacngcngancantgctcacttgcatngagagcccaccananagctgacacctgcggctnngttncgnatcatctncnacntagaantctacatatngctgacttacnncnnnagcccaagggaatcagattccanctatcaaactnctgattangccnaancctctattgtnaacaggttntggcgcacntgttcatcacnactnatgcntcgaanagatgtgaaatgnaaaatgcnatntctatgtntctttactcatttgataatntttnnnatgtctgcattcnaaatgcgtganctttgnccaaagcnnntagctacctnttnttcgccnt

SEQ ID NO: 3803 - DNA, 761 bp, Homo sapiens
  misc_feature 1, 2, 6, 8, 12, 14, 31, 74, 95, 137, 153, 155, 158, 159,181, 187, 280, 295, 298, 304, 306, 313, 322, 326, 331, 346,353, 385, 386, 390, 391, 392, 396, 398, 448, 455, 457, 474,477, 484, 485, 491, 510, 513, 514, 522, 529, 533, 545: n = A,T,C or G
  misc_feature 548, 553, 554, 560, 581, 605, 607, 624, 628, 631, 646, 658,659, 664, 668, 674, 682, 715, 732, 733, 739, 744, 761: n = A,T,C or G
nntttncnaatncnaggctacttgttctttntgcaggatcccatcgattcgaattcggcacgagaaatcagttnttaaactttatgtatatattntagccagagcttaatgttttatgaagataaaggacatgaagnttaacaatggacaacngntanntcagctaattgtgaggtcaagnaattgnaagacatacgggaaggctttgttccacaatattatatggaccactgaacaagaatgacagccctttgttatcacttggcatatgaaaagtgtngtgtgcataggttgngtnaatttntnatgtgcntaaaaatgngatnttaanttatatgctctgaangataatncagggtatagttaaaaatgtacaatgtgccanntcannntatntnaccctagccctcaaattattctgattaaggttaaaatgtgctggcttacngtgcttnancctgaggccttctgatnggntcttggnnacaganttttaaagtaaggtgtganttnngcaactcntgtgctntatntataaagatatnaantaatnncatgtnctgatatttgaaaagaatttncccacaaatgtgttattttaaaancnatcaaagctagctacangctnaanaggctcagttcttcntacataatcggnntaaanattntaaggnattataanaattgtaaattactgcccaattgggtaaaaaangggggtatacatgcaannaataanactcnagccctttataactttn

SEQ ID NO: 3804 - DNA, 857 bp, Homo sapiens
  misc_feature 1, 5, 7, 11, 16, 35, 318, 325, 370, 383, 389, 401, 402, 403,405, 408, 409, 414, 418, 428, 430, 432, 439, 443, 447, 452,454, 455, 457, 458, 459, 463, 471, 475, 476, 482, 486, 488,495, 503, 505, 512, 520, 521, 528, 536, 537, 538: n = A,T,C or G
  misc_feature 539, 545, 554, 557, 570, 574, 577, 583, 584, 589, 592, 600,605, 608, 609, 610, 616, 617, 618, 623, 626, 627, 631, 632,634, 637, 642, 647, 648, 649, 650, 652, 653, 656, 658, 660,663, 665, 666, 667, 668, 674, 680, 681, 682, 683, 685: n = A,T,C or G
  misc_feature 688, 692, 694, 697, 702, 703, 705, 709, 718, 719, 720, 726,735, 739, 742, 743, 745, 752, 753, 756, 759, 761, 763, 764,765, 769, 774, 775, 778, 783, 784, 785, 786, 787, 793, 814,815, 820, 821, 822, 832, 833, 838, 840, 841, 842, 843: n = A,T,C or G
  misc_feature 844, 845, 846, 847, 853: n = A,T,C or G
nttcntnactnaagcnctttgcaacttcctctttntgcaggatcccatcgattcgaattcggcacgaggatagctatctgacttctcaactatgttttaagcagatgttgtaaatcctatgctgtagttcatgaatctatatgacatgtggggtcgggaacatagtaccctaccataagtcaggttattcctactattctgcaacatgtaaataacactttgaacagagcaagtggtaaagattgcttaatttttgcatgactattatgataaatatgttgagaaggaccagctcaaaggaaaacctcttggtaactnggcatangttaaatgtttcccaagaaagtgcactcttcccaaataaagcttnctccttgaaaaanaaacgnccaggtagccannntnaanngatgnaaangcaaaaaacnananacacaangctngctncaggnanngnnnctgngctgactnttgnngagccnccangnctacggntaacctgncngcttacnttgaatgnnactgtgncccttgannnnggaacngaaaccccntcncaatcctgaaagngtcntgnaaggtnnacccntgnaaaaatgnaactnccnnnccaaannnttccngcnnaaannanggntttgnccccnnnncnntantngnccngnnnnccaatntcctannnncntanggtntnacnccccnntnaaanagattttgnnnaagggnttccccatnaacnccnngnccccaannccnggnanannnaaanccttnnccngaatnnnnnggcctntatcggccccctttaaaattnncgggnnnaaaaaacaannccctngnnnnnnnntaaaantagg

SEQ ID NO: 3805 - DNA, 857 bp, Homo sapiens; identical to SEQ ID NO: 3804
  misc_feature 1, 5, 7, 11, 16, 35, 318, 325, 370, 383, 389, 401, 402, 403,405, 408, 409, 414, 418, 428, 430, 432, 439, 443, 447, 452,454, 455, 457, 458, 459, 463, 471, 475, 476, 482, 486, 488,495, 503, 505, 512, 520, 521, 528, 536, 537, 538: n = A,T,C or G
  misc_feature 539, 545, 554, 557, 570, 574, 577, 583, 584, 589, 592, 600,605, 608, 609, 610, 616, 617, 618, 623, 626, 627, 631, 632,634, 637, 642, 647, 648, 649, 650, 652, 653, 656, 658, 660,663, 665, 666, 667, 668, 674, 680, 681, 682, 683, 685: n = A,T,C or G
  misc_feature 688, 692, 694, 697, 702, 703, 705, 709, 718, 719, 720, 726,735, 739, 742, 743, 745, 752, 753, 756, 759, 761, 763, 764,765, 769, 774, 775, 778, 783, 784, 785, 786, 787, 793, 814,815, 820, 821, 822, 832, 833, 838, 840, 841, 842, 843: n = A,T,C or G
  misc_feature 844, 845, 846, 847, 853: n = A,T,C or G

SEQ ID NO: 3806 - DNA, 746 bp, Homo sapiens
  misc_feature 2, 3, 4, 5, 8, 9, 13, 14, 15, 30, 145, 238, 264, 269, 351,364, 369, 371, 378, 384, 386, 395, 408, 422, 423, 480, 497,511, 523, 543, 556, 565, 595, 603, 608, 637, 638, 642, 649,653, 655, 663, 695, 715, 739: n = A,T,C or G
gnnnnttnnaatnnnagctcttgttctttntgcaggatcccatcgattcgaattcggcacgaggccctgtgttaatccaggtgagaacaggtagtacccaaattagggcatggtagcagggatgcagaggaaagaagaggagtangaactatttgggaggtagtattactaggattttagctttgaagggttgagagaaatgtcaagcctaactacaagcaaggtttctagtatcagnaacttcatatcatttgaaatacaaanattancaatcaatgtaaaaaacgtcctgggctaagcatagcatgaagtctgacttcagtgtagcattgaggagggtcctggcctcanatactgcaccagntgttngntcagctntgggcnanaacattagncagatcattaggnatttttgtcccttnntgcattgtccttcgtcatatatttattaaacacctactgtatcctaggcagtatttnccagggatgcaaagatnaattagatctggtngcttttcttcanagtctgaagttaagtgtcangtttgtggggaangttattctngccttgtgtatttagtcccaacttaagctntaattttngaatntgtaaaaccttatctgattataaaaaaannaacncagtctnaaananaggatggntgaatgcataaatttaatcttgaaaatttaancgactggttcttcaaaatgncacttttcatccccggttggcttntggctga

SEQ ID NO: 3807 - DNA, 753 bp, Homo sapiens
  misc_feature 2, 3, 4, 5, 131, 325, 343, 415, 502, 517, 526, 553, 559,570, 573, 603, 607, 609, 620, 634, 639, 652, 663, 677, 698,721, 724, 726, 735, 752: n = A,T,C or G
gnnnnttctaatgctaggctacttgttctttttgcaggatcccatcgattcgaattcggcacgaggaaatgggtaggaacaagcattagcctggtctgggttcctccagctcttaggacaagttggaacanatttgctgttctgatgattcatctttctgatcacagggatagcataactcagctttgaagaaaggcatctgcagagatcatggcagttccattttgcgttctgagtttgctcctttaggtaagggaactagaatgcagatacagttagaatcagtctctctctctctgtttgtctgtctgtctgtcactctctntctccttattgcactganggccgggcgcggtggttcacacctgtaatcccagcactttgggaggctgaggcatgtggatcacgaggtcangagatcgagaccatcctggccaacatggtgaaaccccgtttctactaaaaatacaaaaattagccggcgtggtggtggacgcctgtnatcccaactactcangaagctgangcaggagaattgcttgaaacccgggangcggangttgcggtganccnaaattgcgccactgctctccaacctgggtnacanancaagactctgncttaaaaaaaaaanacaanaaactcgagcctntaaactatagngagtcgtattacgnagatccaaacatgataagatncattggtgagtttggacaaaccncantngaatgccanggaaaaaaatgctttant

SEQ ID NO: 3808 - DNA, 748 bp, Homo sapiens
  misc_feature 3, 7, 551, 600, 611, 700, 702, 721, 730, 735, 747, 748: n = A,T,C or G
tancttnatagacagctacttgttctttttgcaggatcccatcgattcgaattcggcacgaggggaccactggcctgcctgacctcaccccactaatattttttattttttgcagagacaggatatggggaaaagaaatcagattgttactgtgtctatgtagaaaaggaagccataagaaactccattttgatctgtattaagaaaaattgttctgctttgagatgctgttaatctgtaactttagccccaaccctgtgctcacagaaacgtactgtattgaatcaaggtttaatggatttagggctgtgcagcatgtgccttgttaacaatatgtttgcaggcagtatgcttggtaaaagtcatcgccattctccattctctattaaccagggacacaatgcactgcggaaagctgcagggacctctgcctgagaaagcctgggtattgtccaaggtttcccccactgagacagcctgagatatggcctcatgggaaaggaaagaccttacatcccccagccggacacccttaaagggtctgtgctgangaggaggagtgaaagagggaggcctctttgcagttgagataagagtaangcttctgtctnctgctcattcctgggaatggaatgtcatggtgtaaagccaccattcccattcgttggattctgaaataggagaaaactccctgtggctnanaaccgagatatgctggcancaatactgntctgntgctctttgctnn

SEQ ID NO: 3809 - DNA, 753 bp, Homo sapiens
  misc_feature 2, 3, 4, 15, 18, 663, 665, 667, 668, 669, 670, 671, 672,673, 674, 679, 681, 683, 684, 685, 686, 687, 688, 689, 690,691, 692, 693, 696, 697, 698, 699, 700, 701, 702, 703, 704,705, 706, 707, 708, 709, 710, 711, 712, 713, 714, 716: n = A,T,C or G
  misc_feature 717, 718, 719, 720, 721, 723, 725, 726, 727, 728, 729, 730,731, 732, 733, 736, 737, 738, 740, 741, 742, 743, 744, 745,748, 749: n = A,T,C or G
gnnnttctaatagcnagntgctacttgttctttttgcaggatcccatcgattcgaattcggcacgagaaaggcttagatcattgacttcagattttttgtcttttctaacaagtgttcaagactataatataaatttccctctaagcattgtttagccacatttcacaaatttggaaatgtttattcattttcatcttcattcagttgaaaatattttctaatttcccttttaatttcttcttttactcacttattatttggaaatgtgttatttcatttccaaatatttggggattttcaaatatctcctgttaacaatttctaaattagttgtagtcagagaacatattctgtgatttcaatgctgaggcttgtctgaagccccagaatatggtgcattctgtggaatgtttcatgcacatgtaataagaatgtggctgggtgcagtggctcctgcctgtaatctcaacactttgggaggctgaggtgggtggattacttgaggtcaggagttcgagaccagcctggccaacataagtgaaaccctgtctctacgaaacatacaaaaattagctgggtgtggtggtgggtgcctgtaatctcgattgcacccctgcactttagtctgggtgacaaagcaagactacatcttcaaaagaaananannnnnnnnaaaangntnnnnnnnnnnnaannnnnnnnnnnnnnnnnnnannnnnntngnnnnnnnnnggnnntnnnnnnaanncccc

SEQ ID NO: 3810 - DNA, 745 bp, Homo sapiens
  misc_feature 3, 4, 5, 6, 7, 8, 15, 17, 20, 124, 141, 222, 232, 389, 401,409, 410, 418, 426, 436, 437, 441, 454, 456, 462, 466, 495,503, 541, 574, 590, 618, 636, 650, 651, 652, 653, 654, 655,656, 657, 676, 681, 684, 685, 707, 708, 718, 721: n = A,T,C or G
ggnnnnnnttgaaangnttnttgtcttttgcggatcccatcgattcgaattcggcacgaggttacaaacagtggaaaacagacattttcagatgtttgcacaccatgcaccatgcaaaatacanaccagctgaatcataanaacaaatgactagttactgggagggttttctctctttctcattatttttacttctaccaaagtaatgtgcacatactggtnattttattcnattttaattttcaccaagctagctaattacctttctttgttttttgtggaggtgggctgtcggtcttttgtcgaggctgatctccaactcctgtcctcaagcagtccttccacttgggcctaccagagtgctgggataacaggcgtgaaccactgcncctgacctatanctataatnntaagaagnaaaatggngcaaaaaccnnacangagcaacctgacntnctactntcanaaacaatcacttttaactctttgaactgnatctctgntatttgcctacttatttctaagtaatatgcttactctncatgttatctaaatggggtattaaagctttttnacaagcatctcttctnactatcaacattcacattcattacaaanggacttacaatatctttntcaaaaaaaaaaannnnnnnnaaaaaaaaaaagcctttanaactntanngagtcgattacgtgatcccganntgataaggancanttggtgagtttggacaaccccaac

SEQ ID NO: 3811 - DNA, 747 bp, Homo sapiens
  misc_feature 3, 5, 7, 23, 24, 26, 97, 595, 616, 617, 707, 724, 747: n = A,T,C or G
ggntntnaatttgcagctcttgnngntctttttgcaggatcccatcgattcgaattcggcacgagcggtgctggtgcggcgggggactgcggggccngcctcaggtagcagcagcagcagcagcagcagcagcagcagcagcagcagcagcagcaatgtttcacttcttcagaaagcctccggaatctaaaaagccctcagtaccagagacagaagcagatggattcgtccttttagaagcatctcagaggctctccagtgacgtgctgttaaaagtgctgaccctgggtcagaccctttgggttggcttcgtggctccacgacttactctctacccttggcagtggcgtgatctcggctcactgcaacctccgcctcctgggttcaaacgattctcctgcctcagcctcctgagtagctgggactacaggggcctgccaccacgcccagctaatttttttttgtattttcagtagagacggggtttcaccatgttggccaggatggtcttgatctcttgacatcatgatccgccgctcggcctccaaagtcctgggattacaggcgtgagccaccgtgcccggcctatatgttntattttataaagttatatgtnntattatttactttttggtatgtaattggttatgtcataaaattataatataataattccttaaccaaattatattccataaattataacntatgaattcaatatgcntttattaaataaagattctagan

SEQ ID NO: 3812 - DNA, 762 bp, Homo sapiens
  misc_feature 6, 9, 15, 591, 602, 615, 681, 711, 743, 758, 760, 761: n = A,T,C or G
gctatnttnatatancagctgctcttgttctttttgcaggatcccatcgattcgaattcggcacgaggggggacacgttggctgcgttttcggcgggcttcccgggtacaaaaatggctgtggctagcgatttctacctgcgctactacgtagggcacaagggcaagtttgggcacgagtttctggagttcgaatttcggccggacggtgtttacgtgtaattgttcaccataggacgcatgaagagtaccaagcaagaggggagaggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacagaataaatgatgtttctcaggcttctgaagaactctgaaagcctaatttcactctgtaaaaagaaagtttggtttctgaattgggtcttttcaactcttggagaaattccttcaacaacccctggaaaggaagaaacatttaatttcacttttgnatatccctgangaatgtcctttgnatcaccttctttgaatagaagaaaatgtggagaaatctaacacatgcttgcactcttgtaggaatnacttaagtcttctgcttaaagaaacccttntttagaaaaaccaaaggaactttgaaattgtnaattggagatgagcncnnt

SEQ ID NO: 3813 - DNA, 791 bp, Homo sapiens
  misc_feature 1, 2, 3, 4, 5, 6, 7, 8, 9, 10, 13, 15, 495, 500, 501, 502,503, 506, 509, 510, 511, 512, 513, 514, 515, 517, 519, 520,522, 523, 524, 526, 527, 528, 533, 536, 539, 541, 542, 543,544, 545, 546, 547, 548, 549, 554, 555, 557, 558, 559: n = A,T,C or G
  misc_feature 560, 564, 569, 570, 571, 572, 573, 576, 578, 581, 584, 585,586, 588, 590, 591, 594, 595, 600, 602, 603, 604, 609, 610,611, 612, 614, 618, 620, 622, 623, 624, 627, 628, 637, 638,639, 640, 642, 643, 644, 647, 651, 652, 653, 654, 656: n = A,T,C or G
  misc_feature 660, 661, 662, 663, 664, 665, 666, 667, 669, 671, 672, 673,674, 675, 676, 677, 678, 679, 680, 681, 682, 683, 684, 685,686, 687, 688, 689, 690, 691, 692, 693, 696, 698, 699, 700,701, 703, 704, 705, 706, 708, 710, 713, 714, 715, 716: n = A,T,C or G
  misc_feature 717, 718, 719, 720, 722, 723, 724, 725, 726, 727, 728, 729,730, 732, 733, 734, 735, 736, 737, 738, 739, 740, 741, 744,745, 746, 747, 748, 750, 751, 752, 753, 754, 755, 756, 757,758, 759, 764, 765, 766, 767, 768, 769, 770, 771, 772: n = A,T,C or G
  misc_feature 773, 774, 775, 776, 777, 779, 780, 781, 782, 783, 784, 785,786, 787, 788: n = A,T,C or G
nnnnnnnnnnttnancagctcttgttttgcaggatccctcgattcgaaatattttcattggttatacaactgctgtgtcttttctgagaaactcagccccaatgtgtaacaccctggattccacggggcagcaaattccacacactgcacccatgttgtgagcggagattttcgggctgaccaaaacttgaggcgaactgagtctccatcttaacactcaaacacacttcatggcggcctggaaacaaggcaatcattatgaagcttcagcccagttcttctgaaaccaacgtattgggcctgcttcattgtctctctaggggctaatcacaaacatgtgggaagggaagctaaggaatgcctgtctagaaagggaggttgtataatgtagtgggaagaacctatctgtggggtaaactttttttgcatcatgtagaaagcaaatctgggtaattaaatgtttgtgtgtgtgtgtgtgtgtgtgtgtgtatttangtttnnnntanggnnnnnnntncnntnnncnnngcccngtntangnnnnnnnnnggcanngnnnnttcnctccnnnnncananganctnnngncnngtnnctgtncnnncttannnntngaangntnnnttnngaaaacctnnnntnnnccntttnnnnantggnnnnnnnncntnnnnnnnnnnnnnnnnnnnnnnnacntnnnngnnnnangnccnnnnnnnntnnnnnnnnncnnnnnnnnnnaannnnngnnnnnnnnnnatttnnnnnnnnnnnnnntnnnnnnnnnngcg

SEQ ID NO: 3814 - DNA, 788 bp, Homo sapiens
  misc_feature 2, 6, 8, 9, 14, 30, 348, 357, 448, 470, 514, 517, 523, 524,527, 528, 529, 530, 534, 535, 541, 543, 544, 545, 547, 548,554, 569, 573, 578, 583, 584, 588, 589, 590, 591, 592, 594,595, 596, 600, 601, 603, 607, 609, 610, 614, 617, 619: n = A,T,C or G
  misc_feature 620, 625, 626, 627, 631, 635, 636, 638, 641, 643, 644, 645,648, 649, 650, 651, 655, 656, 657, 658, 659, 660, 661, 662,663, 664, 665, 666, 667, 668, 670, 671, 672, 673, 674, 675,676, 677, 682, 687, 691, 692, 693, 697, 698, 699, 704: n = A,T,C or G
  misc_feature 705, 706, 707, 708, 709, 710, 711, 712, 713, 715, 719, 720,721, 722, 723, 724, 725, 726, 727, 728, 729, 730, 731, 732,733, 734, 736, 737, 738, 739, 741, 742, 743, 744, 745, 746,747, 748, 749, 750, 751, 752, 754, 755, 756, 757, 758: n = A,T,C or G
  misc_feature 763, 764, 765, 766, 767, 768, 769, 770, 775, 776, 777, 778,779, 780, 784, 785, 786, 787, 788: n = A,T,C or G
gntgtntnnttacnactgctgttcttttgnaggtcccatcgattcgaattcggcacgagtaaacatccagatgtgttttgatagcctggggtaattaaggttgaggacaagtgtaccagatcaaggagaggaacccgtcccatgcctgccgtgtgttcaggtggctagacttgttgttgcatctgttagttccactcttagtacatcattgtgctgtgaggtgtcattagccgccgtttaatttttcttttgtttttagagacagtgtcttgctctcaccccggcttaagtacagtgacatgatcatagctgactgcaacctcaaactcctgtactcaagtgatcctnctgtcttantgtcccaagaagctaggactgcaggcacacaccaccatgcctggctaatttttaatttttttgtaaagatggggtctcctatgttgctcanctggtctcaaactcctgtcctnaagcagtcccccacctttggccttccaaagcactggggattagnatncttatnntcnnnnatannccttantnnncnngttttnctaaatgggtatttnaacnttttncaaanntttnnnnntnnntttnnanaatncnntttnttncnnaaggnnntttnccanntnttntnnnaannnnaaannnnnnnnnnnnnntnnnnnnnnaaaanccctntttnnnaacnnnttttnnnnnnnnnntntttnnnnnnnnnnnnnnnntnnnntnnnnnnnnnnnntnnnnnatttnnnnnnnnactcnnnnnntttnnnnn

SEQ ID NO: 3815 - DNA, 746 bp, Homo sapiens
  misc_feature 4, 9, 13, 746: n = A,T,C or G
tatntttcnagcngctcttgttctttttgcaggatccctcgattcggtggtcagcagtaagatggaagaaagaaagtcaaagctggaagaggccctcaacttggcaacagaattccagaattccctacaagaatttatcaactggctcactctagcagagcagagtttaaacatcgcttctccaccaagcctgattctaaatactgtcctttcccagatagaagagcacaaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaattccatgaagcttggaaaaaactgattgactggctagaagatgcagagagtcacctggactcagaactagagatatccaatgacccagacaaaattaaacttcagctttctaagcataaggagtttcagaagactcttggtggcaagcagcctgtgtatgataccacaattagaactggcagaacactgaaagaaaagactttgctttccgaagatactcagaaacttgacaatttcctaggagaaatcagagacaaatgagatgatggccgatatgtccaccagatgaccagtgcctgccccggan

SEQ ID NO: 3816 - DNA, 762 bp, Homo sapiens
  misc_feature 2, 4, 5, 6, 8, 24, 29, 33, 608, 626, 655, 684, 706, 728,758, 759: n = A,T,C or G
gntnnncnaatgcttggctctcgntcttnttgntgcaggatcccatcgattcgctaatatccagaatctacaatgaactcaaacaaatttacaagaaaaaaacaaacaaccccatcaaaaagtgggcgaaggacacgaacagacacttctcaaaagaagacatttatgcagccaaaaaacacatgaaaaaatgctcatcatcactggccatcagagaaatgcaaatcaaaaccacaatgagataccatctcacaccagttagaatggcaatcatagagcttttcatttatctgagtgttttcctctgcttgtcgggacttgtgctttcacgagctcctgctctcatatcaggggagtgaataattgaatttggatagttttttggtttttagttggaacactccttttcctgtggaacgtctatagaaaaaatgagtcaaacagagaatatgcaggggaggcaactctgaatgcttccatggctacatacatacctgttttctttgatttgctaaaccctaagttaaaaggaaagtactgtctaaaatagggagaaattccctatatttataccatcatttggagtatttacaatgggagtgttttgnattataaatgtcaaaaangttgagacaggactcacttaaattaagangggaaacttttttttaatgatggaaatangggcttaataaacttacatctncttaacttctttaataattggnaataaactatgactggtcaagaattggacnntcc

SEQ ID NO: 3817 - DNA, 760 bp, Homo sapiens
  misc_feature 2, 3, 4, 6, 7, 8, 12, 14, 16, 33, 321, 486, 492, 515, 519,534, 626, 636, 639, 726, 760: n = A,T,C or G
gnnntnnnctantncnaggctacttgttctttntgcaggatcccatcgattcgaattcggcacgaggtgatatgaaaagcgaatgcaccatttcttggtgatgattcaggtcagcgttgggacccaggaatctcctgttaatcagtaccctggtgattttgatccaggtcatcaagaccatggcttccatcgtaggcagtcacactctttctctcttggatcatttgctgtggggaagcaaactgtcatatgagaggacactcaaacagcctctggagtctcatttgctaaggaactgaggactccagcctgagaactcangcaagtaactgaggcctgccaacaaccatggagaaagcctggaagtggatcctccctcagccttcagtcgagacaacagctgcaatgacagccaagccagcgccacccagcttagccacccccagagaactaactctcagaaaccatgtaagataatacatgttngttgtnttaagctgctaagttttggggtnattnattatacaatagatnattaaaacacatagcatataaataaaatcaataaaaccagtatgggtcagtaatgagttaattagataattagacaaattttgcatttctgnttctatggtnatnattttcttcagaaaaaattctctccgggtaaaaaatgtttaaaagtggttcccaaccggacatttttaaaattaattaatcagtttngggaaggccaaagccggtttggattgcttttaan

SEQ ID NO: 3818 - DNA, 795 bp, Homo sapiens
  misc_feature 3, 5, 9, 11, 14, 517, 620, 686, 689, 703, 704, 706, 707,708, 709, 710, 711, 712, 713, 714, 715, 716, 717, 718, 719,720, 721, 722, 723, 724, 725, 726, 727, 728, 729, 730, 731,732, 733, 734, 735, 736, 737, 738, 739, 740, 741, 742: n = A,T,C or G
  misc_feature 743, 744, 759, 763, 781, 787, 789, 790, 791, 792: n = A,T,C or G
gcnanagcngnctnatagctcggttggctcttgttctttttgcaggatcccatcgattcgaattcggcacgaggaagagaactatctaaatgagtaatggtcaagaaattttaaagcataatgacatgaaacaaacaaccggtccaggaagctcagagaatacaattcatgacaaacaacaaaaatacagcaccagacatagcatttcctatatgtagaataaaagaaaataaaataaatcaataaatagacaaagagaaaatcttgacagaatctggaatgaaaactacattccttgtagagaaaaaagagcaaggatttcagcccacttccagtaagaaaccaggcaagaaagaagagagttgcgggaaatgttaaggaataaatgcaccaacttagaattctacatctagcaaaattatacttcaaaagcagaggggaaatcagaatttaccagacaataaaacactaacggaatatattgccagaaaactttcctgcaaatgtgttaaaagangttattcatggaggagaagagtgatatagatcagaacctgtatttacaataagaaagcaagtatgttgaaaaaggaaaaaaaatgttttatttttcttattgnaaggtctttttaaactacatggtttggttaaaggtaattattaagtaaaatggttttggggccaanttncccaaaaaaaaaannannnnnnnnnnnnnnnnnnnnnnnnnnnnnnnnnnnnnnnaaaaaaaaaaccttngggnccttttaaaaactttttngggggngnnnnttt

SEQ ID NO: 3819 - DNA, 785 bp, Homo sapiens
  misc_feature 6, 7, 14, 15, 126, 246, 254, 320, 368, 392, 408, 412, 419,431, 441, 458, 460, 461, 463, 473, 476, 486, 529, 534, 549,557, 574, 581, 593, 603, 604, 611, 618, 623, 626, 629, 631,636, 639, 640, 642, 649, 653, 673, 674, 678, 681, 686: n = A,T,C or G
  misc_feature 689, 694, 695, 703, 705, 706, 708, 709, 728, 731, 733, 740,742, 743, 750, 767, 769, 774, 775, 778, 780: n = A,T,C or G
cagggnntctaatnncagctcttgttctttttgcaggatcccatcgattgggcaaatattaaatattcaatgaatgatagctgcctctacttctccttttgttgtttttattttccatttatgggngtcatttatttattttaatgtcttcgaaagtattgactttaacaagtactttgtgatgcatttattatttcatttgttattatttatgtatttgatttatttctttgtgaggtaggatanaatctcantcagatttttgctgttaggataccacagactggataactacaaagaagggaagtctgtttaactcncaattctagaggctggcgcatctaagagcatgacactggcaactggcnaggatcatctcatggtggaaggtngaagggagtacatganatanagagaancaccatgggctngactccgctntgtacaaccaaaccttnanntnactaacccgntcntgcaataatnacattaatcccctcatgaaggttccacccctcatgactgattnacatntaattaggccccacnctcctaanattattcacttgggagntcaaagntctaacaccgtnaaccttttgnngggatancattccnaaccnttnccncnattgntgnncnaaaaagnaccnttaccaatccctttaccctnnttgngcntaacnccntttannagcgtgananntnnactgtttcttttaaaatanggntncttaaantnncttggantaaattttaaaattggnantatgnncananctttc

SEQ ID NO: 3820 - DNA, 802 bp, Homo sapiens
  misc_feature 2, 3, 4, 5, 6, 7, 8, 11, 12, 17, 18, 19, 21, 656, 692, 710,712, 719, 725, 737, 749, 780, 790: n = A,T,C or G
gnnnnnnnttnnaaatnnnangctacttgttctttttgcaggatcccatcgattcgaattcggcacgagcctctgcgcctggccccgggtgggtcagcccgcgtggaccacctgaccttggcctgcacccccggcagctcccccacacttttgcgctggttccacgactgcctgggcttttgccacttgccgctgagcccaggtgaggatcccgagctgggcctcgaaatgacagcagggtttgggcttgggggactgaggcttacagccctgcaggcccagccgggcagcattgtccccactcttgttctggctgagtcccttccgggggcgacgacacgacaggaccaggtggagcagttcctggcccggcacaaggggccaggcctgcagcacgtggggctgtatacgcctaacattgtggaggccactgagggggtggcaactgctggaggccagttcctggctccccctggggcatactaccagcagccaggaaaggagaggcagatccgagctgcagggcacgagcctcatctgcttgctcgacaggggatcctgctagatggtgataaaggcaagtttctgcttcaggtcttcacaaagtccctttttaacttgaggaacactttctttcctggaagcttgaattcaanaaggcaagggggggccaactggctttttgggtcaangggccaacaatcaagaancnttttgtnggcaantcccgttaccanggaagccaaatnttggccaagggaacccccaggaaaacccctnaagggattgnccccaaggggct

SEQ ID NO: 3821 - DNA, 828 bp, Homo sapiens
  misc_feature 4, 7, 36, 51, 61, 79, 98, 107, 110, 123, 138, 164, 170, 174,182, 183, 186, 192, 193, 216, 220, 224, 238, 239, 240, 245,251, 255, 263, 270, 274, 277, 278, 284, 290, 299, 323, 332,337, 339, 347, 352, 374, 382, 389, 411, 412, 422: n = A,T,C or G
  misc_feature 426, 429, 430, 431, 438, 441, 446, 452, 453, 454, 455, 457,459, 461, 465, 467, 471, 473, 474, 476, 495, 497, 500, 516,517, 524, 528, 529, 539, 551, 553, 556, 557, 562, 566, 567,569, 571, 578, 581, 594, 596, 600, 602, 604, 607, 616: n = A,T,C or G
  misc_feature 623, 627, 629, 642, 649, 656, 658, 662, 665, 668, 669, 672,675, 676, 680, 693, 694, 712, 736, 740, 741, 742, 746, 758,773, 774, 785, 791, 824: n = A,T,C or G
ggcnctntttctaatgcttggctactcgtcctctangcaggatcccatcgnttcgaattcngcacgaggtgaagaagantaaaagagacagaaaggangaacggctngangaaaaggaacagngatgcgaaagaactnaagatagaaaaccaccattaaaactnaaggantccnaggcctannacnctcaannagggacaggaggctgacctttangctngtgnggaggaagtccctnnngccantggctntgcntggaaaancatcatnaagnagnngcagcncaaggncttctccantgaggaataggctcaacgtgggcnctcaggtgngaggnancatgagcnctccntagttggaacatatccctaagngtatgatnatgaatntcccaggagcattctgcaggcnnttaaccatangacnatnnngctgctnctntgcgnatattnnnntngnanggancnatcnanncntattttgaaacaggtcccngncanttgaaatttccatccnnaatttcngtanncaaggttttngctcatcctacncnatnnctgancagnntnanctattcnganaaggtacttacangnccancnantancattgtagnattgcgntatnantccccttcctttnttaattnccctaangnactnaanttnnaanccnnggtngataatagcaacnntttcgatgtggatttaantaccctttgaattccaatttttgnttgnnnattnctatacctttancatgttgaatccctnnattaacaattnctttantttggaacttcttaacccaccttcaaatttttngccg

SEQ ID NO: 3822 - DNA, 753 bp, Homo sapiens
  misc_feature 2, 3, 4, 5, 6, 12, 19, 27, 35, 400, 428, 462, 490, 546, 593,622, 646, 677, 695, 698, 744, 745: n = A,T,C or G
gnnnnnttttcnaatgctnggctactngttctttntgcaggatcccatcgattcgtttaaaaagcattttattatgtattatgaaatatttcaaacataaaaagatgtaaagactatctaccaatgactccccccttaataaaacaaattaacctgaaggctgttttgtgcccctccttgattgtgcattcacctcccaacccctcgctccttgggcaactgttatctttgttatttgtcattgccttaacattagatttttttattactgcttttgtaattctaatgatatcaaatggaaaaaatattttgaatgcaactcctcttttaatttgctccaattggtatctgtattttttagtccatgcctgtattataagtattataaatactatctgtntatacttttgctaaagtcgagtgtattngttaaactgatgatacagcttcataagattttangtcagctaatggattgtcaatattttgngtagaatacttaccaggttataaattacaatttgaaacatagatatcctatagttngagaatttgaacatagatatggattatgttgaaatcgactgcctttntcttagctatgacagtaataaactatatnacaacaaaaaaaaaaaaactatanaaactcgagccttttagaactatatgagtcngattacgcgatccagacntgntaagatacattgatgaatttggccaaaccacaacttggaatgcaanngaaaaaaa

SEQ ID NO: 3823 - DNA, 792 bp, Homo sapiens
  misc_feature 2, 3, 4, 5, 6, 7, 550, 625, 693, 709, 716, 735: n = A,T,C or G
gnnnnnntttcaaatcgctaggctacttgttctttttgcaggatcccatcgattcgaattcggcacgagagaggaggaggaagaggaggaaaatggggattctgtagtccagaataataacacttcccagatgtctcataagaaggtggccccaggcaatcttagaaccggacaacaggtggaaacaaagtcacagccacactccctggccacagagaccagaaacccaggaggacaggaaatgaacagaacggagctgaacaagttcagccacgtggattctccaaattcggaatgcaagggtgaggacgcgaccgatgaccagtttgaaagccccaagaaaaagtttaaattcaaattccctaagaagcaattcgccgctctcactcaagccattcgcaccggaactaaaacagggaagaagactttgcaagtggtagtctatgaagaagaggaagaggatggcaccctgaaacagcacatagaagccaagcgcttcgaaatcgctaggtctcaacctgaagacaccccttgaaaacacagtgaggangcaagagcagcccagcatcgaagagtacatcttccgatttcaaggaactgatgaaattagaaaaaacaccttccngaacattgggatagccttggaagcaggacccattaaacaagcttggaaaattccaattcggtggaaantgagttccccaaaagncccttanttggatacctcatggttcntttccaacaggagaattctggttgccaaggttcatttcccaccattagccccaagag

SEQ ID NO: 3824 - DNA, 757 bp, Homo sapiens
  misc_feature 3, 4, 5, 33, 35, 176, 177, 178, 196, 205, 266, 268, 277,302, 319, 330, 333, 342, 373, 388, 406, 412, 432, 443, 449,451, 477, 481, 483, 489, 500, 517, 521, 523, 529, 536, 543,544, 571, 613, 617, 653, 656, 666, 667, 675, 677, 680: n = A,T,C or G
  misc_feature 693, 751, 752, 757: n = A,T,C or G
gannntgctactaatgcttggctactcgttctntntgcaggatcccatcgattcgtggaaaatataaaaagtgacactttatgcaaatgtgatggcctccgagctgaaatgaaggaactggcaatctttccaaagtggcagccaaggccccactccctgtcctactcaatctctgnnnggaaaaactgtgggatangatagcagncagctggggacacacagaggaacattcaacaggaaggtcccgtctagggaaaaggccacanancccatcctnttgccgattcagggatccttggatntaagtggattaaacganagggaggaaanctntcatttcantggtcttcaaatcaagttgaaatattactgngaggtatcccacttnagcctgaaccagcagacntacganagggtcactctagagtcacnaaggaaagcangtcccncngaatgcaacacattgatcggaagtgnacgncncagacnaagaatggccnacttgataattacttangacntntatttnaccggangaacatnnaaatacttttgtaaatattcatattgntgaacctttcataatcaggaatttactatgtactatactgtnagtnataattcgcctataatttacttaatctatctccttntangacatatacnnaaatgggntnctntggaagttgcctngtgcgaaaatgtttttaaaagtttttcaatttggtttggaaaactctaactttttttnnttttn

SEQ ID NO: 3825 - DNA, 747 bp, Homo sapiens
  misc_feature 2, 3, 4, 5, 8, 9, 10, 13, 268, 280, 307, 399, 401, 440, 485,542, 579, 605, 641, 670, 684, 688, 689, 691, 701, 703, 711,725, 730, 740: n = A,T,C or G
gnnnnttnnnaanaacagctcttgttctttttgcaggatcccatcgattcgaattcggcacgaggttacctctcaattttaactttttttttcttttttaattaatgttttttacccatggcaagctgtaatagcttttttgaggggaggtaggtgcttgataaagaacagtaggtgctgcttatcaacagatgaaaggagggttctttttcaggcaaccatctcatttgtgagtgaatggactttctctttaaagtgctgggattgntagtgccatttntattgtaaatatcagaattgttattcnttgtcttctacctaagaattctgtctcttaggctttctcttcccagatttcccaaagttgggaaaagctgggttgagagggcaaaaggaaananaaagaattctgtctctgacataattagatagggaaccanttgggaagctgtaagaataatgcaggtgcaaggtggtggtggttnagagccgggtgatagctgtggatgtagaaagaatctgaatatattgtgtcatagggntgacctgatttgctaatggagtagttaaggatgtggnaaagtggaatcaagcatggcttcaangtctgggcctgaaaaaccgggagaatgagtcacatnaactaagacgggaaagacaatggtagggncctgtttagggaanactnngnagaagattancncctcattnctaatgatgtaatncatanaatcttgcangagcctt

SEQ ID NO: 3826 - DNA, 745 bp, Homo sapiens
  misc_feature 1, 2, 6, 8, 11, 573, 585, 624, 658, 671, 676: n = A,T,C or G
nntgtngntcnaatgctaggctacttgttctttttgcaggatcccatcgattcgctagagtgcaatgttgcagtgcaatgctgcaatctgggctcactgcgacctccacctcctgaggcaggagaatggcgtgaaaccaggaggaggagcttgcagtgagccgagatcgtgccactgcactccagcctgggtgacagagcgagactccgtctcaaaaaaaaaaaatctaattatcaaatgcatcccattgtgatagtcctacattatgtgacattaacctatattcctgggtccttttaattcccaactactgctcttagaggtcttagccttttatgttaatttttataaattcaattaaataaatattattcccaaatcttagtgtttgcagattagttataaatcctatccaaggtaggttaaaggccaccgttttacagataaatagtactttttatatttttatctgaaatagtgcatttgttgagaataaaagaaggtatgtttaaaaatagaatcttttgggcctggtggtacgcccttgtagtcctagctacttgggcagctgangtggaggatctncttgagcctaggagttccagactgcactggcgtcactgnacttcagcctgggcgacagaatgagaccctgctnttaaaaaaatatnaaatngactattttatagttgaatgttagttagcaagttatcatctgagccttaagtcaaaattaaatctttaa

SEQ ID NO: 3827 - DNA, 785 bp, Homo sapiens
  misc_feature 2, 3, 5, 13, 17, 32, 102, 115, 127, 173, 228, 241, 242, 248,252, 257, 267, 270, 272, 280, 284, 286, 290, 291, 301, 302,317, 319, 322, 324, 325, 329, 330, 332, 333, 339, 349, 350,351, 352, 354, 358, 359, 362, 365, 370, 371, 374: n = A,T,C or G
  misc_feature 377, 380, 403, 406, 409, 414, 421, 425, 426, 434, 439, 440,455, 456, 462, 467, 470, 475, 480, 482, 486, 487, 492, 496,501, 510, 512, 514, 520, 530, 538, 581, 583, 601, 612, 615,624, 648, 652, 654, 659, 661, 672, 688, 689, 702, 710: n = A,T,C or G
  misc_feature 711, 726, 738, 748, 753, 763, 767, 768, 772: n = A,T,C or G
gnntnttctaatngctnggctcttgttctttntgcaggatcccatcgattcgaattcggcacgaggctggtgttagggttctttgtttttggggtttggcanagatgtgtttaantgctgtggccanaagcggagggagggggtttggtggaaattctttgctatgatgtctntgtggaaagcggctgtgcatacattcaattgctattaaaaaaaaaaaaaaaaaancacaaaagataannctaatnaaanaaatnctcataaganacnangacctttnaacntnttcnnactggtattnngtaaatccatccttnancananncatnntnnagttcngaccaacaannnntngatnnccntgnaaaanntgnttnatnagggaaattcagcgatctattgnttnatngcganccctttntgannccaataancaggnnaaccacttccatggnnttcgtnaaatnctnaaggnctggngngaannattcngagngtctncaatactcngncntagagntattccatgncccccagnacctaaatctttggccctttaagcatagggaatttccccaccncnccttaatgctagccattntctgtttcatnccncaaatttgnacttcccataaccacttccaaganaaananttttncncggcggaactntacttggaaaaccctnncgagttccctaangaagaagnncctaaccccccattnaaaattgacgtnccgattttgntccanccgttttgancaanngggnaacccttccggac

SEQ ID NO: 3828 - DNA, 798 bp, Homo sapiens
  misc_feature 8, 26, 301, 521, 528, 562, 601, 615, 638, 644, 645, 660,666, 676, 696, 697, 732, 751, 752, 768, 788, 793: n = A,T,C or G
gcaatgcngtctttgaatcccgtttntaaatccctctgtttgcaggatcccatcgattcgaattccaattccacattttcaagaaataaggaggcaaaaattttcatatatgaattggaattatttgttttcttattaggccgagatgcgccgcgtgcggctgctggagatggcggacgcgatggatatgttctgccaagggttggtttgcgcattcacagttctccgcaagaattgattggctccaattcttggagtggtgaagaaagaaaaaagttgaactagatttggtctgatgcanttacagatttacaaactgtgcccccaccctcctgcagacaccttccactcctcattcttgagggattagggatggaggtcatgcttctgtatcgacttcatgctgaccagggtcactgagtcccctaaagtgagaggaatgaaactcttgggcttctgagttcaaatgagttctggggtcacctggagtagcttgaaaggctggtattggtgtaatacangctgaangtggaagtgttggaacctgaaggacaaacagctnaccatccatttaaataaataagggcccaaaagttaccanaaccagtggccacnaaggggccccagcagaaggaaanaaaccnnggtgaaggtgccggnataatnggacctcgantgcctttttaaaatctcaanngggtttggccccgggttccaaatgggctttaacgnccttggaaatttccagccnnaaagaaaaaacccccnaaggccaagggtggaatccnttaangggcc

SEQ ID NO: 3829 - DNA, 773 bp, Homo sapiens
  misc_feature 12, 13, 15, 18, 19, 20, 33, 39, 46, 56, 412, 553, 587, 613,646, 654, 674, 698, 701, 711, 719, 721, 730, 738, 741: n = A,T,C or G
gcaatgcttggnnanatnnnaggctcttgatcncatcgnttgatcnaccccatcgnttcgaattcggcacgaggttacctgtgtatgactgaagtacatattcgttatctgcgtgagacagtacagattggtgtatagtattttacagccacttcattatatgctatttccgtgtactggcaaaaaagagaataaaacttcctaggatataagtacctactgctgttttggtgcatgtccagttaggcttttctctttttatttgtttgtgtacctgtaactccatataagcatatataatcatgttacatatgtttaaaaggcgtcattttgcaatgcagttttatcactagttttttctctgtcaagggatgtataaaaatggatcacaaatctaaatttaaaactatanaacttaggagagaatctttgtgatcttggattaaacaaagatttgttagataagatacagaaagtatgaacaacataagaaaaaagtctatagtttaaacttttttatattcagttttgcttttcaaaatatacctttaangaaatggtctgggtaaggtgggctcacacctgtnatcccagcacttttgaaaggcttgangtgggaagtttggcttgaggctaggaagttcangacccagnctgggcaccatagcaagganggtcttttacacacacacaccacnacncacacacacncacacacnanacaccgcancccaggtngcntttgaaagaactggctttttacacacccccac

SEQ ID NO: 3830 - DNA, 773 bp, Homo sapiens; identical to SEQ ID NO: 3829
  misc_feature 12, 13, 15, 18, 19, 20, 33, 39, 46, 56, 412, 553, 587, 613,646, 654, 674, 698, 701, 711, 719, 721, 730, 738, 741: n = A,T,C or G

SEQ ID NO: 3831 - DNA, 851 bp, Homo sapiens
  misc_feature 6, 7, 8, 14, 16, 19, 20, 22, 26, 30, 31, 44, 52, 81, 96,110, 137, 163, 173, 277, 281, 291, 305, 311, 321, 328, 340,345, 357, 358, 361, 362, 366, 371, 387, 393, 395, 419, 447,464, 486, 527, 543, 547, 573, 577, 594, 647, 676, 679: n = A,T,C or G
  misc_feature 681, 686, 688, 696, 721, 741, 742, 748, 767, 768, 781, 783,784, 788, 791, 793, 802, 804, 810, 813, 819, 821, 823, 826,830, 831, 844, 846, 848, 850: n = A,T,C or G
tcaatnnntagggncnggnntncctntttnntgggccagggcantacccccnattccgcgttattccggaaaattttccgngacctaccgtagggntttcacacctgggnggttgatggaaccttggaaagcttgcnataatacctgcattatcctcgcagtnggtagtacangacaccatgatatgtgccgacatgagtcattttacagcccacttcattatatgctattgtccagcgtgctggcaaagactagacataaaacttgactcgatctnagtncctactgctncacttggtgcatantcatgncggctctgcnatcaagntaatgcatgagnacccntcactccatatnntcnnatancaacntgttgcactgcttcanaggctntntatgggctaagcacaaacatgctngaagggaatctgacgaatgactgtttanaatgggatcgcagtatntaagtattagggactgaacctnttagtgggagtaatctttgtgatgcatggatgtaaacagcnaatctgggtaataganacanaagagtgtgaaccgcattgtataaantgtntataggttaaacttttntatattcagttttgcttttcaaaatatacctttaaggaaatggtctgggtaangtggctcacacctgtaatcccacactttnaanangcttnangtgggaangttggctttgaggctaggagttcangaccagcctgggcaaccttnncaagantgggcttttacacaacacnnctccacacacacncnnactncananacacacgcngnccaggntancattancnanganttgnnttttttacccccncncncnc

SEQ ID NO: 3832 - DNA, 851 bp, Homo sapiens; identical to SEQ ID NO: 3831
  misc_feature 6, 7, 8, 14, 16, 19, 20, 22, 26, 30, 31, 44, 52, 81, 96,110, 137, 163, 173, 277, 281, 291, 305, 311, 321, 328, 340,345, 357, 358, 361, 362, 366, 371, 387, 393, 395, 419, 447,464, 486, 527, 543, 547, 573, 577, 594, 647, 676, 679: n = A,T,C or G
  misc_feature 681, 686, 688, 696, 721, 741, 742, 748, 767, 768, 781, 783,784, 788, 791, 793, 802, 804, 810, 813, 819, 821, 823, 826,830, 831, 844, 846, 848, 850: n = A,T,C or G

SEQ ID NO: 3833 - DNA, 744 bp, Homo sapiens
  misc_feature 4, 20, 92, 93, 433, 517, 525, 587, 598, 654, 705, 730: n = A,T,C or G
gaanctttgatccctttctngttctttttgcaggatcccatcgattcgaattcggcacgagggcaggcactggagagccagggtggttcagnngcagctcctctgagcagggagtcaaacagggctgaaacagacaccagctctccaggaccagctgctccaggaatcaacctctaccctgaaccaggtccctgaggaccaccacgtggctgcaacacagcaggagttcacagtccagaggagaagcccgatgctgaacagagaatcacatccgtgagcaacacaaaaggtctcaatcaaaaacctctgaaagccactggcctagagttagaggaagagttagccatgagaaatggtggtgacacaggttccaaaagaagaaacaataggtatcaggctcagagatgaaagggctagaaggaggacacaccangttcaaggtctggcctttctcgagggcagtggggagccatgggaggagcctggacctgtggccttcctgcttcacctgggcctnaacccgtnacgaccacctggcctttgaggtgtatctcgtttctcatcataagagctctttcgctcgtgtngaactgggaantggccgtcattggctgcgcatacctaaacttggtcagggcagaatgattgctagtnaccacgtgaagcaggaaaccccggcattaacttgcagaatgagttggtgangcttgaaataaatggtggaaacatngtggcaatctttta

SEQ ID NO: 3834 - DNA, 747 bp, Homo sapiens
  misc_feature 3, 4, 5, 6, 9, 10, 12, 13, 20, 28, 34, 36, 667, 721, 731,741: n = A,T,C or G
gannnnttnnannaatgctnggctactngttctntntgcaggatcccatcgattcgaattcggcacgagaacacttacagcctatattgtaacttctctcctgggatatagaaagtatcagcctaacattgatgtgcaagagtctatccattttttggagtctgaattcagtagaggaatttcagacaattatactctagcccttataacttatgcattgtcatcagtggggagtcctaaagcgaaggaagctttgaatatgctgacttggagagcagaacaagaaggtggcatgcaattctgggtgtcatcagagtccaaactttctgactcctggcagccacgctccctggatattgaagttgcagcctatgcactgctctcacacttcttacaatttcagacttctgagggaatcccaattatgaggtggctaagcaggcaaagaaatagcttgggtggttttgcatctactcaggataccactgtggctttaaaggctctgtctgaatttgcagccctaatgaatcagaaaggacaaatatccaagtgaccgtgacggggcctagctcaccaagtcctgtaaagtttctgattgacacacacaaccgcttacttcttcagacagcaaaacttgctgtggtacaccaatggcagttaatatttncgcaaatgggtttggatttgctatttggcactcaatggtggatataatgggaangcttttgggncttttaaaanacaaaa

SEQ ID NO: 3835 - DNA, 756 bp, Homo sapiens
  misc_feature 3, 4, 9, 17, 496, 645, 706, 707, 708, 709, 710, 711, 712,713, 714, 715, 716, 717, 718, 719, 720, 721, 722, 723, 724,725, 726, 727, 728, 740, 751: n = A,T,C or G
ttnnttccnaatatcangctacttgttctttttgcaggatcccatcgattcgaattcggcacgaggcatcctgtccttgggaaccctttctcattctccaagcctggtcagctgcctgcacaggcagaggtgccctcagcccaggttagcaacactcatagttttgccaattaccagtagacactagtggaaccatctaactggaacttcctctctccttccacttatttcctcaaacttgttgctttacactagacacatgcaaatgtatgttttaaacacaccaaaacagatcatgccaaatgagttgcctgtcaaaggctggagggcaggaggagggcctgggtttgggttctttcctcccagcctttggatggtgccttgggccccttagccccagcgccagggcctcccagctgaggccacaggaaagcacttttttatgatgtactaaaagccacagtatgtggcaactgcaaaaggatcaggaatttanggtatgatctcggtcacgtgtcccgggcgctgaggggaaaggaagcgggcatgattgtagacaatgagggggttctcttgatgtaatgaaatgcaattttatggtttggtgcaaaaactctattttccagtaaattaactttatttctnaagcatattttggatttgccatcaagaagcaataaagcattaaatctttaaaaaaaaaaannnnnnnnnnnnnnnnnnnnnnnaaaaaaaacttngagcctttttnaactt

SEQ ID NO: 3836 - DNA, 824 bp, Homo sapiens
  misc_feature 19, 33, 36, 39, 41, 63, 155, 168, 454, 460, 530, 557, 597,612, 619, 620, 650, 658, 664, 666, 686, 705, 743, 748, 754,760, 770, 778, 779, 785, 799, 803, 806, 809, 814, 816, 820,822: n = A,T,C or G
gcttccttccaattacctngtgggctactggtnctnggntntatctgcaggtatcccatgcgnttcgaattcggcacgaggagactccaggctgagctggctgaccgacccaatccccctacccgccctctgcccgctgacccggtggtgagaancccgaaggtaacngtggggggagagcaaaaaacacatgaaaaaatgctcatcatcactggccatcagagaaatgcaaatcaaaaccacaatgagataccatctcacaccagttagaatggcaatcatagagcttttcatttatctgagtgttttcctctgcttgtcgggacttgtgctttcacgagctcctgctctcatatcaggggagtgaataattgaatttggatagttttttggtttttagttggaacactccttttcctgtggaacgtctatagaaaaaatgagtcaaacaganaatatncaggggaggcaactctgaatgcttccatggctacatacatacctgtttctttgatttgctaaaccctaanttaaaaggaaagtactgtctaaaatangggagaaaattccctatatttatacccatcattttgagtnttttacaattgggantggtttnngtattattaaattggtcaaaaaaaggtttnaaaacaangacttncnttaaaatttaagaaaggggnaaaactttttttttttaantggattgggaaaatagggggctttaaataaaaactttnaattntccttntaactnccttttaaanatttttgnnaattanaacttttgaactgnttcnaanaantttgntncatntnct

SEQ ID NO: 3837 - DNA, 765 bp, Homo sapiens
  misc_feature 1, 3, 6, 7, 8, 9, 10, 11, 12, 13, 16, 25, 37, 41, 45, 102,414, 468, 487, 570, 610, 633, 651, 654, 675, 715, 725, 761: n = A,T,C or G
ngnttnnnnnnnnctntgaaacttnctggcacttccngtangaanccctcgattcgaattcggcacgagaagaattgtacgactcttattgatgagtgcaanttttttctatagatttgaaagtcactactaatcatgactagctgattataataattgagagtaaacttttaaaattattaaatatcctgtgaaagttggagcacagtaaccattaaccctaaatttgatactatgtccatatgaattcagatcataatagtgctctatcatgtgaaactactaaaggatgtatagagttaaatattacgtatccactttaatgaagaataggtattacacagtaatggttgtttaaaaaaattttttttatataatatcagagtttacctgatgtgcttgggcatgcatagntgtcaacaatgatttgctagttgtacagttttgtatgctgatcagaattatcanaagtttgtaaagcatcttntcttttgattcatacatgaaacaaaaacaattctgtgtattctcagtgttctggataaaaaaattttaagtgcatatactttntaggaaatatgacagatgcttgtcataatacaaaaatatnttacttttttattatgctcattnctatggggagaggaaacntancccggaaggaaggaagaatanggattggaaaacatttggctacttacctgcaactcatccntggacaacangccatgtgcacatttacacccatgccccatataccncatg

SEQ ID NO: 3838 - DNA, 766 bp, Homo sapiens
  misc_feature 3, 6, 16, 24, 35, 38, 39, 42, 45, 46, 57, 60, 81, 82, 87,95, 98, 100, 110, 119, 122, 123, 124, 125, 129, 131, 159,162, 166, 168, 176, 183, 191, 200, 214, 219, 230, 244, 259,284, 287, 292, 313, 331, 367, 375, 388, 389, 390, 418: n = A,T,C or G
  misc_feature 426, 430, 439, 449, 455, 460, 470, 473, 475, 484, 499, 502,506, 516, 526, 530, 533, 538, 544, 548, 553, 556, 559, 566,571, 574, 577, 579, 581, 583, 587, 595, 596, 599, 602, 611,620, 632, 638, 643, 663, 678, 683, 707, 719, 723, 737: n = A,T,C or G
  misc_feature 748, 757, 758, 760, 761: n = A,T,C or G
ctnctntgactaatgnactgaacngcaaattcccntannaanccnngcggtgcgggnctncagactgtagaagcagaaggnnccatncccgatgnttngnttttggtgcnaaggaccgnccnnnntagncnctgtccctgatatgacgccgcaatgccngangaancncacccaanacgacangcttgtcnagataagcncgcacagggagcangcagnactgctgcagntgccgcagccgcanccaccctacaggganctgcaacaaaatggacaaaccacancanatgcngaggagaatggagcccatacnataccaaataaccatacngatatgagggaagtggatggggatgttgaaatcccncctaatanagcagccgtgtannngggccatgaatctgaaactctatcaagngcctgcancccnggtagcganctcctagcgncatggnctggngactcaacancangnatatggaancttaagcgagaacancancagnggctctacanagccgtactnaganatngtatnccacangganggcancangtnccaagcnacaangangtnanancngtanacgggaannaanaanggacacttntggccaccngggccctatgangggaanccccngaatacggactaaagaaggnaaacctcctaaccancttangggcacattaaagccctttattcncattaaaaaggnaatnccaaaggaaatttncaacccaagcncccggccgnngnnaaaat

SEQ ID NO: 3839 - DNA, 746 bp, Homo sapiens
  misc_feature 2, 13, 21, 25, 33, 292, 385, 599, 686, 709: n = A,T,C or G
cnttttgatttcnctttggcnaccncctctttntgcaggatcccatcgattcgaattcggcacgaggagaatactttatacttctcagctttttttgtatttgactgtgacctggttataccatttgccactgtgaggcttagctgtgcatctgtgaatgggagattgttcttagagattggtcatagttgtccacctgcctcggaaactgcaggtacaaatgcagcagcaaagtatttacattcttacttcagggctgatctcctatttctatcagtccttttgaaggcanagaatgttaatttggaacaacctgcatatttattcaaatttccagagagatgaaactttcagaatgctgtgctgcagcgccccctagtgccgngctgtactgatagtccccagcgtctcctgaagccgaaagtggtgtttcccgcagttccggcgggagagctgtagccagcaggttgtgcaagtgaacattagacatcttttctccttctcgccttccttgggctgagatggaggaatgtgtctttattgctgaaggcaaggtctttgtttttcctttagcaggaacactggttttcccacttcgntaacctttgcccaaggtttctcaactcaagccccctgaggccgtagtggccttcacacacctccagaaggtaaactgaccagcttanccaacaggctatgctttaaggangaagggtcttttggttcccatcctgctgggggggggg

SEQ ID NO: 3840 - DNA, 739 bp, Homo sapiens
  misc_feature 7, 9, 13, 14, 25, 31, 566, 586: n = A,T,C or G
tcttctnanttcnnttggctcttgntctttntgcaggatcccatcgattcgcggcacgagcccaggctggtcttgaactcctcagcttttactttagcttcccagtgtgttgggattacaggcatgagccacaatacctggccaagtccttttttttaatcaaatgacttattaatacacagtttctttgccagcttttgttttcatttgctatcaaaaatgttgcttagtagtgctttgatctgagttatcaataacaggtaaatgccattatggataataattcaaaaagaagcttattaattattaggcctatctgagagtgaagtaaagttagcattttctttttgtttattttacttattgtttatttgtttagagacagggtctcgctgtgttgcccaagttggagtgcagtggtgctgtcataactcattgcagtctcaggctggagtgatcctcccatctcaccctcctgagtaggtgggattagcatatgccaccatgcctggctaattcttttattttttaatttttttgtggagatggggtcttgccgtgttcangttggtttcaaactcctggnctcaacggcttggcctccaaggtgctaggattacaggtgtgagctaccatgcccagctgagcatttttaaaaaatactgggctttgacatgagtcgttactattggatctaaccttatgactgatatccctaaaaatattataaaatttaagg

SEQ ID NO: 3841 - DNA, 748 bp, Homo sapiens
  misc_feature 9, 569, 653, 677, 708, 721, 725: n = A,T,C or G
gaagttgtngatcagctcttgttctttttgcaggatcccatcgattcgaattcggcacgagagcaaccctagcaatagactgactctactacaaaacaatttggttatttctcttactatttctctattatatctgttgagggaatgttatcatgagcacaggtattagtcctatgcttttaatcggtttagtggtttctttgtgtctcattttattcatttgtaatttttttaaagactataaaacttccacagtttctttagatcattaagttatatgactctttttcatgggggtcagttaacaatacataagaaaacatttgttctaggataatatatgacctaacagtcttttgttagacttagagatatcaatatgctttctatgtttcaggcatattttatattcctggaaattaaacaatatattttaggaccccataccatgtgctctcagtaggacgatcacaaatcagtgatcatattctagtgttcttttataggaaatgtaaacctatgtcattacattgttagtacaactgacagtgaaatatttaaaaaatctntgtcagccaacaataatcatacttcaaataagccttatgatatgtgatatcacattggtgagtgaattttggtcaaggcagtanaatggagtcactaagaggacagtnggacaagctgtctgagtttcaatcccagctntggtactcactantggngacatctttgggccaatttactt

SEQ ID NO: 3842 - DNA, 745 bp, Homo sapiens
  misc_feature 7, 16, 537, 596, 683, 693, 724, 741: n = A,T,C or G
tcttttnctaatgctnggctacttgttctttttgcaggatcccatcgattcgaattcggcacgagaccatgttgcccagtctggtctagtctgttttaacaagttgttgctgtgtaatgatatatgtgtggtgttaatttgcttgttcctaagtttaaatgaggtagagcattttatgacatgcctgttctagtcttttgcttatttttctaattgccttttctttttcttaataatttcagttcttcatatgttcagcatactagtcctttgtcaatttacatgtattgaatatatatactctcccattctgcggcttattgttccattcttcatgaacatttgtaattttaatgtcctatttagacctttcctctgtctattgttttatattttgtattaaaggagtcattcattactccaagatcatgaagattttcttgtatgtaatcatgtaatcttcttaaaagctttatggcttttgctttttttttttttttttaagagtcttgttgtgtctccaaagctggagtgcantggcacaatcacagctcactgcagcctcagcctccctggcccaagtgaccttccacctnaccttctgagctgggactatagccatgcaccaccatgcccagcaaatttttattttttgaagagcccgattcactggggttgcccangctgggttcnaatgccctgggctcaagtgatcatcctggcntgggcctccaaaggctnggga

SEQ ID NO: 3843 - DNA, 757 bp, Homo sapiens
  misc_feature 5, 9, 11, 22, 23, 29, 106, 107, 207, 216, 263, 297, 301,313, 362, 375, 400, 401, 427, 440, 463, 465, 466, 496, 497,506, 509, 511, 517, 532, 561, 572, 574, 579, 582, 586, 596,661, 675, 677, 678, 681, 701, 714, 727, 748, 755: n = A,T,C or G
gtgtntggntnactctttgtcnnttggcnactctgctctttctgcaggtagcccatgcgattcgaattcggcacgagtctcgatctcctgacctcgtgatccgccnncctcggcctcccggggtgctgggattacaggcgtgagccaccgcgctgggcctggatcaaatctttatccatgcacattggaacacaggattactgggtngaaatcatnctagttttgtcatttagatacttgtagatgaatctattttagcacanggtataaataactcgggaggtcatctctatcttntttncttttgtgcatntggctataccacgtttaggtactaaaacagctttgcttatgttggccangggaaaacatggnattctgtgcgcaaagctaatgatcnncagccctgccttggcccctcccttgnttatggtcattgnaagatgcccgcatgttaaggctnannctgtcactgggctgggtgtaatacccgatnnattcctgcngcnancctctnacccgaaacatgaanggcactgggctctattgagatctcgatangatcatcattntnaactngtnttcnactgagggangtaaacatgatatctgggtgctggtggattgagacctcaagcatcaattcaaaagtgctggcaanaatatgcacttatntnnttntgcactctggctaagtgtangctctgatgccantttataagttggnacattctggggaaaaatggtncattttnaa

SEQ ID NO: 3844 - DNA, 860 bp, Homo sapiens
  misc_feature 1, 5, 8, 9, 12, 13, 15, 22, 35, 41, 50, 66, 74, 89, 95, 120,168, 174, 181, 209, 210, 261, 269, 272, 280, 288, 313, 325,413, 453, 530, 538, 606, 623, 627, 628, 645, 649, 654, 655,658, 659, 664, 665, 686, 690, 693, 694, 695, 696: n = A,T,C or G
  misc_feature 697, 707, 719, 722, 732, 739, 740, 748, 767, 777, 785, 786,806, 813, 828, 832, 833, 839, 841, 843, 850, 851, 859: n = A,T,C or G
ngctnctnntcnngntggcttncgtgctcctgcangagccnatcgattcnaattcgcacgaggccnacactcgnattccccggcccttngcagcnttggagctctagccggggccggagngggagcggcggggcccttggagagacggggggcgcaacccggacgacnctctgngaccggntacggggactgcgccgtgggcgcccggnnccaggacgagctaacagctttgcttcgcctgacggtgggcaccggtgggcnagaagccngancccgcggngaaccctnggggattgagccgtcgggtctgcangagccaccaggncctttcgttccggaggccgaccgggcccggatgcgggagccagaggccagggaggactacttcggaatcatgctcacatggtcccctntgcacggagccctctgccaagccagatccttttcttcatncttggaagtctgcagtggagagaaatcattctataactgaacagctcgtttgactgatgggaaaactgaagtcccanagacgatntctgggcctacctggttttctctagaaaagtattttcaagtctggttgcttgaaccacctgtgggacntggggatttttttgaancggnncaattccttacaacacntggnaaccnngannaaccnnttacccctttggcccctggtnggtnaannnnnttttttcttncccccaaacccnggnaaaaaccttnaagggcnnttcctggnaattggcccaaggggggancccaattaanctttttcnnaacttttttttttccccaanggttttnccccttttaaggggnaaanngggggntngnccttgannggttttana

SEQ ID NO: 3845 - DNA, 860 bp, Homo sapiens; identical to SEQ ID NO: 3844
  misc_feature 1, 5, 8, 9, 12, 13, 15, 22, 35, 41, 50, 66, 74, 89, 95, 120,168, 174, 181, 209, 210, 261, 269, 272, 280, 288, 313, 325,413, 453, 530, 538, 606, 623, 627, 628, 645, 649, 654, 655,658, 659, 664, 665, 686, 690, 693, 694, 695, 696: n = A,T,C or G
  misc_feature 697, 707, 719, 722, 732, 739, 740, 748, 767, 777, 785, 786,806, 813, 828, 832, 833, 839, 841, 843, 850, 851, 859: n = A,T,C or G

SEQ ID NO: 3846 - DNA, 764 bp, Homo sapiens
  misc_feature 5, 11, 13, 19, 27, 31, 41, 44, 50, 93, 97, 98, 291, 305,410, 551, 570, 613, 638, 662, 674, 693, 697, 748, 752, 762: n = A,T,C or G
agctnccacananagctgnattccgancttnctgcaggagnccntcgatncgaattcggcacgaggccgccactcgtatcccccggccctttncagnnttggagctctagccggggccggagtgggagcggcggggcccttggagagacggggggcgcaacccggacgacactctgtgaccggctacggggactgcgccgtgggcgcccggtaccaggacgagctaacagctttgcttcgcctgacggtgggcaccggtgggcgagaagccggagcccgcggagaaccctnggggattgagccgncgggtctgcaggagccaccaggtcctttcgttccggaggccgcccgggcccggatgcgggagccagaggccagggaggactacttcggaatcatgctcacatggncccctctgcacggagccctctgccaagccagatccttttctccatccttggaagtctgcaatggagagaaatcattctataactgaacagctcgtttgactgatgggaaactgaagtcccagagacgatttctgggcctancctgctttctctagaaagnattttcaaagtctgcttgttgagcaccttgtggactggcaatntttgaccggtcatcctacacactgnaacaagagatcataccttggctgnggtagccttttnttcccaacagaaactaaancatntgaatgcccgggaccatatctttgaattttttcaaggttccctaaggaagngggngcctggggtnaa

SEQ ID NO: 3847 - DNA, 764 bp, Homo sapiens; identical to SEQ ID NO: 3846
  misc_feature 5, 11, 13, 19, 27, 31, 41, 44, 50, 93, 97, 98, 291, 305,410, 551, 570, 613, 638, 662, 674, 693, 697, 748, 752, 762: n = A,T,C or G

SEQ ID NO: 3848 - DNA, 751 bp, Homo sapiens
  misc_feature 1, 2, 4, 6, 8, 12, 13, 32, 91, 93, 98, 579, 607, 630, 652,672, 681, 700, 709, 726: n = A,T,C or G
nntncntnactnntttggctacccgttctttntgcaggatcccatcgattcgcagatacagcctagtgtccctcagttacacaatagtgtntnccccnttggtaggacagtctactactgagtcctcctggcatgagtcgagctgagattaggatagggtaatgacccttcagttttggggaagggaccagagctcggccagtgagaagcttccagctccgtctggccatatccaggctgctgagggtcctgggctctgtccttaaacctcatcactgacatgacccagcaaacctcctcaagaggaaaaagtccccttgggtcaaacacagcttgtgcagttctcggggacctcctcctgccatcctggggatgctgtggagaatggagatgcacagggggctttgtcctctcctctgccttttggagaaaatatttcactcaaggcaaacgcagcctgagggcagcacaggggaccccaaggctcactgcgcatttctagtcgcccccaaacgcgtgggttttcctcctggtctcctcgtgggtgcctttgctcattctcatcctcctgttctcatncagtctgcccagtctgaccggcttccancagcatccggccaaaagtttctnccatgacagcaggaaccacctnagacaatacatgatggacangcctgctgngttccaatagaaccccganttaattaancccgaccttccttttanctggatactggtaatgacaggggtc

SEQ ID NO: 3849 - DNA, 792 bp, Homo sapiens
  misc_feature 2, 3, 4, 5, 6, 7, 8, 9, 11, 16, 22, 126, 151, 240, 244, 292,338, 364, 390, 453, 461, 490, 492, 515, 560, 587, 588, 601,607, 613, 615, 623, 650, 670, 675, 677, 685, 691, 730, 736,743, 759, 763, 770, 776, 781, 782: n = A,T,C or G
gnnnnnnnntntatanatacangctacttgttctttttgcaggatcccatcgattcgaattcggcacgagcctcatcagcaagccagtgagagggtgcctatccgaggatgatattccatcacctntgtcagattctgcttactagtcagnccccaggcccaggccactcgcaaggggaggacattacaggaggcgtgagtataggtggtgtgatctgtggggaccgtcgcagaggctgnccancacaaggggttaaaacctataaaacttcgaagttggatttaataattntcaattactaggaaatagataaaaacaaattttctgtccttcacanaacactaaagtatgtattggattttntatcccccctgaattttgctgtgtgngtgcttcccagttgaagcagtaattcaggttcattaatgtttacttcaaagccgaattggagncttgactnacacagttcaacgctcttttcagtaacantntcaaattcctttacggttatttnttgccacataacacactatcctaaaatgctggggcttaaagcagncaccactgtgtttgcttatcatgctgnngatcagcatttanggctgngctcgngntgggccgnttttcatgtgaattagcttcttgggcnttaacttcgtgtggggtctngcccntnggtcttgntgggcnaacttgggacaattcccagggggaccctttgggaatggnccttgngaaattnccggaaaccgtggggntttnccccaanccaaantttgnnaacccagggg

SEQ ID NO: 3850 - DNA, 728 bp, Homo sapiens
  misc_feature 2, 4, 6, 12, 13, 27, 29, 30, 31, 35, 47, 57, 67, 68, 82,90, 102, 109, 124, 127, 133, 136, 141, 147, 155, 157, 160,174, 177, 214, 221, 239, 242, 245, 248, 255, 259, 260, 263,264, 266, 267, 269, 270, 274, 277, 279, 282, 290, 311: n = A,T,C or G
  misc_feature 314, 316, 317, 320, 321, 322, 328, 333, 336, 341, 342, 349,353, 364, 393, 394, 413, 416, 417, 424, 449, 463, 487, 498,501, 506, 507, 508, 514, 531, 535, 542, 545, 553, 562, 567,573, 574, 582, 589, 599, 606, 607, 613, 628, 633, 644: n = A,T,C or G
  misc_feature 654, 663, 683, 693, 700, 707, 715, 719, 720: n = A,T,C or G
cncntnaactcnnaaactttccgcccncnnngcangacccatcgatncgaattcggnacgagcctgnntccaggagatatgngcgttttntcagcagtgatnaaaatcntgggcaggtgttatngcnctgttngcntgaancacacncacctacncngcnggaaacaagcaggntgntgcttacttgcctttcccaggcagaagtggccagagnccgggcngaaaggatccaccaacanccnccnatncatgatngcanntgnncnntnntggnaangncancaaaagcncacttgctggtgaaggtgcgngangnnggnnncaaacnctttnacncgcannagaaccnaatnctttaacgggnacaaatggggctgctcacgctctggaccnntccccggaagactctgaanagnnggctccntttcgggttgtgcactggtgcttgnagctgccaaacccnacaaaactgaaaatacagaatggnttcacgtatanagncacannncacaantgccggactacagcccntgancgaatgnaancacttgcncatattacntgacnctggannacaaactntgaaaantactctctgncctgggnngccatnaattctgccacctgnagatnccccattattncttaataacngaaaacagngcttgcctccgatagttaangcgggtgccnctaagcnttaacgnttcgcaanattnntcagatta

SEQ ID NO: 3851 - DNA, 752 bp, Homo sapiens
  misc_feature 3, 9, 11, 548, 556, 594, 633, 654, 660, 663, 672, 682, 693,696, 705, 708, 730, 752: n = A,T,C or G
gangtgctntntctttttgaggatcccatcgattcgaattcggcacgaggagcggggaggcgagcatgagcccccgagccggccctgtggcctcctggatgaggatgggagtgagcccctccctgggcccagaggggaggtccctggaggcagcgctcactatggggggccctcccctgagaagaaggcaaaaagttcctctgggggcagctcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgccccttcccagactgaggagtgcctcagggagaggccaagcacctgcccgcccagagaccagggcacccctgaagtcacccacccctgcaaaggacacatggaanggcaagcnggctcgatcccagcaggagaacccagagagccagcctnaagaagaggcacgccccttaaccaaacccttcgtcgtancttgaggtcaaaggcaacgtnttcggncanccgaaacanggcaccttgnattccaacggnttnaagaacccnttncacttttccggttcttggcgtnttccttgaaggaaggttcaaan

SEQ ID NO: 3852 - DNA, 720 bp, Homo sapiens
  misc_feature 2, 3, 682: n = A,T,C or G
gnntcttcgatcagctcttgttctttttgcaggatcccatcgattcgtgtattcagaagaaagcaaggatagaatgagtataactctttaaaatttggaggcaaaattggctgtgagttgccatggagataggagcaatggatgtccaaggtctgaggaaatagaaactgttcgaaataattgcagagaaagcttgccaacggtgataagtaggtttgtctagcagcactgatgcgtcgtggaagttgatggtcatgaacatacagtgtgataacctatctgccctcttgaccttttctagtagtgctatgtcattttggtactaaggtaggtgaattttccaagtgttcttggaaataaggaaacatcaagaataatgtaaaagcctcatatacaataatgaataataaagaataatgtgaaggcttcattcaaggttggggtttgccagatacattgcaacaaaatgacagagcagccaaggtatttaggatagtggccaaagtattgtaatgatggcttatggagtgtcagctggataaagagtgaaaatgaataaaaactaatggattgttcagtcgaatagcagatggtacaatggtacatggccagtagaataggggcccaataaattgaagaccatcagagtggagtgataatccacaagtggatgcagggatcnagccaagtcgatgacatgcatgttgctatgtggacaga

SEQ ID NO: 3853 - DNA, 748 bp, Homo sapiens
  misc_feature 2, 3, 4, 5, 8, 9, 568, 641, 737, 742: n = A,T,C or G
gnnnnttnnatcagctcttgttctttttgcaggatccctcgattcgaattcggcacgaggaaggaagaaaatttgggactttgttttaaaagtggaatactatcttcttaaacaacttgtgtttaaaacaagccccaatccacacttgatcttcttaagctaggaaaagtgagctcacactgagtgctggcaggatgctccatgtgcatcattattttgtttaattctcacaataactctctaaatcccttttgaggataaggagactggggctgggagaagttatttcaaggagtaaataaaaaattcagacccacttgggttttatgccaaaggctctgtttttacaaatacacaatattgttgcccagttgtgatgaaacataatttatgaatttcactgagggaatttcgcaaaaggaaagaatttacttttccctctaaagcagaggcttttcatatgcaactgttaaaagacacacgagcttgtgggtctgatgggtggtctgagctgttgctgttgggagagctgctgggacactagcaggaagacgtagtttgtgctcantggccaaggatggcgcccccgtaaggcaaccagatccggactacgcagtgttttccaggctggaggtgccctnctcaactgtcttacaaagttcccaaagcagccacccaaatctggctgctccttatgcccaaatggatttggcaggaaaaaaggccaattgggcaancagangcccaa

SEQ ID NO: 3854 - DNA, 780 bp, Homo sapiens
  misc_feature 2, 13, 28, 560, 626, 634, 703, 716, 720, 729, 748, 750, 757,761, 765, 776: n = A,T,C or G
gnttctaatgctnggctctcgttctttntgcaggatcccatcgattcgcttaggggaaggaaatgaaggtcagctttgggtatactagtgtaaggtgcccatgagacattcagataaaaaccagccaccaggcatatggagataacagggctgaacttaggagaaaagcctgggttgaaacagagattcggatatcctcagtatgaaggtgatagttgaaactggggactggatgaccgaaagagatcacccagaacaccagtacagagaggagagagctgaggatggaattttgggacataggtgcttctacagcacatggcaccaacctctaataatcacaccacttgctattacatttgatttttgaaagagtagcctgcgcagtaatgggaggaaactagattgtatatgttgatgagcaactagaaacaaagaagtgcagggccctagttgtagactaatgttttgaaacatttggctgtgggctgggcatggtggctcatgcctatagtcccagcacttggggaggccaaagtagaggatcacttgaggccaanagttcaagacccctgggcaacatagcaaagcccctgtgtctatttaaataaattaaattaaaatanaaatcagnaaaacccacaaggctcattattccttttccaaaaaaaaggaaaaaaaaaagttggcttgttgaaaaagnaaaggggaaaccnaatngggccaatnggctttggaagaatctttngnaaatggnttgnaaanactttttgttngggg

SEQ ID NO: 3855 - DNA, 754 bp, Homo sapiens
  misc_feature 2, 8, 28, 586, 605, 695, 702, 712, 714, 727, 732, 742, 746,754: n = A,T,C or G
gnttcaanagacagctacttgttctttntgcaggatcccatcgattcgaattcggcacgagattgtcttgtgttatggtgcttcagcattggattcagcagccagcttcctagtacgaaggcaacgattacctccacagggtcccttccattgtcctcctgcatcattttcctccaacttgaataaatgttctacccacctttctcctttattttctctaccccctgtaccccgctccctctcacaattaactctacagcagaatgtgaattctctgattttagaataactattttatggtaacttcaaatatatcctagttgtatccacattcagcttgggtaggtaccttcatagtagctcatggattaattgtccactgcacccaatcatagtcatttttggtttgggttgtcatatgctccccaatagatgaagaagagaataactcttagccgacttcatcagcaggtagggagagagtctctgatggagttatatttcattattcctcacaattgcatagtgccctcttacctcaaaaaaaacctttccaggtgttttcaaaggaattattttattcctncacaacaagcctgtgggantcggagcaaaaggcaaaagtgattacctgagacattagataactcgcaatatcaccctggttaacaactgaggggcccttgggctttgancttctgntttccgaatnanggctttttcctgncatcntggcataatncaanccatggcn

SEQ ID NO: 3856 - DNA, 753 bp, Homo sapiens
  misc_feature 2, 3, 5, 7, 14, 704, 726: n = A,T,C or G
gnntncnaatagcnaggctacttgttctttttgcaggatcccatcgattcgaattcggcacgaggagaaagtaaagtccctttataatggcatgtgaaccagacaatttagtagccagggttgtaaggcaactcttaactgacaatatagttagtatattctgggccttcatcttcaaaattagtaggtagtatttattgagtgcatatcatgtgccaggcctggtgctgagtgcttacaatgatcattttatatatgggaaaattgaggctcagcagggtcaagtgccttgtaagaggtagcactagtaagtaacagtgctcaaattcaactaggtctttcagctttttatacaatactgcctgttatcagaaagtatagtcttaaaatctgctatcaagcatctatcagaagcctgatgagaaatattcagatgatctaacgcagttcccaaacctgcattgtgggccgttttcattacaattacctaaggtgctttaaaaattttcttgggccctactcgttgtggttcagcagctgtgtaatggagcaaaaaggaatagtcactaaacagcgaaggaaagtggtggaattattgaaagacctagcacttacctgctgggatgagtctcttaccccacagaattgatttcaaacacaggacttattcaagataaggataataaccactatcttcttgggtnggaaaaaagtacattagactgngtttttaaaaaatttggtatgaatttc

SEQ ID NO: 3857 - DNA, 748 bp, Homo sapiens
  misc_feature 2, 3, 4, 5, 6, 7, 8, 10, 13, 518, 545, 639, 674, 723: n = A,T,C or G
gnnnnnnnanttntcaagctacttgttctttttgcaggatcccatcgattcgaattcggcacgagatgacttcctagctttacccggggttttttctgcaggtggagaagggtggagtcctcccagatggttctttctttgctcccctaacagcctttaagatgtggctacttgtttttcccaccgtttaacaccctccaacttcatttggagcacgggttcctcaagggatcctgagagctgggtgctgggtgctggtttggagaggcaggatgatgcttctcccggctggggagagcagagcaggaaggctggttggcgccatgaggaaagagccacgaggttttagctcccgaaccgactcgtcagtagcccctcctccatgttggttttacatttttccctcctggtctggactactttagcgcaaggagcccagccagacacggcagcaggccgcattgacccgtctccatcggaccccagcccctatctccaagagacagaggaggggtcangaggcactgctcatctgtacatactgnttcctatgacattactggatttaagaaaacaccatggagatgaaatgcctttgattttttttttctttttgtactttggaaccacaaaatgaancagaacttgaccctgagcttaaataacaaaactgngccaactactactggggatgcctaatatgaatccacgtgtaaccagttntaatcctttatttttaaaaaaaaaa

SEQ ID NO: 3858 - DNA, 835 bp, Homo sapiens
  misc_feature 2, 4, 8, 12, 16, 94, 98, 230, 242, 252, 253, 303, 327, 412,444, 460, 471, 475, 476, 483, 511, 533, 534, 549, 558, 559,562, 564, 578, 581, 589, 592, 612, 615, 622, 627, 649, 675,692, 704, 707, 729, 730, 733, 734, 735, 736, 737, 742: n = A,T,C or G
  misc_feature 751, 754, 758, 760, 763, 764, 765, 770, 774, 776, 777, 782,784, 793, 814, 815, 818, 819, 820, 826, 834: n = A,T,C or G
tntntctnctgnactntcgggaacttcctctttgtgcaggatcccatcgattcgaattcggcacgagggaagtacaaattaagatcacagtgantttncattatccacttgtcacaatggctaaaataaacaatagtggcaataccaagtcctgtgaaggatgtggagaaatggatcacttatacactgctggtgggcatgtaaaatggtacaaccagtctgaaaagcantttggcagtttnttataaaagnnaacatgtaattatatgctgaggtctgaatgtcctccaaaaattcatatgntgacacccaaaccctcaaggtganggttttaggagggtaggccctttgggagattagcttctgaggatggagccccatgaatgggattcatgcccctataaaaaagaanccccaggaaacgaccttgcccttcaccatgtnatcaagaatgtgcggnctatttacganagannccttgcncaaacactgaatctgacggtgccttganctcggggctttctgggcctctnntaaccatgaggaaanaaatctcanntgntntataaccaacctanccnaaggatanccnggtattaacaggccccacantgngctaaanatggncatattgaaccccaccagttanccacctctttgggccaattttatttnccaaggggaaaatggtnaaaattgggggnttnattacccaaaaaaacccttgtnnccnnnnnaaaangggttccantanccantnatnnnaaaancccntnnggttnanccccccaanaaacttttggggaaaacaaannttnnnaaaaanggtttttnt

SEQ ID NO: 3859 - DNA, 764 bp, Homo sapiens
  misc_feature 2, 8, 9, 10, 12, 42, 225, 396, 417, 546, 585, 599, 625, 641,660, 680, 702, 724, 733, 746, 763, 764: n = A,T,C or G
gnatgtgnnnancagctcttgaggatccatcgattcgaattnggcacgaggggcggctttggcctcacgcttcggggagactcgcctgtcctcatcgctgccgtcattccagggagccaggccgcggcggctggcctgaaggagggcgactacattgtgtcagtgaatgggcagccatgcaggtggtggagacacgcggaggtggtgacggagctgaaggctgcnggagaggcgggcgccagcctgcaggtggtgtcgctgctgcccagctctagactgcccagcttgggggaccgccggcccgtcctgctgggccccagggggcttctaaggagccagagggagcatggttgcaagaccccggcatccacgtgggccagtccccggcccctcctnaactggagccgaaaggcccancagggcaagactggaggctgcccccagccctgtgccccagtgaagccagctccgcctcatccttgaagcacccagggtggccgtgagggccaggatccctgcacgcctcaccctggctccaactggcancaagcaccgagcatgcccttcccacccaaaggaccttcnggcaatgccttgtnccgccttatgcttggaagcttgcctngggcaccttgccttgnccatttaaagactggtcanaacctgaaaaaaaaaaaaanaaaaacttcgagaaaaggcccnaacattggagaatcaagaattntatcttggnacttgcatttgancctctttcttaaaattnn

SEQ ID NO: 3860 - DNA, 772 bp, Homo sapiens
  misc_feature 12, 17, 19, 24, 39, 49, 50, 139, 144, 189, 202, 206, 218,219, 220, 232, 247, 248, 249, 252, 285, 304, 310, 325, 333,358, 364, 370, 371, 378, 400, 418, 420, 422, 423, 428, 434,449, 481, 483, 522, 528, 531, 536, 541, 558, 568, 574: n = A,T,C or G
  misc_feature 576, 577, 584, 590, 599, 600, 601, 603, 607, 616, 617, 623,626, 627, 631, 632, 636, 647, 652, 653, 676, 686, 696, 700,704, 711, 720, 723, 728, 732, 737, 738, 740, 749, 754, 755,759, 760, 772: n = A,T,C or G
gttattctttcnaaaangntgggntactcgttctttctncaggtagccnntcgattcgtttgtaggcaatggaaagccaccagtggttttagttgagcagcaatgaaattaagcctgtgctttgcaaagattaatctancagcnacagattggaagcaacaccaccattcctggtatcagtccacgtanaatatattacagntctntactggagcaannncagtaatattanaaggagaaataaaannnaanaatattgcacaggcagaatggggaggtcccacngatggagctgatcttggcnattgangcatgggtggcattnatcatgtnaaacacaggatgaggaactgggttnggagtnatggannagttcantttacgtaattgcaaatacacnctattccctgactagctncnannacttnatcttncctatcttcttagancttcattatgaagaggtgatgatagctcttangntgagagctcttacttaccattgactaatacatgttctcntgatgnaantttgntattncaacatccatgctaaanggggttattnaaacangnnaactctngggccngatgaaggnnnancctncattaactnntcatgntgnnactnnatcnaaggggccaanttgtnnccttaaatttttgtaaaaatttngccaatgccnaaaacatatnaatnttcncttgcanatgaaaaantcncgaancccnatttnntnaaacagaanggttnntggnnggacctttttan

SEQ ID NO: 3861 - DNA, 757 bp, Homo sapiens
  misc_feature 5, 282, 656, 689, 694, 707: n = A,T,C or G
gaagngctctgttctttttgcaggatccctcgattcgaattcggcacgaggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgncacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgccttgtgtgttgcaccaagacatgttgatcgaaatgaccttttcacctcattctatgataaagttgaaatttcngggaagaagttaaaggatttaagagcttgttgnaagangcatttcgtaccnagttatttaaacctctggtttgatggggattagaagattggatattttgt

SEQ ID NO: 3862 - DNA, 734 bp, Homo sapiens
  misc_feature 1, 6, 12, 14, 17, 21, 22, 49, 484, 533, 592, 666, 705: n = A,T,C or G
nctatnactgantnccnttcnngctgcaggatccctcgattcgaattcngcacgaggggacactggattctcattctactcaaactcccactaggactgttggcttgttcgcttctcaagtgtttgtatttttctgagttaatatttttgggtgtaatttacatgtaggaaaatgtacacatttttagtgtacagttcaccaagctttggcaagcatgtatagcctggtaacccacaagccaatggagacctagaacattcccgtgaccccagatgctgggttctgtgtgccttcccagggcttgtggctgggcacatcaggcatggcgggtaccatgcctgacagctctgaaccagttgggcgacctgggtctgggaggtgctgagggacccagcaccctgcaggcgtttccttttgtctcatgtagcagtgcagatgtttggaaagtcacacgtaaatcttgaaaaactggaaacaggccangcgtggtggctcatgtctgtaatcccagcactttgggaggccaaggtangaggactgcttgaggccaggagtttgagaccagcctttggcagcatagaaagaccttgnctctacagaaaattttaaaactagccaggtgtgggggggttgcatgcctgtagtcccagcaacttggaaggctnaagttggaaggattgcttgagcctaggaatccaaggctncaatgagcccatgatcaccaattgactgc

SEQ ID NO: 3863 - DNA, 795 bp, Homo sapiens
  misc_feature 13, 14, 21, 29, 38, 43, 46, 47, 562, 589, 654, 664, 669,681, 690, 695, 696, 716, 721, 722, 723, 725, 726, 727, 728,729, 730, 732, 756, 763, 764, 787, 791, 793: n = A,T,C or G
gtctatctcactnnagccctntgttagcnctggttctntttgnatnnaattcggcacgaggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaggccactgtaggaggatcaattgagcctagaagttcaagaccagcctgggcaaagtagggagaccccttctctacaaatagtaataaaatgaaccggggcatagtagcatgtgcctgcggtccccagctgctctgataagaagangctcactttgaccccaggaaggttgangctgcagtgagccataaccgtgcccggttaccacttccaagcccttgattgaccaggaaccgaanaccacttggncttcnaaaaaaaaattnaaaaaaaanttcannaattggcttggaaaaaaaanaaatnnntnnnnnnanaaaaaactttggggcccttttttnaaacctnnttgggggaggtccgattttaccntaanantc

SEQ ID NO: 3864 - DNA, 764 bp, Homo sapiens
  misc_feature 3, 60, 61, 63, 70, 73, 84, 93, 95, 110, 114, 123, 149, 151,158, 167, 180, 182, 184, 186, 188, 196, 197, 200, 201, 207,221, 224, 231, 234, 239, 247, 252, 258, 265, 276, 285, 287,301, 315, 317, 324, 346, 381, 382, 388, 407, 409, 410: n = A,T,C or G
  misc_feature 413, 414, 415, 426, 443, 444, 448, 451, 452, 470, 471, 489,493, 500, 501, 509, 529, 535, 537, 538, 546, 548, 551, 553,557, 562, 563, 571, 578, 586, 587, 607, 616, 636, 644, 664,665, 679, 680, 682, 691, 692, 704, 710, 714, 716, 732: n = A,T,C or G
  misc_feature 737, 745, 747, 748, 749, 760, 763, 764: n = A,T,C or G
aanccctttgaaaatcccctttttgcaggatcccatcgattcgaattcggcacgaggganntnaggccanganacaaagcagcntttgccagnangagacactcattggnaggnctaatgtcnccctgtgctgatacaagcatgaactntntggaatnttctgctantctgaaattacancnantngnctggggtnnggnngacgcntggcaatggttgtnttnacacacnganttacnctgaaccncaacntggacngcacatnacacacatcanactttcacngngcatctcgaactcngggttcacccgatncngaaaccntatgctaccaagaagtgcgtgncctctaggcacacctcactattgcccggcaaattnntgtganttcggagcttttgcagaancnngannnctgcatgaacnccaagctggactcatannaccnganntcatctgatccgcctgcnngagctcccaaagggctgngatnatatggnnaagccacnctgcttatccaaggtcaatntgaaantnngaccaacncnggntngatngcccnnaaaggctnaacgggnacatgccnntaatgccaaaaacggtaaanctctctcancccgggaacccggaactggnaaacttgngccgctttacccaataatgnntccgaataacgttnnancccaaaaanngggccccagccntagggngaancntggacaagcccacaanttggnaatggccntnnnaaaaaaaatgnttnn

SEQ ID NO: 3865 - DNA, 810 bp, Homo sapiens
  misc_feature 1, 6, 8, 25, 42, 102, 511, 520, 554, 570, 580, 597, 625,701, 729, 737, 747, 748, 750, 759, 774, 779, 789, 804: n = A,T,C or G
ngtctntnacttcgtggctcctttngaaaatccccttttgcnggatcccatcgattcgaattacaggcttgagccactgcaccaggccctaagagctctttnctttcttatcacacagtgaattaaaatattttggatcttaactatcccatattaagcgatcctttcctcaaatgaaagaaaatacttaattagaacatatatgtttaaactgatacagtaagttgtttgtaagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaattcgcggccgcggcgccaatgcattgggcccggtacccagcttttgntccctttantgagggttaattgcgcgcttggcgtaatcatggncatagctggttcctgngtgaaaatgntatcccggtcacaattncacacaaacattaccgagccggggagcnttaaaagtggtaaaagccctgggggtggccttaaaggaggtggagcttaacctcaccaattaaattggcggttggngccttcaaattggccccgcttttccaantccggggnaaaaccctgnncntggccaaanttggaatttaaaggnaaatngggcccaaangcccccggggggaanaaggct

SEQ ID NO: 3866 - DNA, 765 bp, Homo sapiens
  misc_feature 2, 4, 5, 125, 194, 199, 209, 241, 345, 357, 374, 378, 379,381, 385, 397, 404, 434, 472, 484, 500, 501, 503, 504, 510,513, 516, 524, 530, 534, 540, 563, 578, 585, 590, 599, 606,615, 624, 629, 634, 642, 654, 660, 663, 675, 676, 688: n = A,T,C or G
  misc_feature 705, 715, 717, 720, 721, 730, 740, 743, 747, 756: n = A,T,C or G
gntnnttctaatgcttgggtacttgttgttctttctgcaggatcccatcgattcgctgaaatgtcaaacacggccacctaggcagcatttacaagcaagagttcactgcttttttgatgtatatnttaagcgcccccagtgaatgaacagcatataactccacataaaaatcattaaatgtaattgacttccanagcangcagttctgntgtatgcctctggagaaggctggctgaattgnaattggtctgtaccttctgtctatcatgtacatgaggtttttgggcaaagagaactttccacaaaataagtccaaaaattatacgatcatcagacaaccaatancatattgatganatatctccaagatctanaatnntnctgngtgtcaaggaantctttgnggtttttacaaatattgataatgcactttntataaaatgcactttttataaaaatgcatgctcagttnagacaacttggnaacaccctgaaaaggnncnngcgtantgngtnacgcctgnaatccnagcnctctgngaggccgagacgggtggatcacnatgtcaggaaaatgngaccatnctggntaacatggngaaaacnccgtctctncttaaaatncgganaattngcaggatntggtgccggccncctatngtnccatttactcannaaggcttgagtnaggaaaatggtgtgaancccttgaaanangannttttcaatnaccggggatnccnaccnttgaatttnatctgggga

SEQ ID NO: 3867 - DNA, 757 bp, Homo sapiens
  misc_feature 2, 5, 7, 12, 20, 534, 572, 628, 655, 671, 688, 690, 706,736, 746: n = A,T,C or G
gnttntncatantgaaagcncttgttctttttgcaggatcccatcgattcgaattcggcacgagcagatggtttttaacgcctaccaggctggggtaggagcactcaaactctccatgaaggatgtcacagtggagaaggcagagagcctcgtggatcagatccaagagctctgtgacacccaggatgaagtttctcagactctggctggtggggtaacaaatggcttagattttgacagtgaagaactggagaaggaattggacatcctccttcaggataccaccaaagaacctttggatctgcctgacaacccccgcaataggcattttaccaacagcgtgcctaaccctaggatctcagatgctgaacttgaagctgaacttgagaaactgtccttatcagagggaggtttggtcccaagcagtaaatctccaaaaaggcaattggaaccgactctaaagccattgtaggaccctcaagtgaaggaccctcatgtaaaagagagaccaggcctgctgggtgtgtacatagntatttaaacaagaaactctcagaatgtgtttggaagangagaaaggagaaccactgattttatctggatgctactacttactacaggacagatngaatttcttggaaccgatgcttcaaangcttggttcccactgnatcatggacctgccttntnatctttataggggccnccaatttatacagtcctgtggctgacctgncatttcatancctgcagttct

SEQ ID NO: 3868 - DNA, 752 bp, Homo sapiens
  misc_feature 1, 10, 30, 32, 33, 34, 37, 448, 479, 665, 677, 694, 714: n = A,T,C or G
ntaatccaanaaccttgttgaagcctttgnannnccnatcggcaggacccatcgattcgaattcggcacgaggacccaggtagaccagctcaagagttcatgttctttgtcatcctcctgtgagctctctgtaagtctctttcttgcccatcaccacatccctagtactgggtatcagtctggccacttggctttctggtttgccccaatgtggtctattcttgatgcagctaccaaagtaatgttttaaaaccattataccaagttactatccttgtcaaaacccccagtaactgccaatctcacttagaataaaatccggactcctgtgaagcacagcataaactggccactgcctatgcagcaacctcatctttaccgtttcctgccttgctcactcccttccagcgccgttattcttcctgatgcccctagtacacaacaactncttcctgctccaagagtaggaaaattactgntctctctgccagtgagattcctcttctggtattacctttgcttcattgctgaatcttctccaatatcatcttctaaaaagagccttttaaaatcaccttttctattatgccctactcaatttccagtccctgaatgcccattccccacttcatagcacttattgctatctgaaattcactaaatgncaccttcatganggtaggcaatttaatgncttggcactggtatgtctanagacaagcactggctatagtaggcactcaacaaatatt

SEQ ID NO: 3869 - DNA, 763 bp, Homo sapiens
  misc_feature 1, 23, 27, 29, 680, 696, 703, 717, 755: n = A,T,C or G
nctctactcagattgcttggcgntctntntgcaggatcccatcgattcgaattcggcacgagccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggctctcacctgctgattgccctgagcagcacggaggtcctctacgtgaacccacttgagaaggctgcctcctaggctctgctcagtcatcttgcaattgccacactgtgaccacgttgacgggagtagagtagcgctgttggccaggaggtgtcaggtgtgagtgtattctgccagcttttcatgctgttcttcagagctgcagttatgccagaccatcagcctgcctcccagtagaggcccttcacctggagaaagtcagaaatctgacccaattcaccccctgcctctagcacctcttctgtcctgtcattcccacacacgttcctgttcacctcgagagagagagagagagagcacctttctttcgtctgntcacttttgcgggctntggaatnccagctcttctctntcagaagaagccttctcttcctctgccttgtaggtgtnccaaaagt

SEQ ID NO: 3870 - DNA, 933 bp, Homo sapiens
  misc_feature 1, 6, 23, 25, 35, 43, 268, 269, 380, 415, 423, 432, 460,477, 488, 493, 528, 541, 556, 564, 573, 574, 576, 580, 581,582, 583, 589, 600, 619, 625, 633, 642, 648, 658, 672, 686,694, 707, 710, 723, 734, 738, 751, 754, 755, 759, 781: n = A,T,C or G
  misc_feature 784, 801, 802, 815, 838, 857, 876, 880, 883, 899, 902, 903,908, 917, 928, 931, 932, 933: n = A,T,C or G
ntatcnttatacgtctctaaaancnttggctactngttctttntgcaggatcccatcgattcgaattcggcacgaggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcagnnttggcttgctgggccctcagagcccagtgggtggctctgactcggctccctactccctgcacccagctgggcgcaccttggggcctgcggtctgaatgtatccctcccctnagttttaacctgagctgccgaacgcacagtgggcncgggggcnaagctgtgnggaaaccggggcccaattacggatcccnggaagttacaggtgccnacgtgatgtcnctttntcttggtgcccaacttaccttacttggtcttgaanacttagcttcttnggggggtaggcccgngggccccnccaaaaaanncntggnnnncccggntttccaacccnttggccccggtggccttgntttganttattgangcccctggntttggnccaaataaanccccccttgggttntgggggggaaaggnaatttttngggccccaacccnccntttggaaaaaaancccccgggaangggnaaaaaaccggggnccnntttnttgccccttgggggtttttttnccngggaaaaaaaacccccnnttttaattggggntttttggggtccccgtttccaanaaaacaccctttggttttnaaaaggggggggaattggngccnttnaaacccgggcccaaanccnntaagnaatttcccnaacccgctttnaannn

SEQ ID NO: 3871 - DNA, 773 bp, Homo sapiens; identical to SEQ ID NO: 498
  misc_feature 1, 4, 8, 11, 12, 23, 32, 152, 258, 351, 482, 524, 574, 605,742: n = A,T,C or G

SEQ ID NO: 3872 - DNA, 773 bp, Homo sapiens; identical to SEQ ID NO: 498
  misc_feature 1, 4, 8, 11, 12, 23, 32, 152, 258, 351, 482, 524, 574, 605,742: n = A,T,C or G

SEQ ID NO: 3873 - DNA, 773 bp, Homo sapiens; identical to SEQ ID NO: 498
  misc_feature 1, 4, 8, 11, 12, 23, 32, 152, 258, 351, 482, 524, 574, 605,742: n = A,T,C or G

SEQ ID NO: 3874 - DNA, 751 bp, Homo sapiens
  misc_feature 1, 5, 6, 7, 8, 13, 16, 18, 28, 288, 637, 676, 705, 717, 743,751: n = A,T,C or G
ngttnnnnttgtnctntntctctgaaancgtttggctacttgttctttttgcaggatcccatcgattcgaattcggcacgaggtaggttgaaagcctggtcagctattctgcaagacagtcaaaaattgtttacagggctggacagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttnaccagaaagctaaattaaccagataagtctttctgaaagttttagtgtcttagtttgttcctgcgctgtaacagaataccttagactgggtaacctataaataataggaatttatttctcacagttttggaggctggcaaatgcaagatccaggtgctggtacgttcagtgtctggcaagggcggctttctggtccaagatggtgcctttttttctgcatcttccatagggaatgaacactccttatggtagaagggatggaaggaccaggcttttttttttttttggatacagcaggatcttgctctgtcgcccagcctggaatgcaatggctgattaaggtcactgnagcctcaatctcccacttttcagcgatcatccaccttancctcttggatagctgggaccgcagcacanctacatgcctgnttaattattttgtaaaaccgggtttnctgtgccn

SEQ ID NO: 3875 - DNA, 752 bp, Homo sapiens; identical to SEQ ID NO: 3868
  misc_feature 1, 10, 30, 32, 33, 34, 37, 448, 479, 665, 677, 694, 714: n = A,T,C or G

SEQ ID NO: 3876 - DNA, 768 bp, Homo sapiens
  misc_feature 2, 3, 7, 8, 9, 10, 18, 20, 23, 24, 31, 41, 43, 597, 639,737, 749: n = A,T,C or G
tnngttnnnnttgttatncnctnngaaaccnttggctactngntctttctgcaggatcccatcgattcgaattcggcacgagacctgagctagggttgcagcagaaaattgagttgcagcttgcccttgtccagacctattttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcantggaaactggttaagccagttgttcatcttcgtttccaaatntaaaggatagctggttaggatattttggtcatatttgtaaatttttgaaatgcttagtaatgtgttttcaccacaagtatttgttgcaaacttaatgncatttccttaanaagggtacagctatgtaat

SEQ ID NO: 3877 - DNA, 823 bp, Homo sapiens
  misc_feature 4, 13, 15, 27, 35, 73, 86, 87, 91, 98, 111, 150, 152, 206,231, 258, 278, 279, 284, 287, 292, 320, 321, 325, 333, 339,382, 385, 387, 403, 419, 420, 424, 443, 459, 470, 479, 486,494, 497, 514, 551, 562, 568, 591, 595, 596, 606, 609: n = A,T,C or G
  misc_feature 622, 631, 640, 643, 658, 688, 695, 723, 724, 733, 747, 751,758, 762, 763, 768, 770, 779, 786, 792, 794, 804, 807, 819: n = A,T,C or G
cacngaatcgatntnacctttgttcangccttttngaaggaccccatcgatacgagcccatgcgattcgaatncggcacgaggacnnaggnagaccanctcaaggagttcntgttctgtgtcatcctcctgtgagctctctgtaagtctntntcttgcccatcaccacatccctagtactgggtatcagtctggccacttggcttnctggattgccccaatgtggtctatncttgatgcagctgccaaagtaatgttntaaaaccattataccaagtnnctatnctngtcanaacccccagtaactgccaatctcacttnnaatnaaatccgnactccngtgaagcacagcataaactggccactggctatgcagcaacctnatntntaccgtttactgcctngctcactccctttcanngccnttgattcttcctgatgccnctagtcacaacaactnctttgctgctncaagagtangaaaatnactgatcnctntgacatgagatcgcatntttatggtattacctttgcgtcattgctgaatcttcnccaatatcatnttctanaatagagccttttaaaatacccntacnntattatgccnttnctcaattttcaantccctgaantgccccatntcnccacttttcagtagncactttaattgcttatcctggaaaatttancacctanaattggtcacccattgaaagaatagggnnatggcaaanttattgggcctttngtcnaactgtnctgnncttanangaaccaagncaacttnggcttnanaagtaaggcnccntcaaccaaaatnttct

SEQ ID NO: 3878 - DNA, 823 bp, Homo sapiens; identical to SEQ ID NO: 3877
  misc_feature 4, 13, 15, 27, 35, 73, 86, 87, 91, 98, 111, 150, 152, 206,231, 258, 278, 279, 284, 287, 292, 320, 321, 325, 333, 339,382, 385, 387, 403, 419, 420, 424, 443, 459, 470, 479, 486,494, 497, 514, 551, 562, 568, 591, 595, 596, 606, 609: n = A,T,C or G
  misc_feature 622, 631, 640, 643, 658, 688, 695, 723, 724, 733, 747, 751,758, 762, 763, 768, 770, 779, 786, 792, 794, 804, 807, 819: n = A,T,C or G

SEQ ID NO: 3879 - DNA, 823 bp, Homo sapiens; identical to SEQ ID NO: 3877
  misc_feature 4, 13, 15, 27, 35, 73, 86, 87, 91, 98, 111, 150, 152, 206,231, 258, 278, 279, 284, 287, 292, 320, 321, 325, 333, 339,382, 385, 387, 403, 419, 420, 424, 443, 459, 470, 479, 486,494, 497, 514, 551, 562, 568, 591, 595, 596, 606, 609: n = A,T,C or G
  misc_feature 622, 631, 640, 643, 658, 688, 695, 723, 724, 733, 747, 751,758, 762, 763, 768, 770, 779, 786, 792, 794, 804, 807, 819: n = A,T,C or G

SEQ ID NO: 3880 - DNA, 760 bp, Homo sapiens
  misc_feature 1, 7, 8, 9, 10, 15, 27, 31, 699, 701, 719, 721: n = A,T,C or G
ncgttgnnnnttctntgattccttgtntgangctctttctgcaggatcccatcgattcgaattcggcacgagggcagctagagtcaggaaaatgaccctcatatgcttttaatctttgtttcagttgtctgtcagggttgaattaagaagctactggtttattcccaattgttgatgcctttaggtatgttggaatctttttttttgcctaggaggggccagttgaaaatctgtgactcaagaggcagtgaacagaatactgttttctggggaaaaattggttggctacttgatgttaattatggcacagtaacaggaaaaggttgtgtctgtgtttttaagtttttctttattctgcttttttgctgctataagagttttctgaaatttatattttaaacttttcatgcactttactgtttctagtctcaaaatgtgatatttttaataaacaagaaattttccattatgtgaatgaaattttaaaagacaatagcctatatttgtgtctcactaatatataaagtataggtcaaatttaaattatttaattagttttaaatatcacaatttgtctcctctttcaaacctgacatcttcgggctgttttattagtctaaatgatgcatttacttttgtcattttatgctaattctttcatagtaaataatcaggctatataaggtaatatttccccananggtaattttaatgggacnanggttggtgggatgatgtcatatcatacatggggattgcc

SEQ ID NO: 3881 - DNA, 764 bp, Homo sapiens
  misc_feature 2, 3, 4, 8, 10, 22, 27, 508, 514, 582, 593, 616, 700, 703,736, 746, 763: n = A,T,C or G
tnnnctantnttatacctttantactngctctttttgcaggatcccatcgattcgaattcggcacgaggtgatctgcctgccttggtctcccaaagtgctgggaatacaggcatgagccaccgcactcggccaggagctagttttatcagcatcctgctccactgccttcctctagtgcagcctggaagacatggcagcgggtagctcctggggctgagccagaagcatcactgcagtgaaagtctctgcttacctgtctggctcagcttgggcaagggctgggccatatgtgctcagggacgtgcttctcttgtaaggcaggaggatagaagaggaccaagaagggagggagctgccctgtggtgcacacaggcctgccatggggcgtgggagcccatcccgctgcctgaccggagctggctgctgtggtggactcaggaaccacttttaatactgcaactgctcccttttgcccagtcagggaaagctgactgtaagtcccacctncccctncgtccacccttctagtggtttctctgagaggtttctctgcttcagctgtgcttgaagtggcatgcctnctctgctgcanggctcccccaacccccacacggncttaaagatgttaatttccttatagactggattaaagtcagccattctttttcctcaaaaaaaaaaaaaaaaaacttgagcctntanaactatatgagtcgtattacgtagatccagacntgataagatncattgtgagtttggacnt

SEQ ID NO: 3882 - DNA, 787 bp, Homo sapiens
  misc_feature 5, 6, 7, 8, 9, 10, 11, 12, 13, 16, 17, 18, 20, 27, 28, 46,47, 129, 578, 648, 683, 748, 751, 752, 754, 760, 761, 768,771, 772, 773, 774, 775, 776, 778, 781, 783, 785, 786: n = A,T,C or G
tgggnnnnnnnnnttnnntntactaannttatgcctcgttagtacnngctctttttgcaggatcccatcgattcgaattcggcacgagattggggactgacatcttaagctctcacctggctgcagtangaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgngctgctacattatactggaaattaacaggggaaaagggaagagcttcttggctcccttgaggtctgctantgggtgttagggagtggttacaactgaacttttantaaccatttaaccgtatgtaaacttggtttctaattaaaaaaaattcctttttccaaaaaaaaanaanntnaccccnntttttantcnnnnnnanctnanannt

SEQ ID NO: 3883 - DNA, 752 bp, Homo sapiens; identical to SEQ ID NO: 3868
  misc_feature 1, 10, 30, 32, 33, 34, 37, 448, 479, 665, 677, 694, 714: n = A,T,C or G

SEQ ID NO: 3884 - DNA, 811 bp, Homo sapiens
  misc_feature 2, 3, 4, 9, 11, 12, 13, 25, 41, 44, 69, 88, 99, 102, 171,210, 239, 268, 292, 307, 332, 339, 348, 391, 403, 439, 440,448, 451, 454, 455, 475, 481, 487, 496, 508, 514, 548, 565,567, 575, 593, 599, 648, 671, 672, 706, 712, 713, 717: n = A,T,C or G
  misc_feature 736, 738, 748, 753, 757, 763, 765, 771, 772, 797, 801: n = A,T,C or G
tnnnaatcncnnnaagcctttgttnaacccctttgctactngcnctttttgcaggatcccatcgcttcnaattcggcacgaggttatnccagtatctgncancagaatggcattgtgcccatcgtggagcctgagatcctccctgatggggaccatgacttgaagcgctgncagtatgtgaccgataaaggtgctggctgctgtctacanggctctgagtgaccaccacatctacctgnaaggcaccttgctgaagcccaacatggtnaccccaggccatgcttgcactcanaagttttctcatgangagattgccatggcgaccgtcacancgctgcnccgcacagngccccccgctgtcactgggatcaccttcctgtctggaggccanactgacgaggangcttacatcaacctaaatgccattaacaagtgcccnntgctgaanccntgnnccctgaccttcttctactgncgagcnctgcangcctctgcnctgaacgcctgnggcggnaataaggagaacctgaagctgctcacgaagaatntgtcaagcgaaccctgncnaacagccntgcctggcaaggaaagtncacttncgagccggttaggctagggcttgctgcaaccgaagtcccctctttggtnttctaaccatcgccttttttaanncggaagggtgtttccccaaggattgccccccaanaacttnnaagncctttggccccaatttccnantttttgaaanaaggnaggnccgccntnctttanngggcttccaaaccttgggcttagancccnggcttttttt

SEQ ID NO: 3885 - DNA, 757 bp, Homo sapiens; identical to SEQ ID NO: 494
  misc_feature 1, 4, 8, 9, 17, 22, 26, 29, 35, 41, 47, 526, 621, 664, 669,707, 719, 747: n = A,T,C or G

SEQ ID NO: 3886 - DNA, 788 bp, Homo sapiens
  misc_feature 2, 3, 7, 23, 27, 28, 31, 46, 47, 54, 87, 94, 120, 163, 341,422, 446, 452, 495, 496, 501, 503, 534, 538, 592, 596, 610,628, 633, 634, 642, 661, 663, 678, 679, 696, 697, 718, 723,729, 732, 748, 749, 751, 766, 778, 787: n = A,T,C or G
gnnacantgaacggaaagtcccnatcnntgnaggatcccatcgatnngaattcngcacgagccccactcggggtatgtgaatgcccnttttgantaaggaagtgcccatcttcacaaagnagcgcattgacttcaccccttccgagcgcattaccagtcttgncgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggctctcacctgctgattgccctgagcagcacggangtcctctacgggaacccacttgagaaggctgcctcctaggctctgctcagtcatcttgcaattgccacactgtgaccacgntgacgggagtagagtagcgctgtnggccangaggtgtcaagtgtgagtgaattctgccagcttctcatgctgnnttcananctgcagttatgccagaccatcagcctgcctncagnagaggcccttcacctggagaagtcagaaatctgacccaatttccaccccctggnctcnagcacctcttctgnccctggcattcccccacncacgnncctggttnaccctcgagaagagaagananaagagaagcaccctnnctttccgactggtaaanntctggcgggccttttggaaancccanctcctnttntctcagaaggaagccnntnttcttccctcctggnctgaaaggtgtnccaaaaaanc

SEQ ID NO: 3887 - DNA, 788 bp, Homo sapiens; identical to SEQ ID NO: 3886
  misc_feature 2, 3, 7, 23, 27, 28, 31, 46, 47, 54, 87, 94, 120, 163, 341,422, 446, 452, 495, 496, 501, 503, 534, 538, 592, 596, 610,628, 633, 634, 642, 661, 663, 678, 679, 696, 697, 718, 723,729, 732, 748, 749, 751, 766, 778, 787: n = A,T,C or G

SEQ ID NO: 3888 - DNA, 804 bp, Homo sapiens
  misc_feature 2, 9, 10, 12, 14, 22, 119, 138, 241, 256, 258, 272, 280,366, 368, 370, 409, 425, 444, 458, 462, 466, 482, 486, 489,508, 514, 518, 519, 552, 554, 565, 591, 600, 602, 604, 607,612, 621, 658, 659, 669, 674, 683, 684, 688, 692, 698: n = A,T,C or G
  misc_feature 707, 715, 718, 721, 726, 727, 735, 737, 738, 741, 742, 745,748, 749, 752, 755, 757, 758, 762, 773, 778, 780, 785, 790,791, 793, 794, 798, 800: n = A,T,C or G
gngacctanngntngaaacgcnctctctgcaggatcccatcgattcgaattcggcacgaggtttcatttaagaagaatgagctagataaatgtgctcttctggttaccccaccctgacngagtgcatttttacacggntagcaggggttgagactgcagcctggcctgccagccattggaggtgtttaaggaagggcagataatgtgactctttgcggggtgccatctgcttacccattancgagcagagggggtntntgcgggtgaccccnagcatatntctaggttacttatgggcagatttgtaagtgacaatactccagctgatgctgggaatggggagagggcccttgagggactttgtgntncngtgcttctggtttcctggccaacccccagggtcaacttngtcttggatgcccaancttgggcactaatgtctgncacctgactatgtnaaantgtntaaatgattcctctantttnggnatgagatcttccaatccanaggaancccnnctttggacttgccttgggttaaatcttgcatancntaaagtggttngatgaagttcatctgaagaaatttanggcccaacntncnaanccttnccccattcntgcttcccttttgaaacttggcttctggggaaactcnngccagaagtncttgnggacaccanncctntttngggggntctcaaggncgttcccnttnggnctgtnncccaaagncnnaanngantcnngtngcntnnattnggaaggaattnctggntncctangttgnntnnattncnaaac

SEQ ID NO: 3889 - DNA, 774 bp, Homo sapiens
  misc_feature 2, 12, 30, 87, 108, 173, 417, 448, 608, 695, 711, 766: n = A,T,C or G
cngtctaaaccnttggctacttgctctttntgcaggatcccatcgattcgaattcggcacgaggcaggagaatcacttgaaccctgnaggtggcggttgcagtgagcncagatcatgccactgcactccagcctgggcaacaaaacgagacttcgtctcaaaaaaaaaaaacntagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgtcaggaccacattttacaaaatgccttgtttccttcattgnttctggaaaaggaaagttctattaatattgntttactttgaatatagaatagtttttttaattagggcttattttgaaaaatctgagtttaattcaaatgtttgccaataccttccaaagtaaggtaatattcagagacagttgttgtgaacaagatggcttaaaagaaattcttggaatattcacattcnaaagattccttattaatgaatgtctttgccttaaaatctaaccaaaaaactgcacatttatcctttgggcatttttcattatatagnggtaacaagctttagntgccaaccaaattaaaatccttaagctttttaaaaaaaaaaaaaaaaaaactcgngccctttt

SEQ ID NO: 3890 - DNA, 779 bp, Homo sapiens
  misc_feature 4, 5, 6, 11, 14, 16, 31, 606, 623, 729, 765: n = A,T,C or G
cttnnnttgtnctntntctttcaaatcgctnggctacttgttctttttgcaggatcccatcgattcgggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctcttgagctacctcgactttggacagagtaatgactccccagaaaacgtcatataagaantttaccaacccctgaangaccaagaaggagccattcctttgaccttcatttaacttgggctcactttttctttaaaactttgggtagaaaatgcagagccccagaattgcttttccttcccgncttttgacatgaaggccttaagtaaaagaacttccngaacattaaaaaaa

SEQ ID NO: 3891 - DNA, 767 bp, Homo sapiens
  misc_feature 2, 29, 541, 583, 596, 691, 698, 707, 720, 727, 739, 752, 754: n = A,T,C or G
tnctttgatgccattgctcttgttctttntgcaggatcccatcgattcggcttgcctttacacacggaatcgctgtgcatccgacagaggctgattggcacatggggcacggggattgtcagctcaaacaccgtcagcagcgttgcccttggaaatgggatttcccagaacagtaaacgtgtctgtccttgatttacagagtagctacattcctaggaaatccagggtacattaaaactcaccatgttacccaggctggtctcaaactccaggcctcaagcaatcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggccggatcacctgaggtcangagttcgagaccagcctaccaacatggtgaaaccccgtcttntactaaaattatnaaaaattagcccggtgtagtgggtccacgcctgtagtcccagttactttgggaagcttaagcattaagaattgctttgaacccaggaagttggangttggangtgaacccnaaatgtgccctgnacttcancctggaacagantgagacacttgtncncaaaaaaaaaaat

SEQ ID NO: 3892 - DNA, 770 bp, Homo sapiens
  misc_feature 3, 5, 11, 12, 14, 17, 22, 23, 43, 104, 499, 635, 637, 654,664, 689: n = A,T,C or G
ttngncgactnnanctntacannaatcctttggttacttgccngcaggatcccatcgattcgaattcggcacgaggcagggagttgcttgggtggccgctaacnccaggctactcttattttagcttgctaagttgagatcagctagacctgctttcttttctcctcagtcttgcatttccctcaatacaagctgtagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttanatgtcacggaaaaagctagttctgtggtcaggcggcaccaatgagaaaggaatgcagacccttcagatgtatccttgggaaaagcagtaaaccaactaatatttattgaaggacctactttgtccttacatagggnancttctgtcagggaatcntgggttcttnccaagaaacactgattttctttcanggagacttcatggggtcatttatttccccacagcagaatttaagaaattattatatggaatattggatatctataaagagc

SEQ ID NO: 3893 - DNA, 765 bp, Homo sapiens
  misc_feature 3, 5, 10, 27, 29, 35, 614, 732, 765: n = A,T,C or G
gcngnctacngaaacccttggctactngntctttntgcaggatcccatcgattcgaattcggcacgagggaaccatgagaaccgaagctagaattgctattgaattactttattttctcttcccttattgggtagagatacatcattactggcctcaggggtttacccaaagaaagggtatttttgagcaaataatgtgatttcctggctattttgttgggggcttaagatttttttttttcaaatgcatttttagtcactaaaaattaactgtcgtaccatctagaactatactgtccagtaccatagcctctagccgtatgtagctatttgtattaagattaattgaaattttaaatccagttcctcagtcacactagccactttctaagtgctcagtagctctgtgtgaccagcggctactgtattggatattatagaaggttctttcattcaagatcatcattcttgacagacccataaatatttcctataaagactgtagaagtgtgttctggaagggtttgctctccaaaaagaattgtaatatagagtagaattgggatagagtattgaagacactgggtttagacattggatattttaatgattgngtgttctaattcatgtgctgccactgagttatctagtgatatgacctcactgcttgaccaaaagcccggaatagaaggcaggattcctggaatctatcttaaaaatttgcaatggaanaaccttttccctaaattatcccattatggtaan

SEQ ID NO: 3894 - DNA, 815 bp, Homo sapiens
  misc_feature 2, 3, 4, 5, 6, 7, 8, 12, 28, 275, 323, 417, 421, 494, 551,564, 602, 664, 669, 684, 695, 697, 710, 720, 727, 734, 736,743, 749, 758, 775, 784, 787, 811: n = A,T,C or G
gnnnnnnntttnaaacccttggctactngttctttttgcaggatcccatcgattcgaattcggcacgaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgnctcctatcagtccgtatgcttcagaaagctgtggaacgctacctcttnctttgagaccttgtggagaagggtctgaaatggtaggcaaagagaatagttccccagagaataaaaactggttgttggccatggcagccaaacngaangctgagaatccatctccacgaagtccgtcatcccagacacccaattccaggagacagagcggaaagacattgncaagcccggcaccatcacgcccagcttcatgaggaaaatctgcacatacttccatanaaagtcccaggangactttctgtggtcctgaacactcaaccagaattatangattctaatctgagttgagttactgagcttttggtcccacttaaaacaaagcttgaagcttntggtnccacttaaaaaccanggaatgaaaananttcccaagaagtnggacttcttnttaactncttgggncntttttangaaaangcttgcccntttttcaaattttttangccaaaaantcnttttttcaaacccctttgaaaatngccc

SEQ ID NO: 3895 - DNA, 716 bp, Homo sapiens
  misc_feature 4, 26, 77, 88, 292, 357, 366, 390, 481, 489, 524, 599, 610,687, 688, 704, 710: n = A,T,C or G
gaanccctttggctactcgctctttntgcaggatcccatcgattcgcaaagatcagaagtcctggcaagaatcacanatggaaaaacnacaattctagacagagagcagtcactggatcaggcagtcacttgtgtgatttgaagctagaaggtccaccggaggcaaatgcagatcctcttggtgttttgataaacagtgattctgagtctgataaggaggagaaaccacaacattctgtgatacccaaggaagtgacaccagccctatgctcactaatgagtagctatggcngtctttcagggtcagagagtgagccagaagaaactcccatcaagactgaagcagacgttttggcngaaaaccangttcttgatagcagtgctcctaanagtccaagtcaagatgttaaagcaactgttagaaatttttcagaagccaagagtgagaaccgaaagaaaagctttgaaaaacaaaccctangaggaaanaagatttcacaactatcaaacgttattcgaaccangaacacaccatccatatctcttggaaatgcttctagcttccggacattcgacatgaaaagaaatgtgatttgcantgtggccggtncctcatcaaaaaagactttttggctggatctattctgcgaaagtaagatgttagctctggggttacttctactgaanntgtgaacattctcctntttgtngaggaa

SEQ ID NO: 3896 - DNA, 785 bp, Homo sapiens
  misc_feature 3, 4, 5, 6, 7, 8, 9, 10, 11, 12, 16, 17, 21, 23, 24, 25,33, 35, 37, 39, 40, 41, 64, 119, 599, 631, 654, 659, 709,729, 772, 774: n = A,T,C or G
ggnnnnnnnnnnttgnngttnannncttttttncntncnnntttgaaaccctttggctacttgntctttttgcaggatcccatcgattcggccgccggggcgcaatgcgagcggctggngtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctganaaggtactgctgcatgcatttgatggtccggncatctgtagccatggaaggagtnagaanctgggtacttcttctcaatttccccttctatcataagaaatggacagcangaaacttgtgaaacaattgnctttacttctatatgcttagaaacagatcacctgactaggacnanaaaacaggtcc

SEQ ID NO: 3897 - DNA, 790 bp, Homo sapiens
  misc_feature 3, 4, 5, 6, 7, 10, 12, 20, 21, 23, 110, 563, 605, 630, 634,658, 669, 724, 727, 789: n = A,T,C or G
gtnnnnncantnattccccnnanaaaacctttggctacttgctctttttgcaggatcccatcgattcgaattcggcacgaggtttcacatttgctgccatgagcaaagangaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttctcaggactcagttaggtgtgcccagacgcactgacaaaatgacatgacttcagggaagcctggacacccgangcacctggaccaactatgggtaagttcttgtgggtggaacancattctgtgtaagaacccacttganggcnttttgcaaaccggaattgacaggnaaccccagaanattaaggcaccacaaaagtgcccccttgcatgaaaacaccttgtgaaccatttcnaantcttgaaatgccgggggggggaagtttcaattttttaagggaaagaaccaaaagcccctttnt

SEQ ID NO: 3898 - DNA, 770 bp, Homo sapiens
  misc_feature 2, 3, 6, 10, 11, 12, 13, 37, 107, 594, 625, 661, 670, 696,703, 754, 770: n = A,T,C or G
gnntgntttnnnntctttgatcccttctttcaaatcntttggctacttgttctttttgcaggatcccatcgattcgaattcggcacgaggggtgttggagcagattntagttgatccacagcaaagagcatcaccaaagccattccaggaggaactagatccaccacttcctctgctgggcatgctccaaaaatggttgtggcttccagagaggactccaaaagaaagcacaaaaactagacagtgggagggcatacccaaaagccctgagtttctgaaaaaatattgaaagtttctatggtgaaataggaagttaatgtgcttaggaagaaaaaagtggtaatgattcaaggaaacataatcacacacggttttagttttaatggacatgggaggagccataaaagtagtctatctatcatcagttacatatctaatgaactgtctatctgggataccctatcctgttttaatctgagtgactctctctcagctgagagagctggacagactccattttagcctcttcacttgcagtccccttatcccccttccttaagggaataactagtgcaagctgactccaagcacatncaggaatgcacttactgataaagatattgangcaagttgtaccagcagctcctggggacgtgctcantggatggtnccaagcccctgcatttatctctttgngatagtntaaacccctgcacctggaactgtgatttttctgtactatctctgtaccctnaattttttttactttn

SEQ ID NO: 3899 - DNA, 784 bp, Homo sapiens
  misc_feature 2, 9, 30, 91, 192, 437, 563, 650, 694, 719, 783: n = A,T,C or G
tncttgaanccctttgctacttgttctttntgcaggatcccatcgattcgcgtctgtaatcccagctgcttgggaggctgaggcaggagantcacttgaaccctggaggtggcggttgcagtgagcacagatcatgccactgcactccagcctgggcaacaaaacgagacttcgtctcaaaaaaaaaaaccntagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgnttctggaaaggaaagttctattaatattgttttactttgaatatagaatagtttttttaattagggcttattttgaaaaattctgagtttaattcaaatgtatgccaataccttccaaagtaaggnaatattcagagacagttgttgtgatcagaatggcttagagaaatttctggaatattcacattcgaagattccctattaatgaaatgnctttgaccttaaaatttacccaaaaacttgcaaccattaattcntttggaccatttttcattatatagnggttaaacaagctttagttgccaaaccaaattaaaattccttaaagctaaaaaaaaaaaaaaant

SEQ ID NO: 3900 - DNA, 779 bp, Homo sapiens
  misc_feature 3, 9, 10, 20, 21, 32, 34, 35, 621, 622, 623, 624, 625, 626,627, 669, 679, 696, 700, 740, 741, 744, 765: n = A,T,C or G
cgnttaaannccttcactcnntcgtttgaagncnnttggcgattcgaattcggcacgagataacacacatcacagtatgctctcagaaatttctttatttgaaccctataccaatatctgttgatcaatgaccatttttgctcagcatggagaaacagtgccctgcatgaagggtagtgagaataaaaaggatcttaccacctttatcatgagggtggctttgctctctccattccaagttgttctctgttctagaaagcagatgtagtagacatctactgtttttgcctaaacagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagagaaagaactttaattttttctcttggactgcaataaagtatagctgcctaaaatacgtttcctgacacttggaggtttgtccacaatcggtgaaataaaggcaagacgtaacaactggatgaaaaaaaaaannnnnnnaaaaaaaaaaactcgagccttttaaaactattagtgagtcgnattaccgtanatcccggacatggatangatncattgatgaagtttggaccaaacccccaacttggaatgcnntgnaaaaaaatgctttaatttggngaaatttggggatg

SEQ ID NO: 3901 - DNA, 754 bp, Homo sapiens
  misc_feature 4, 12, 35, 37, 100, 318, 490, 497, 651, 731, 743, 749: n = A,T,C or G
ttancctataancgtctatgaagcctttgctattngncaatggatgcaggaaaactgagatgggatttccccacgttgcccaggctggtctcctgagctnaaagcaatccagattgctgggattacagctgtgagccaccgtgcctggctgagatgacttttaaaaaaagacttctctaaagtagaaggaagggtggaattgtatgcacaagaagaaaaaaacctggaagaaaaacatactaaagaggctggagtgcaatggcgcgatcttggctaccgcaacctccgcctcccgggttcaagtgattctcctgcctnagcctcccaggtagctgggattacaagcatgggccaccacgcctggctaatttgtatttttagtagagacggagtttctccatgttggtcaggctggtctcgaactaccgacctcaggtgatccacccacctcggcctccacagtgctgggattacaagcatgaaccaccgngcccggnctcctgttccagttttctataatctggtcatattatattctgggtatatgtgggtggtgtgattatccatgtggtcttattttcacattctttgcattaactataatgacttaatgttttaagataagtttcatttcttcaaaagatgtatgtncaatacctgggtatcaggtaacaatcttaaaaaaacttattcatttaaaaattaacctttaaaattagccattccaattnaacattaagganggttgngagga

SEQ ID NO: 3902 - DNA, 755 bp, Homo sapiens
  misc_feature 1, 6, 9, 14, 18, 736, 753: n = A,T,C or G
nttaanttntgatngtcnataaggcctttatcgattcgccaatggatgcaggaaaactgagatgggatttccccacgttgcccaggctggtctcctgagctcaaagcaatccagattgctgggattacagctgtgagccaccgtgcctggctgagatgacttttaaaaaaagacttctctaaagtagaaggaagggtggaattgtatgcacaagaagaaaaaaacctggaagaaaaacatactaaagaggctggagtgcaatggcgcgatcttggctcaccgcaacctccgcctcccgggttcaagtgattctcctgcctcagcctcccaggtagctgggattacaagcatgggccaccacgcctggctaattttgtatttttagtagagacggagtttctccatgttggtcaggctggtctcgaactaccgacctcaggtgatccacccacctcggcctcccacagtgctgggattacaagcatgagccaccgcgcccggcctcctgttccagttttctataatctgttcatattatattctgggtatatgtgggtggtgtgattatccatgtggtcttattttcacattctttgcattaactataatgacttaatgtttaagataagtttcattctacaaagatgtatgtacaatacctggtatcaggtaacaatcttaaaaaaaactaattcatttaaaaataaacattaaaattagccaatccaattaaccntaaagacagtttgtganga

SEQ ID NO: 3903 - DNA, 755 bp, Homo sapiens; identical to SEQ ID NO: 3902
  misc_feature 1, 6, 9, 14, 18, 736, 753: n = A,T,C or G

SEQ ID NO: 3904 - DNA, 744 bp, Homo sapiens; identical to SEQ ID NO: 496
  misc_feature 5, 25, 28, 620, 621, 622, 623, 624, 625, 626, 643, 709, 733,740, 744: n = A,T,C or G

SEQ ID NO: 3905 - DNA, 744 bp, Homo sapiens; identical to SEQ ID NO: 496
  misc_feature 5, 25, 28, 620, 621, 622, 623, 624, 625, 626, 643, 709, 733,740, 744: n = A,T,C or G

SEQ ID NO: 3906 - DNA, 718 bp, Homo sapiens
  misc_feature 1, 4, 5, 6, 7, 8, 13, 14, 17, 20, 23, 606, 616, 647, 663: n = A,T,C or G
nttnnnnnataannttnatnagncttgcacttgctctttttgcaggatcccatcgattcgaattcggcacgagaaagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggcccttggggatggggctgctggggactgccccccttcccgccgtggccaggcgctctgtgtgctgtgtgtgccccaggctctgttgaccccgtccaggaactaacttacccagcttggtctctcctgagtcctccaccctggcctgggattggccagggagcagggcgggcattgggaccagtgtggagcctgagggtgcctgccctgctctggagggagggccaggagctgccacacccccaagtcctctcagggcccaccctcctttttcagcctctgcataaggcccctgggtacactgcagaagccccatccttcccgcttcgggcataaggcccctgaccacacttcagaagccccatcccccctgcaccgggcgatccctgctgtnagccgaactntctgcccgctgccatgtgtcgtgtttggtgnagacctgatgtctgtntgtgtccaaacgggctcaagagcctcacaatctgggtagctgacccagtacgtgt

SEQ ID NO: 3907 - DNA, 779 bp, Homo sapiens; identical to SEQ ID NO: 3900
  misc_feature 3, 9, 10, 20, 21, 32, 34, 35, 621, 622, 623, 624, 625, 626,627, 669, 679, 696, 700, 740, 741, 744, 765: n = A,T,C or G

SEQ ID NO: 3908 - DNA, 754 bp, Homo sapiens
  misc_feature 2, 3, 4, 5, 6, 9, 10, 13, 23, 26, 36, 544, 618, 646: n = A,T,C or G
tnnnnnttnnatnttgcccttgnctntgaaggcttnctcgattcgaattcggcacgagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctgggtatcttcccccttttttccttttaaactcttgagcctcctataacgaaggattatgtgtttcaaaccttttttttttactgtttcattaagtgtgcttgtgcccaaaatatttacttgtataatatctgtacttgcttaaatacttcagcaaagtcagcatatttactcattcaacaaatatttgagccaggcattattttagacacagcagtgaacaaaacaaaaaggcattcttgccttcatggagcttacattcttattggtatttaaatctaaatgttataaaacaagaatttatattctagggttgatcagctagtatttaatcaaaaangccacactcccatagcagctctctaagctgtagtagctaataaaaaatattaatggtggccgggcacagtgctnacgcctattaatcccagcactttgggangccaaggtggtagatcacttgaggtcaaaagtgtgacccagcctggccaacctggtgaaccctatctctttaaaaaatccaaaaaatccaaaaaaattacttgggctg

SEQ ID NO: 3909 - DNA, 779 bp, Homo sapiens; identical to SEQ ID NO: 3900
  misc_feature 3, 9, 10, 20, 21, 32, 34, 35, 621, 622, 623, 624, 625, 626,627, 669, 679, 696, 700, 740, 741, 744, 765: n = A,T,C or G

SEQ ID NO: 3910 - DNA, 748 bp, Homo sapiens
  misc_feature 2, 13, 14, 17, 21, 27, 59, 62, 63, 78, 621, 622, 623, 624,625, 626, 629, 646, 715, 724, 738: n = A,T,C or G
gnttgaatccctnncanatcncttggntgcaggatcctatcgattcgaattcggcacgngannacacacatcacagtntgctctcagaaatttctttatttgaaccctataccaatatctgttgatcaatgaccatttttgctcagcatggagaaacagtgccctgcatgaagggtagtgagaataaaaaggatcttaccacctttatcatgagggtggctttgctctctccattccaagttgttctctgttctagaaagcagatgtagtagacatctactgtttttgcctaaacagaatccctttttcctttttttgttaaaagtactcatccctaatattacattgttctggaaggactgaaaataacagaactcagcaccatgatcggaccgggacaatcagattatttcattcctcagcaaacggagatcgatccgaaaagtggaaatatgagctcttctttggtgttggcatatggaccctgagagaaagaactttaattttttctcttggactgcaataaagtatagctgcctaaaatacgtttcctgacacttggaggtttgtccacaatcggtgaaataaaggcaagacgtaaccctggatgaaaaaaaaaannnnnnaanaaaaaaactcgagcctntaaactatagtgagtcgattcgtagatccagacatgatagatccttgatgagtttggacaaccacactngatgcatgnaaaaatcttattgngaattgggag

SEQ ID NO: 3911 - DNA, 748 bp, Homo sapiens; identical to SEQ ID NO: 3910
  misc_feature 2, 13, 14, 17, 21, 27, 59, 62, 63, 78, 621, 622, 623, 624,625, 626, 629, 646, 715, 724, 738: n = A,T,C or G

SEQ ID NO: 3912 - DNA, 748 bp, Homo sapiens; identical to SEQ ID NO: 3910
  misc_feature 2, 13, 14, 17, 21, 27, 59, 62, 63, 78, 621, 622, 623, 624,625, 626, 629, 646, 715, 724, 738: n = A,T,C or G

SEQ ID NO: 3913 - DNA, 756 bp, Homo sapiens; identical to SEQ ID NO: 495
  misc_feature 3, 4, 5, 6, 7, 8, 16, 38, 474, 689, 690, 706, 713, 733: n = A,T,C or G

SEQ ID NO: 3914 - DNA, 788 bp, Homo sapiens
  misc_feature 2, 3, 6, 7, 10, 25, 34, 43, 44, 315, 511, 661, 681, 707,710, 720, 754, 784, 788: n = A,T,C or G
gnnttnnaanttaacagctctcgtnctttttgcngatcccatnnattcgaattcggcacgagtgatgccttagtcacttggccacacagttttgtggtttacgagtcatgggaattgcttgtcttactctgactgctaaagttctgtcctattgtcttttcatgtaatagcaacatgactctgatgacaaagcccaactaattacacaacttaatttaatagtttaaagcgcaaagggcattccctgagcagtaaaatcttttgtttggaaattttaaaacaaattatattttactttatgttttatatttaccntaataagtatttacaagaacacaattttctcaagatttaaactgctcattgttccataaataggacacacatttagaaagaggatttttttttaaaggaatattttagtgattacttctggctaaaaacatgaaactcttttagtgcttgatgttactggaaacttgctctagattattttttgaatctttgctgngagggtaaaaatagaaatgttttcctcccaattattgctttgaattaaaattttgtgtctgggtgaaatttcctctggcttaatgcatgaccaggctggtagaaaatgtttcacctaaatcctcttatttttggtaaaacattcataatnccaaaccctaatagtttggnaaggcatgtgataattggtaatcccnctnctgtcctcantttataaattcccctgacaacagccctgcttaanaatatcacctacttctggttggatttcttnccgn

SEQ ID NO: 3915 - DNA, 744 bp, Homo sapiens; identical to SEQ ID NO: 496
  misc_feature 5, 25, 28, 620, 621, 622, 623, 624, 625, 626, 643, 709, 733,740, 744: n = A,T,C or G

SEQ ID NO: 3916 - DNA, 768 bp, Homo sapiens
  misc_feature 7, 10, 23, 35, 85, 87, 321, 322, 323, 325, 327, 333, 334,337, 339, 347, 367, 369, 374, 376, 379, 385, 390, 392, 394,405, 433, 450, 462, 496, 502, 504, 512, 545, 570, 583, 585,604, 611, 642, 644, 676, 683, 705, 727, 728, 731, 734: n = A,T,C or G
  misc_feature 737, 754, 762, 768: n = A,T,C or G
cactganctnctatccttcttcnttgcaggatccnatcgattcgaattcggcacgagatcctgtcggtattccttggtatctgantnaaataccaaatagtaccatacatgagttatttctaagtttgaaaagtaaaaagaaattgcatcacactaattacaaaatacaagttctggaaaaaatatttttcttcattttaaaacttttttaactaataatggctttgaaagaagaggcttaatttgggggtggtaactaaaatcaaaagaaatgattgacttgagggtctctgtttggtaagaatacatcattagcttaannntncngacaanngcntntgtaatgntgtaactgctgttaatattnantgctntngtntgagcnacctnantntgaacagatgngtcagcctgcatgctggacatgcctcanaaccatgaatagcccgnactagatcttgngaacatggatcttagagtcactttggaataagtncttatntnaatacccncagccttttgagaacggggcttgttaaaggacncgtatgtagggcccgtacctactgncagttgggttcangnaaatgggattgactttggncttaagntccttggtcataattttttaaaatatgggantnggaaaacccccaaagaatggaatggactcttnaaaacantgaaaagacccttatcggttgncccttggaatgtagaatttggnnttnggnttncttaattctgcttggtnaaaggggncagttn

SEQ ID NO: 3917 - DNA, 760 bp, Homo sapiens
  misc_feature 3, 9, 694, 718, 737, 747, 759: n = A,T,C or G
tcnctcctnaaatcgttggcgctctcttgcaggatccctcgattcgaattcggcacgagctctcaaatagaaatgggagataagaaatatatctgtgcaatattaaattgaaaaaaaaaacccataaaaagtgtcaaaggcaaataatttgctctagatcacaaaactagttagcacaaggctaggattataaccagggtctaggaaaaaatcctgaaggtgatttaactgagtgttaggccctgtcaagccacctgctaaggctcatggtctttcagactagcttcaacattccaaatcaggcaatagctacaacggaaagataattggacggggaatcctgagatcagagtcctagtttggctttgtctcttgtagcaggattttttaaatcaggggcagctctcttctcccatcccagccatgaatctttcaaccttagtggtcaccaacttgactccattccttatatcaagccttgtcctgtcaattctcccttaaatgttagttgcatccatttctaaatatatccatggccatcaccctagtaaaaagactattacctcacaccccgcacttgatcttcccccaactttaagtgactcagttccttatatcactgccacaagaattaacacccatgtccatcttttcattttctgctgaaagattttcagtggttcccacttgaatnccaaataaagttcgaatcccttanaatggcattcacagccttntacttctggncccacttttatnt

SEQ ID NO: 3918 - DNA, 771 bp, Homo sapiens
  misc_feature 1, 9, 11, 13, 16, 21, 28, 689, 728, 740, 744, 750, 753, 766: n = A,T,C or G
ntttataantntnatnccttnctcttgntctttttgcaggatccctcgattcgaattcggcacgaggaacaagcacagcccaagccagatgtacagcacacacagcatcccatggtggccaaagacaggcagcttcctaccttaatggcacagcccccgcaaactgtagtacaggtgcttgcagtgaaaaccacgcagcagctccctaaactgcagcaggctccgaaccaaccaaaaatctacgtgcaaccccaaaccccccagagccaaatgtcgctcccagcttcttcagagaaacagacggcaagccaggtggagcagccaattataacccaaggatcctctgttacaaagataacttttgaggggcgccagcctcccacagttacaaagataactggtggcagttctgtgcctaagctgacatcaccagttacaagcatatctcccattcaggcctctgagaagacagcagtgtctgacattttgaaaatgtctttgatggaagctcagattgatacaaatgtagaacatatgatagtggatcccccaaagaaggctcttgccactagcatgctcactggtgaagcaggatcattacccttccacccacatggtggtgcagggatggcgaattccacttcccagcaacagaaatgtagagagtcctgttcgagttcattcaccgntggctcttccttaacgacaaggaaaatttgatccaccancagtgccttgcnacanggccanttnatgcgtatttcanaatgt

SEQ ID NO: 3919 - DNA, 751 bp, Homo sapiens
  misc_feature 3, 4, 17, 18, 32, 34, 318, 535, 595, 679, 741: n = A,T,C or G
atnngaaggaaacaatnntccttcgtgctctncntgcaggatcccatcgattcgggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttctgtgtgagtaatgcattctaaacatcctaccccactttagaaacggacgtggggaacgcttggtcatttaagccaacaataaatttaggtgaatgtccctaagtgtttactgnttttatccagtcaaggatttgcttttccttgaacatttgttttaaattctggggccaaaatgcaaaggagaagttctattcaaaggcagtagttgaaatctattattttagttagcctacttggcatttactacatcggtcacttctccaggctgccctaaattaggttgatggagtgagacatgccaaacatccacctttgggaccatagcatagntaaaattaaatgtagttggaatagctagcattgcagctacagtagggaactgtagtctanttccctaccgaaaacccaaggagtaagggacaggattttgcctaggcaaaaatctaagactcgtgcccttctggtacatggggnttaagactgaatgtgtaataggagactgctttgccaatcaaatgatgacaggtactgaaatngcaatccatt

SEQ ID NO: 3920 - DNA, 793 bp, Homo sapiens
  misc_feature 1, 3, 4, 5, 6, 7, 20, 21, 22, 31, 652, 675, 682, 715, 716,754, 780: n = A,T,C or G
ntnnnnngtctaataattcnnnttctttgcnctctccatgcaggatcccatcgattcgaattcggcacgaggagaggttcacagccaccaagaaagaagtttgcgtgaagttctccaggactatggaaaccttacaggatactgacttagaacctctgttggaatgtggctgagtcaaagcctcctgttgttgttaggggtatctacagtaaggagatgatacttcaggagattatatttcactcaatgatcttttctcatttcagggctcttctcaaataagctaaaagaaaaaggatcaggagacaggaaaagtcttccgttttgagtcatgagtagggcaatagacaaggttctcttcaaaaccatcattagtttggctttaagaaaccagtagctagctgctatttatatggtgagggggtgctgcctggtaacagaatagctccacaccacagcttgagattttgtttagtttcactgtgtgagctttcataaagtctgttgccattccatctctgtgttaacacttcatatttttatgaaattcagataatttgtgagaggctggcatggatctaaggatttattatttttattctagtccatcaagttcaatcgcagttttatactaggaccttttaggatggtncataaaatgtgtggactgtttgnccttganttaaaagtgccacttttggccctggggcatggnnggcttcatgcctattaatcccagcacttttgggaaggnccaaggccggttggcttcactttgangctaaggaaattc

SEQ ID NO: 3921 - DNA, 763 bp, Homo sapiens
  misc_feature 1, 5, 7, 10, 15, 24, 29, 33, 666, 681, 714, 718, 751: n = A,T,C or G
nctcnantanctatngcttggttnctcgntctntctgcaggatcccatcgattcgttcgagtgcaagctccccatctttcgaaagtttccatggcaatacagctaactgaagaactaaaagccagtgatgtacttgccaggtttctcagccaagaaagtggggttgcccagactctcaagaaaggagaagtttttttgtatgaaattggaggaaatattggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcagttgtacccaagtatttaaaaatgactctcttaagccttaaaaagtcatagatttgtgctgctgccagaattatattaattattattaatgttattattagaaaaaaaatttctggagtgagagtaaagaggcttaattagtttgtgggcagttttcatatgctctgtgaaatgtgtccagatgtgacatagtttttttttaatatgtggaaagtcttctcttcccattcttttctcctaaaatcatatatactgnaatatatgctctctnactctattaccttcttacatctaccctttccanttangtttgctttttgcccaaaagataccaattccangtttggaagttg

SEQ ID NO: 3922 - DNA, 774 bp, Homo sapiens
  misc_feature 1, 3, 4, 5, 6, 7, 13, 17, 18, 22, 34, 40, 92, 93, 97, 133,140, 255, 338, 344, 345, 354, 391, 437, 510, 527, 532, 567,668, 714, 728, 744, 750, 773: n = A,T,C or G
ntnnnnngtttgnctannaagnctttgctcttgntctttntgcaggatcccatcgattcgaattcggcacgagagagactagtctcgagttnntttnttttttttttcacaaataaaccaactttaatagatnttatttngtatttatatagtgccttcttcaagaaccttaaatgctttacagacattatctctaattaatccccacaacaaccctgtgaggtaggtattactcccattttacaagacaggganactgaagcacagagaggttaagtgacttgcccaaggtcacacagttaaattcactgaagagccaggacatgagcgctttagcntcccanntcccagccnaatacctcatgatagaatctttaataaaaagtgtttntaaagaaagtatcacgagtagttatgttatgaaaatgaggtctttntactgccatcaaggaaagaaaaaaccctatactgatggttagaggccccaagacccacataatacaacatttncctctttccctgttccnaagcntcctggttcctgtcttaaataatcttttaaaggtnaaatttccaagacagaagccatgtgacttaagaagtgggacttaattttagaatatttactttagttacataaatttataggaaatttttattcccatttncaaaatatgggacagccattccaacatcatgtcatagttacacggnaatcaagtccccanttacaacttacaccanccccgnattttaatcacagtcaaccaacnt

SEQ ID NO: 3923 - DNA, 754 bp, Homo sapiens; identical to SEQ ID NO: 3901
  misc_feature 4, 12, 35, 37, 100, 318, 490, 497, 651, 731, 743, 749: n = A,T,C or G

SEQ ID NO: 3924 - DNA, 785 bp, Homo sapiens
  misc_feature 2, 5, 10, 14, 15, 22, 25, 28, 31, 34, 35, 37, 42, 335, 431,555, 633, 637, 639, 647, 687, 693, 710, 720, 723, 751, 782,785: n = A,T,C or G
cnacnaattnacanntcacttnctnctngcnctnntngcatncgattcgaattcggcacgaggtgaatgctgtgcctgtggccccacctgtgtgtgatgtcgccagaacccagccgactccttcagagaaagctgcaggagtcctggagggggcccttgggccacatgttgtcactaacctttatctctatccaatcaaatcctgtgctgcatttgaggtgaccaggtggcctgtaggaaaccaagggctgctatatgaccggagctggatggttgtgaatcacaatggtgtttgcctgagtcagaagcaggaaccccggctctgcctgatccancccttcatcgacttgcggcaaaggatcatggtcatcaaagccaaagggatggagcctatagaggtgcctcttgaggaaaatagtgaacggactcanattcgccaaagcacggtctgtgctgacagagtaagtacttatgattgtggagaaaaaatttcaagctggttgtcaacattttttgcccgtccttgtcatttgatcaaacaaagttcaaactctnaaaggaatgcaaagaagaaacatgggaaagatcaactttccttggtacaatgggccacccttttctctgtgaatgaangccncngtatctgnttgatcaacacattccagtatttttggaacttcaccgggnaacttnaaacacccattgatganaatgggaaanganggaattatttttacttgaaaggatcttnaccttgcgttttcgtgcccaatatttattancan

SEQ ID NO: 3925 - DNA, 812 bp, Homo sapiens
  misc_feature 6, 7, 9, 31, 34, 82, 582, 665, 671, 677, 679, 697, 699, 719,720, 721, 722, 723, 724, 725, 737, 742, 747, 752, 762, 774,785, 786, 787, 791, 800: n = A,T,C or G
cttatnnantactccgtctctaaagcctttntcngattcgaattcggcacgagggaaacagctgactgccactgaaagaatnagcagttttaggggactagctcctatgggagataaaggtcagaaatcgtagtatctgatgaagatattttgatgagcaggtgagaagaaagataaacatggccagatggccaaggactgggataagtagccgtttcacattcaattagaattctgtggctggaataagatcagggagagcagtaggaagatatagtattctataattcatagcttgttgtgttagagattaattaggattctgctgttgaatcttagtacaaaaaaatctaatatttattaggaattaagggaagatggtacttctgttatgttgcctaagcagacaggaagctacaagaacaccagtctgaagcagtgcctcaggatctcagatgatttaggaagtgtgctgtaatgtcaaaaaaaaaaaagtattgtctttagtatatctatgtatagtctcgtgggaaaagcattggttgtggtatcaacagatattctgggttccagatgtcttgnaagttaacctgcctcccatttccctttctgtaaagccaaaataattggttttaccaccctaaatctggcctctcaagggattnccattntttaantnaaaaaattatggtcctantnaaagtgccaaaaaaaaaaannnnnnnaaaaaaaccttnggagnccctntttanaacctttttngtggaggtccgnatttacccttnnnaatncccggaacnttggattaaggt

SEQ ID NO: 3926 - DNA, 768 bp, Homo sapiens; identical to SEQ ID NO: 3916
  misc_feature 7, 10, 23, 35, 85, 87, 321, 322, 323, 325, 327, 333, 334,337, 339, 347, 367, 369, 374, 376, 379, 385, 390, 392, 394,405, 433, 450, 462, 496, 502, 504, 512, 545, 570, 583, 585,604, 611, 642, 644, 676, 683, 705, 727, 728, 731, 734: n = A,T,C or G
  misc_feature 737, 754, 762, 768: n = A,T,C or G

SEQ ID NO: 3927 - DNA, 781 bp, Homo sapiens
  misc_feature 2, 3, 4, 6, 11, 645, 659, 660, 666, 688, 701, 704, 750, 761,765: n = A,T,C or G
tnnngnttaancccttctcttgccttttgcggatccctcgattcgaattcggcacgagccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtaggatattagacaaatatatttcgattgaattccacaactaaanaaaaaaaaaacttnnagcctnttagaacttttagggaggtcgnattacggtagatncanaccatggataaggatacattggatgaattttggacaaaccccaacnttggaatgccntggnaaaaaaatgctttttt

SEQ ID NO: 3928 - DNA, 787 bp, Homo sapiens
  misc_feature 3, 7, 8, 11, 13, 88, 386, 397, 524, 624, 637, 650, 686, 693,698, 716, 735, 763, 771: n = A,T,C or G
gtntaannccnangccttgccatcttgcaggatcccatcgattcgaattcggcacgagagaacgttctcaggttgaccagctgctgtntatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccaggtttggcatagaaatggtaccccttgttcaaaatgaacaagaagccttagatttggatggggaacctgatctgtccagtctanaaggattccantgggaaggtgtttccatttcctcgtcccctggcttggcaagaaagcgaagcctttctgagagcagcgtgatcatggacagagctccttctgtgtatagcttcttcagtgaggaaggtacaggcaaanaaaatgagccccagcagatggttcacctagtaactcattgagggcttggacagagccagaaagcaacccattgcacctttaaaacaagaagtgacacctnggggcttgccctnccttcccgaacangtggaaaaggggcttgaaaatggtgcttccccaaanggcgacntagtncaccaattatcctctgancatattaatacctttgatngcattttggccaaaaagacttgaccagncaaggaanagggctattccccccc

SEQ ID NO: 3929 - DNA, 750 bp, Homo sapiens
  misc_feature 1, 7, 10, 550, 558, 650, 658, 671, 679, 682, 694, 711, 746,750: n = A,T,C or G
ngttaantanatccttgcactggcggatccctcgattcgaattcggcacgagatttaaagtattagccaacctcttcaggtattagcctgaagataaattttaacaaaacatatacacttgggtatccgtcattgctcaaactctatagtgtattgctggagccaataggcagggtatattttattagctaaatttgatatttgtcttctgccttctgtatcacctccaagctataggaaatcaggattttgttggctttaagaaaacacatggtatgttcactgtatattaaatatacctgtatttaatgttttctcttaggacagaaaagtagacacacacacacacacacacacacatgttgtgttcagctttctgttttatattatttgccattgagattagaatagaacaggctctattcatgcaaactatatgaaatgaaaaacttttaagactcttcattaattggagcttctgggcaacatcgtgtgtgtgtgtgtgtgtgtgtgtgtgtgtgtgtatacagacattttttttttaacttgntgattcanatgtcttggtccctgaatagtcctagattacttattttgagaattcattggtaaaattacagggaattaaaataattgccttttttttaganggtaaganatgggtagaagantatgcctntgnaaatttattagntattcttgtggagaatnccagaaaatgggtatttgcccatgctaaatatganatan

SEQ ID NO: 3930 - DNA, 954 bp, Homo sapiens
  misc_feature 2, 3, 4, 5, 6, 7, 8, 13, 18, 19, 27, 29, 31, 44, 51, 123,245, 297, 307, 326, 327, 329, 338, 348, 365, 384, 385, 427,454, 457, 464, 475, 492, 501, 502, 512, 524, 541, 548, 550,571, 580, 589, 590, 591, 596, 643, 647, 658, 685, 700: n = A,T,C or G
  misc_feature 702, 705, 706, 708, 711, 713, 714, 716, 721, 728, 735, 740,742, 749, 751, 755, 756, 758, 768, 778, 779, 812, 813, 814,816, 817, 821, 823, 825, 848, 853, 865, 881, 893, 899, 910,912, 915, 928, 929, 930, 933, 934: n = A,T,C or G
tnnnnnnnccggnttctnnctcacgantntngcatgcatttganagcattnatcgattcgaattcggcacgagctgcgctatcagcgcaaagaacctcccgttagtgccactgaccccacctncccccagccccacagctgggtctggctgggcactgaccaggaggaactgagccgccagctggaccggcagtcccctggcccgcccaagggggaggggagctgcccctgtgagagtgggggangaggggaggcccctaccctggcccctggccctcctgggggcaccaccagctnctcaagcacnctggcccgaaaggaggctnntngggcggctnaagcgagtanagtttgtgacatttgcnccagccccttcagcccagnnacctgaggagcctgtaggggccccttgctgtgcagtaccatncttgtggcaggcgacgaggacatccgntgngtgtgtnaaggacatggngcttgaaggaccctgangaagcttcnnaaactacatngagaggatcccngggcaactttcttgacnctgcaananacaaccttggtcaagcccacncaacttggngcaaacgannnggtgngaagggtttcccaacttggagccctttttccgtccttgcccctcggnccantttcgtttttnggtagccttggtttggaattcccaagntcccccttggccttngngtnncntcncnnancaaanggggacntttaccnatttncnaagggcncncccnntntttgggcccnttggcccccnntttgggcccattggggaaaccaaatggggttcnnntnnaaangngnaaaaggggcctttcaattggccnccccntttaaaaatttnaaatggggggaaaacnccctttttatcntatttntcttaaacccngnaanatttaaaaacccnnnatnnaaaggggaaaaaaaaccccg

SEQ ID NO: 3931 - DNA, 789 bp, Homo sapiens
  misc_feature 2, 3, 6, 11, 12, 15, 23, 27, 28, 30, 32, 36, 383, 615, 728,733, 762, 774: n = A,T,C or G
tnncgnctaannttnatgccttngttnntncntccnttttgcaggatcccatcgattcgttagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggattacaaatttacaggaggatgaaacanaagaaatggaaggcccacagtcacctggtcagctcttaaaccctgccctagcccattctatctctgtggcttcgtgtggtaatatttttagttgtggtgcagaagatggtaaggttcgaatctttcgggtgatgggagttaagtgtgaacaggaactgggatttaagggccacacttcaagggtatcccaggtctgctttctcccagaatcctatttgctgctttactgganggaatgatggggaagatcaccgtttgtggggatgccaaacagtggaagtttgaagaaaaaaccagaagaagtccccacaaaaccgtacccacagggaagaaaccctaaagganggacnttgcaccaaagcagggtgggaaaatcctnacgccttaagtnacccgatggagggaa

SEQ ID NO: 3932 - DNA, 767 bp, Homo sapiens
  misc_feature 3, 6, 7, 8, 12, 13, 14, 16, 18, 607, 632, 690, 729, 745,746, 747, 748, 749, 750, 751, 752, 753, 754, 755, 756, 757,758, 759, 760, 761, 762, 764, 765, 766, 767: n = A,T,C or G
tgnttnnngttnnntntnagccttgctctttgcttctgcaggatccctcgattcgaattcggcacgagggccaaagaggtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccaacatccccagtgaaactttaagaggagccagtgtattccaggttaagttggggaatcagaatgtggaaactaaacaacttcttagtgcaagctatgagtttcagagggagttcacacaaggagtaaagcctgactggaccattgcacggattgaacactcaaaattattagaataattttcttggaaaaatcagcttatggactttagcagttgctgtgaaaaactaaggaagaaaaattttggggtcatttgatcttcacttaatctaagtctgtgaattacttttatattattttgaaatactccttgcagtatattggcatgatacagtaaaagcattttccacaganttggtatcaccttcttaaaagaagncaaaaatttaaaaaattccaatagccccgttggttggtgtcatattcaataacatttncaatgctacatataattttatagacttataaagaaggtnttgaaaaaaaaaaaannnnnnnnnnnnnnnnnngnnnn

SEQ ID NO: 3933 - DNA, 706 bp, Homo sapiens; identical to SEQ ID NO: 501
  misc_feature 1, 5, 23: n = A,T,C or G

SEQ ID NO: 3934 - DNA, 763 bp, Homo sapiens; identical to SEQ ID NO: 3869
  misc_feature 1, 23, 27, 29, 680, 696, 703, 717, 755: n = A,T,C or G

SEQ ID NO: 3935 - DNA, 774 bp, Homo sapiens
  misc_feature 2, 3, 7, 8, 10, 17, 28, 40, 43, 514, 524, 597, 625, 638,663, 674, 685, 687, 732, 753: n = A,T,C or G
gnntttnntnccttttncttttcaaatncttggctacttnctntttctgcagggatcccatcgattcgaattcggcacgaggaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggcaggaccagatgctgtgttggggaggacaatctggggagttttaggtttaggcgcctttgggtttcagctgaaagaagtccctgctgggaaacacattatcacaactactcgatcccatagcaacaagttggttactgactgtgttgctgctatgaaccccgatgctgtgctgcgagtangaagaacaangaaataagattattcagctgattgaagcaaaagcctctgcttattgtatttgccaagtcctggtttgtagaantggggatacttggtgctccagaagttanttttacatgcttntgggaaggcaagtttacccgatttncatggggaatngttctttcaantnccaccaaaggattgttgaaagccttattgaacttttgcaaggganttccttggcccacaatttganggaattattgaccttcctttg

SEQ ID NO: 3936 - DNA, 759 bp, Homo sapiens
  misc_feature 2, 3, 4, 5, 6, 7, 8, 11, 12, 13, 24, 28, 41, 42, 678, 704,718, 722: n = A,T,C or G
gnnnnnnnttnnntttccttttcnaatncttggctacttgnnctttctgcagggatcccatcgattcgaattcggcacgaggccatgtgaggacatagggagaaagcagccaccattggcaagccaagagagagccctcaccaggaacgattggaccagcaccttgatcttggattttctagcctccagaacttacagtacgggtggctggcaagatggccgaataggaagagctccagtctacagctcccgcagagatcaacgcagaaggaacagcagtctcagcggttagcagcacaagagatgatttacacaatgaagaaagtacatgcactttgggcttctgtatgcctgctgcttaatcttgcccctgcccctcttaatgctgattctgaggaagatgaagaacacacaattatcacagatacggagttgccaccactgaaacttatgcattcattttgtgcattcaaggcggatgatggcccatgtaaagcaatcatgaaaagatttttcttcaatattttcactcgacagtgcgaagaatttatatatggggggatgtgaaaggaaatcaagaatcgattttgaaagtcttggaagagtgcaaaaaaatgtgtacaagagataatgcaaacaggattattaaagacaacatttgcaaccaaggaaaagccnagatttctgctttttgggaagaagantcctggatatgtcnaggntatattaccaggtatttttataaccatcagaccaaac

SEQ ID NO: 3937 - DNA, 738 bp, Homo sapiens
  misc_feature 19, 692: n = A,T,C or G
tctaatgcttggctcttgntctttctgcaggatcccatcgattcgaattcggcacgagggagatccagatattcttagacctgctgtttgaacctgtgaggcatttcaagaatggagagtgccattctgcagtcattcaagcagtagaagacttggatttgtctaaagttcttcctttaggtcgtcagcacggtatcttaaacagccttgagatagtattgaaaaacattagtcatctgatcagcgcatacctgccgaagattttgcagatactgctctgtatgacagcaaccgtatcacacatccttgaccaacgagaaaagatacagctgagatttattaatccattgaaaaatttaagacgtcttggaatcaaaatggtaactgatatctttttggactgggaatcatatcagtttagaacagaagaaattgatgctgtgtttcatggtgcagtttggccccagatcagcaggcttggatctgagagtcaatattctcctactcctctgctgaaactgatcagtatctggagcagaaacgcaagatatttccctttgctggctaaacagaacctgggcacccagaatgtgatatcctgaccaatggttttttgcaattctctcagccgaagaatctttcttgatgcccacagccagtattgtaatgggccataagttggatgacctttnttaacctttccagaatttcgagccctaccggaaaccggttttggat

SEQ ID NO: 3938 - DNA, 738 bp, Homo sapiens; identical to SEQ ID NO: 3937
  misc_feature 19, 692: n = A,T,C or G

SEQ ID NO: 3939 - DNA, 787 bp, Homo sapiens
  misc_feature 1, 10, 27, 52, 54, 66, 80, 131, 175, 196, 218, 260, 283,285, 290, 292, 303, 315, 317, 323, 343, 350, 359, 361, 371,374, 375, 383, 397, 417, 433, 436, 443, 465, 472, 480, 483,485, 494, 502, 504, 513, 522, 528, 533, 538, 542, 543: n = A,T,C or G
  misc_feature 549, 557, 563, 574, 575, 581, 608, 611, 621, 622, 625, 626,643, 644, 650, 652, 664, 666, 674, 679, 681, 694, 700, 704,729, 734, 738, 743, 749, 751, 762, 765, 767, 770, 781, 787: n = A,T,C or G
ncttctaatncttggctatttctaatncttggctactttcaaatccttgggnantcgctctctctncatgatcccatcgnttcgaattcggcacgaggattgtgacatggtgtaataaaggtctacatggngtaataaaggtatacatggtgtaataaaggatgtgggagcacanatccataggaatttgacagtntaggaattgctttattattcangcccttcactctcagactaccctgctctatttgaataatgangcttgtggtggtctgtggaaaantngacanantagaatttggncagctgctgaangncacggnctctggaatgagtccacgtncccctanggacagtantnccaaattganacnnaaactttnagaaaaccaatgtnatggggccaagcaattgggnagctaggcccgacctnatnttttagngattttgaactcaatctttaanatcctgnaacagaangananaaagggtgnatattcgngnaatgacatncaagatctnactgcnctctnggctnctanngatggncgaaaaantgtgcncccaaggtttnncccctntatttaccaccttgcatccatgccatngtngaccttacanntgnncaaaaggcccttgcccnntgtganancattcccctggnanctttcccntaccngntgccctctttaantccttnattnaaaccctgggggtgaaaatcctganaaatntaanttaanaatctngntaccttttccntananaanaactaacctcnagcccn

SEQ ID NO: 3940 - DNA, 757 bp, Homo sapiens
  misc_feature 2, 4, 5, 6, 10, 11, 20, 24, 38, 39, 46, 288, 557, 565, 670,697, 731, 741, 742: n = A,T,C or G
gntnnnttcnnttcctttcnaatncttggctactttcnntctctgnaggatcccatcgattcgaattcggcacgagggagatccagatattcttaggacctgctgtttgaacctgtgaggcatttcaagaatggagagtgccattctgcagtcattcaagcagtagaagacttggatttgtctaaagttcttcctttaggtcgtcagcacggtatcttaaacagccttgagatagtattgaaaaacattagtcatctgatcagcgcatacctgccgaagattttgcanatactgctctgtatgacagcaaccgtatcacacatccttgaccaacgagaaaagatacagctgagatttattaatccattgaaaaatttaagacgtcttggaatcaaaatggtaactgatatctttttggactgggaatcatatcagtttagaacagaagaaattgatgctgtgtttcatggtgcagtttggccccagatcagcaggcttggatctgagagtcaatattctcctactcctctgctgaaactgatcagtatctggagcanaaacgcangatatttccctttgctggctaaacagaagccctgggcacccagaatgtgatatcctgaccaatgtttttgcaattctctcagccgaaagaatctttctgatgccnacagccagtatttgtaatgggacatangttggatgaccttctttaaccctttccagaattncgagcctacnngaaaccaggtttttc

SEQ ID NO: 3941 - DNA, 794 bp, Homo sapiens
  misc_feature 2, 17, 19, 27, 28, 35, 36, 37, 42, 57, 65, 70, 604, 606,608, 612, 622, 624, 645, 646, 649, 651, 660, 673, 676, 683,686, 689, 691, 696, 708, 711, 716, 717, 748, 755, 760, 763,771, 779, 780, 782, 787: n = A,T,C or G
gnttctaatgcttgggngntttcaaanncttggcnnntttcnaatgcttggctactngatctttntgcangatcccatcgattcgaatcggcacgaggagttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacattttcttcctataaaagagttttaaatgatggttaagttcttcaaggcagntncncaanggcctatttntnccccaaagggccccctgaacnnttngncccccatanaaactggaacccnccntttttgntantananccccntgggggaagtgnccnatttnnggggggttaaaaacccgggggggtggccaanaaaaacnacacnttntttttccnattcccanncnataangagaagg

SEQ ID NO: 3942 - DNA, 715 bp, Homo sapiens
  misc_feature 15, 618, 689, 694, 713: n = A,T,C or G
atgcttggctcttgntctttctgcaggatcccatcgattcgaattcggcacgagcttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttggtgtttttgtatttccacctcacccccagcacatagcccagtctcttgcacaaattaagtacttaatgtgtgttgagctaaattgaataaaggattattagcattagcatattttgtgccttggttgtataagctggttgtntgttttggtacctttgcaaatatttatgattatcacccccccacatactaaattgtttttaaaaggtttgnctttncttcagaatactaccccangc

SEQ ID NO: 3943 - DNA, 886 bp, Homo sapiens
  misc_feature 2, 4, 24, 34, 42, 453, 537, 557, 577, 615, 622, 655, 665,676, 683, 718, 732, 746, 751, 756, 778, 790, 804, 805, 809,821, 824, 833, 844, 869, 872, 874, 875, 879, 885: n = A,T,C or G
tnancttcaatgcttttccaaatncttggctctngttctttntgcaggatcccatcgattcgaattcggcacgagcagagctgtgatctgcccccaggtattctgacccccaaactggctctcaaccatgtttacatgatgaaaagaagaggtgactgttgtatcagctctaaaggcctcacttttggtgaaatgggacctaaatttgattgcatacttgattacttgctgtcaatactgaaattggcacttcataattttaatactattgaactttcaccataaccctgtcctataaagttgacttgcaaatgaagaaactctatctcttcaatattataaaatatatccaagagtcacaactagtgagaaaaggacaggatctaactaacaatgtgaggctgtgtcttcacaccaattcaacagagtatcttgtaaatgttgagaggagangtctttaggtcatggggtgtctttcaataaagtgctttagaaaacaggtgacaactggaattgggcccttggagggattgaatnggatttaagcccagggcaanttaaaattaggggaaaagcngaattccttcaaggaaccgggattttaaaaacccagcnttggagnaagaaaagttggaaaaatggagcccaagttggntaaaggaacnaattggaatancctgggncccattggggatttttttaagaaaaaagtggtttnaaaaattgggaaanttgaaatttggggnaattnaaaancctttgggaaaaagaaattggnccctgggggggnccccaaggcctttnntttngaaaaagggccnttnggggttttnggccttttaanaaattaaaaggtcccaaaaattggnccncnntttngaaccna

SEQ ID NO: 3944 - DNA, 886 bp, Homo sapiens; identical to SEQ ID NO: 3943
  misc_feature 2, 4, 24, 34, 42, 453, 537, 557, 577, 615, 622, 655, 665,676, 683, 718, 732, 746, 751, 756, 778, 790, 804, 805, 809,821, 824, 833, 844, 869, 872, 874, 875, 879, 885: n = A,T,C or G

SEQ ID NO: 3945 - DNA, 738 bp, Homo sapiens
  misc_feature 2, 4, 8, 11, 22, 32, 33, 36, 619, 662, 681, 737: n = A,T,C or G
tnancttnaancctttcaattncttgctctgnnttnagccgatccctcgttcggagacatcatgtcaacagaaatggagatgtgcactggggaaactgccggccgggccgctggcccgtggacgcctgggaggtggccaaggccttcatgccccgaggactagcagacaaacaaggacctgaggaatgtgatgcagttgctcttttaagtctcatcaactcctgcgatcacttcgtggttgatcgaaagaaagtcacagaggtaattaaatgtcgtaatgagatcatgcactcttcagagatgaaagtatcttctacgtggcttcgagattttcagatgaagatccaaaattttctgaatgaattcaagaacatcccagagattgtggcagtatactccagaatagaacagctgttgacgtctgactgggctgttcacatccccgaggaagatcagcgagatgggtgtgaatgtgaaatgggaacttacctgagtgagagccaagtcaatgaaatagaaatgcagttactaaaggagaaacttcaagagatatatcttcaagcagaagaacaagaggtgtttgcctgaagagctctcaaatcgactgggaatggtgaangaatttctgagaaacatgaaggatcttagaaatgggctttacngaagatatgccagaaactngacagcctttgtcttccttcaaaaactggattcacaaggaacctgggagacaaacnt

SEQ ID NO: 3946 - DNA, 738 bp, Homo sapiens
  misc_feature 2, 24, 535, 538, 647, 693, 733: n = A,T,C or G
gnttctaatgcttttccaaatacntgctcttgttctttttgcaggatcccatcgattcgaattcggcacgagattttgctggacactcagacacaatttagagtatttatatataacttgaaaacagtaacatttccaaaaaccgatgaaccccaccctgtcccaaggaatgattggtatgtatgtgaagttcattttctgacaaaaataattacgttccacttaggatgcacaaccatgctgtcctgtagagaagtcacaagttttgtgagaatttttaaactgatgatgtttatttccatggtaacatgagtatacattttaccttctattgtagtgatgaatcacaattagtctttttttataggttggtggaaaagtaattgctgttttgccattgcttttaatggcaaccacaactacttttgcaccaacctaatatttattaagactttacttttttgagaccaatttctgaaattgggattcatgttgagagtctctaaggtccctgataatttgtcgcatttgttgntgntttttggagaatatttcatcactactcaaatgatggtcctctggtctggtggaagcttcgtaagctttgaaagccagataaccagggtttcagacaagtctagagccangtcaggatatcaataagacccacaggatgtagggcttgcctgctanggagacatttagcttatcttcccggcaaaaaaggcttgtnccccc

SEQ ID NO: 3947 - DNA, 737 bp, Homo sapiens
  misc_feature 2, 5, 8, 21, 23, 32, 520, 574, 702, 727: n = A,T,C or G
gnttnaancccttttgaaatncntgctcttgntctttttgcaggatcccatcgattcgaattcggcacgagagaaaaacaacagagagaaaaagaatacctgagatatgtagaagctttacgagcccaaatccaggagaaaatgcagctgtataatattactttacctccactatgctgttgtggtcctgatttttgggatgctcatcctgatacctgtgccaacaactgtattttctataaaaaccacagagcatatactcgggcactacattcattcatcaattcctgtgatgtccctgggggtaattcaactcttcgagtcgcaattcataattttgcttctgcacacaggcggactttgaaaaatctataataagaatctgaaattaactggtagtattttggcttttacttaaaatcatccctgagagagtatttaagaaaagctgttcaagttataaaatatataatctggaaagaaatactgtctcatataataattagattgtaatcattgntttaatctctgtctgggaaccaagattgaaagctgacttacttctctcttctgncttgtgaaccatacggagcctattattttaaaatatgatcagacaagtaaggcttctcttactttgctctgctctgatcagaagagctcatgtgaagtctttgagattctcttaattatcatcttctnaaactgggttttgagcttgacagtnctgaaaaagt

SEQ ID NO: 3948 - DNA, 757 bp, Homo sapiens; identical to SEQ ID NO: 3940
  misc_feature 2, 4, 5, 6, 10, 11, 20, 24, 38, 39, 46, 288, 557, 565, 670,697, 731, 741, 742: n = A,T,C or G

SEQ ID NO: 3949 - DNA, 749 bp, Homo sapiens
  misc_feature 9, 22, 40, 83, 88, 91, 107, 109, 111, 119, 124, 129, 132,137, 145, 149, 170, 189, 213, 217, 220, 228, 235, 255, 337,339, 341, 364, 375, 376, 394, 409, 416, 466, 472, 477, 500,533, 603, 604, 605, 622, 652, 654, 655, 658, 679, 687: n = A,T,C or G
  misc_feature 694, 697, 704, 706, 715, 726, 736, 746: n = A,T,C or G
ttcaaatcncttgctactttcnaatcgcttggctactcgntctttctgcaggatcccatcgatgtcggaattcggcacgagangtgtnccnactgtgccctctgctngncnctgctccnaactntaacncanttgcntttggtgnacangtcacctgcgtgtttaaaatntccttttgtaatgtatcgngaatgtgccgagaacatatgaaantggntgncaatgganatggaangggctttattctcacttaanagagccctgggaggaataaggttttatctggatcaggtatccaattgcattggataaacgtggcctgaggcatgataaaatntnanaacacaataataagcctcctggngacatctctgnnccttttatagtccctcanctggcttgtttgcanggtgcangatgggtgaccacctgacgtgcttatgtggtcagtaagttatctgaatanggtctntctanaccccctagaatttgtggagctnggttgcatcataggaaatgcaagctgtgctggngttcacaagctaggagaggagaatgggttggatgtgcacctggctctgcaggaagcccatcttaggttannncctgaaggataaagaanctggccactggaatggttgggaaaaggctntnngancttcccatgcccaaccttggncctttttngggtatnatngtgcccngnccttgaacngcttttttaantctgacaaanatacaggganttt

SEQ ID NO: 3950 - DNA, 726 bp, Homo sapiens
  misc_feature 17, 22, 26, 30, 35, 38, 40, 41, 57, 60, 61, 72, 83, 95, 100,108, 124, 219, 261, 325, 349, 350, 358, 360, 384, 385, 399,414, 434, 441, 476, 494, 496, 572, 573, 587, 588, 606, 654,660, 667, 671, 672, 688, 705, 713, 726: n = A,T,C or G
tgagttcaatgttggcnttgcnaatnctgnctgtnccncnnttgcgggttaaccagnctnncgattgaggantaaaggtcatngatggtcagaanctgantgacgttnggaatccaccccgttnattgtagaactgggggttcagagggcaggtgcctcagagttgaggccacacagtgaggtctggtgggtgaaaggacccaggaacgaggcgttcangaaagcaggttgtcagagctatgtggagtctgtgggtggcangggcagccgctccagcctttgaagactttgaaagccacagattcctggcgcaggcttggacttnctgggagctcctccaagtacccannggcatcananctgcctgggtgttacatggcccanngaacccatgttcanggtaggacatgcatnaccagatacccaatgtgcanagtgaanacactgggctccctgttaaacgatgaagaattcangacagtgacagcattacntnacccctggggacaagaggtcagcctaaggtgacacacggttgactactgtgcttcggaggctccctgtgtcctggnngaagaaaagcattnnagggggcagctggaccangctcccaactgcagaagttccagccctggcttgggcaagggccccggncttggnactcacnattnnctgatatgccttaagnaattcattctggtttgnacaatttntttttttaaaaan

SEQ ID NO: 3951 - DNA, 907 bp, Homo sapiens
  misc_feature 4, 9, 19, 20, 22, 29, 31, 35, 46, 50, 51, 52, 73, 86, 163,191, 199, 219, 221, 227, 274, 287, 292, 302, 334, 342, 350,354, 392, 398, 416, 432, 435, 443, 460, 464, 486, 488, 489,500, 507, 517, 535, 537, 545, 564, 567, 570, 579, 590: n = A,T,C or G
  misc_feature 595, 598, 600, 606, 607, 611, 623, 624, 628, 629, 632, 637,648, 649, 653, 663, 665, 671, 680, 681, 683, 688, 701, 702,718, 736, 744, 747, 754, 768, 773, 776, 785, 806, 808, 814,819, 820, 824, 825, 827, 828, 833, 834, 844, 847, 856: n = A,T,C or G
  misc_feature 867, 874, 880, 888, 891, 894, 905, 906, 907: n = A,T,C or G
gttnaatcnttggcatttnnanatcgctngncganccgatcgattngaannnggcacgaggcagctgaaagangatctgtccagcntcatcctcctatcagaggaggacctccagatgcttgttgacgctccctgctcagacctggctcaggaactacgtcanagttgtgccaccgtccagcggctgcagnacacactncaacaggtgcttgaccaaananaggaantgcgtcagtccaagcagctcctgcagctgtacctccaggctttgganaaagagggcaatnctctngtcaaagcangaagagtccaaagctgcctttggtgaggaggnggatgcantagacacngggnatcagcatgagagacctgctaagacgttgcgcttggcngagccncatccttactgcacttgnagggagaagcaggctncanaagctgtngcttatctaatacaggnattncggagttgggttacccaaaggnannacccccaaaancacttgncttgtatggncttggaacctggggacantnaaagaatnaccgggacacctggttcanagnaangcccttgtnagtcagtttanccttnggnancttgcnnactntgccaattaaannaacnnccnataancctttggcaannttcntccctttccngntaaggncaatatttnnanaccanaggcccaaagggnnccccttcaacccaaancctttggggttggaaccncttgggcnaanaaaaatncccctttaaagtcncgatntgnccccaaggnaaccgggggaattctccccanantatttngtccnntacnnannatctnnggttaaactntgnacgccccanaaggggaaaantcttctnttttgngggctccnaanttntatgggttaannn

SEQ ID NO: 3952 - DNA, 715 bp, Homo sapiens
  misc_feature 5, 6, 7, 9, 17, 25: n = A,T,C or G
tcttnnntnggctattngatctctntgcaggatccctcgattcggaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgcagtaggtggtggctttcttcttcttcagattgctagtcatagtggctatgtgcagattgactggaagagagttgaaaaagatgtaaataaagcaaaaagacagattaagaaacgagcgaacaaagcagcacctgaaatcaacaatttaattgaagaagcaacagaatttatcaagcagaacattgtgatatccagtggatttgtgggaggctttttgctcggacttgcatcttaaggacatgaatattctcccataacggattcaactatgagaagagaagtggcagcaataaggcagtctctcaaaagtcatactgccagagtctctagggcaaggagaaacaactagctggacaatactcaattcacaacttagcattttgccatctgaagcttggcaaactagtatctgctgtaaaacaacctatatggtatgtgaaccgtagtattcctgagcaaaacgtggctttcatcgctttgtaaaaatttggcatctgtttagaaactagcctataaaata

SEQ ID NO: 3953 - DNA, 715 bp, Homo sapiens; identical to SEQ ID NO: 3952
  misc_feature 5, 6, 7, 9, 17, 25: n = A,T,C or G

SEQ ID NO: 3954 - DNA, 730 bp, Homo sapiens
  misc_feature 4, 9, 22, 364, 377, 505, 512, 602, 625, 626, 655, 667, 684,705, 722, 730: n = A,T,C or G
tttnaatcncttggctactcgntctttctgcaggatccctcgattcgaattcggcacgaggtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaattnctgcaactggcanaatctaatacagtgagaggaatagaaacctgtggaatactctgtggaaaactgacacataatgaatttactattacccatgtaattgtgccaaagcagtctgcgggaccagactattgtgacatgganaatgttnaggaattattcaatgttcaggatcaacatgatctcctcacttctagggatggatccatacacatcctactcaaactgcatttttatccanccgttgatctttacactcactgnnccttatcaacttatgttgccaagaagccnattggccatttnttggctcaccaaaagcntaaagacactggccttcttangcttaccaatgcttggnttgcttgn

SEQ ID NO: 3955 - DNA, 787 bp, Homo sapiens; identical to SEQ ID NO: 3939
  misc_feature 1, 10, 27, 52, 54, 66, 80, 131, 175, 196, 218, 260, 283,285, 290, 292, 303, 315, 317, 323, 343, 350, 359, 361, 371,374, 375, 383, 397, 417, 433, 436, 443, 465, 472, 480, 483,485, 494, 502, 504, 513, 522, 528, 533, 538, 542, 543: n = A,T,C or G
  misc_feature 549, 557, 563, 574, 575, 581, 608, 611, 621, 622, 625, 626,643, 644, 650, 652, 664, 666, 674, 679, 681, 694, 700, 704,729, 734, 738, 743, 749, 751, 762, 765, 767, 770, 781, 787: n = A,T,C or G

SEQ ID NO: 3956 - DNA, 746 bp, Homo sapiens
  misc_feature 1, 4, 6, 7, 12, 13, 14, 18, 22, 26, 37, 44, 107, 180, 202,204, 206, 207, 218, 237, 248, 253, 257, 263, 269, 272, 290,299, 313, 318, 326, 354, 360, 400, 420, 432, 445, 458, 459,476, 486, 496, 563, 577, 578, 587, 592, 595, 599, 617: n = A,T,C or G
  misc_feature 629, 644, 654, 655, 657, 671, 694, 700, 712, 719, 727, 736,740: n = A,T,C or G
nttntnnccttnnnccanactnaacnctttgcacttnctctttntgcaggatcccatcgattcgaattcggcacgagatttgtaccaactgtaccatctgcttgttnctgctccaaacttttacccacttgcttttggtaaagaggtcacctgcgtatttaaaatatccttttgtaatgnatttgggaaagtgccaagaacntntnnaaatgggtggnaattgaaattgaaagggcntttaattttcnttaanaaanaccctnggaggnganataagggttttatctggnatcagggtntccaatggcattgntatanacgtggcnctggggcagggataaaatttaaaaaacncaatantaagcctcctggtgacatctctgcccttttatagtccctnatctggcttgtttgcagggngcaagatgggtnaccacctgacgtncttatgtggtcannatgttatcaaaaggggnttttctctangaccccctanaatttgtggagctgggttgtatcataggaaaatgcaagctgtgctggtgtacacagctagagagganaatgggttggatgnncacctgctntgcangangccnatctcagttattgctgangataaaaagctngccttggaatggaanggaaaggctnnangaacttcccatgcnacctggccctttttgggtatggncggtgnccaaaacctgancttgttnttaccccngacaaaggngggnggtttt

SEQ ID NO: 3957 - DNA, 755 bp, Homo sapiens
  misc_feature 2, 5, 6, 7, 16, 18, 30, 35, 537, 571, 605, 645, 707, 754,755: n = A,T,C or G
gnttnnnccttttcantncttggctctcgnctttntgcaggatccctcgattcgaattcggcacgaggtctagtataatcttgatgctcaaaccagataaggacaatacaagaaaggaagagtataggctaattctacccaataactaaatgaagtattagcaaaccagattcatcaataatcttttaaaaatcaagaattaattggatttaggaatataacactgtgtataacaagtttaagagaaatatatgagaatgataagactgcaattgaaagtagaggctttctctggagggaaaggtgaggaggatgtgatttggaagaacagcatggggaggcatcagttgtattgtaatgtttattttttaagctgaatgataggtacgtagatgttcattgtgttctttttgcctttttgtatatcttaaatatatggtagtgccatgattagcaggcttaatagccttgtgagtttaaatgtcactttcaaatgctgtatttttggtggagttgcttaaacacattccccttggnatctatacaaccagttaaaaaaaatcatgtatanaccacccattgaaaatataatggaaatgtactgnatatgccattttcatgaaatggttgtgtcaaaggggcttnttaggaaaaaaaaagatcgtttaactctttttgcatttaagtggaaaataaggtgggctttnggaaatagtttcaacccttgcttaaccagttttttttttcatgcttnn

SEQ ID NO: 3958 - DNA, 749 bp, Homo sapiens; identical to SEQ ID NO: 3949
  misc_feature 9, 22, 40, 83, 88, 91, 107, 109, 111, 119, 124, 129, 132,137, 145, 149, 170, 189, 213, 217, 220, 228, 235, 255, 337,339, 341, 364, 375, 376, 394, 409, 416, 466, 472, 477, 500,533, 603, 604, 605, 622, 652, 654, 655, 658, 679, 687: n = A,T,C or G
  misc_feature 694, 697, 704, 706, 715, 726, 736, 746: n = A,T,C or G

SEQ ID NO: 3959 - DNA, 744 bp, Homo sapiens
  misc_feature 3, 6, 25, 26, 37, 39, 528, 609, 629, 641, 696, 718, 730,743, 744: n = A,T,C or G
ttnaancctttccccctttcaaatnncttggctactngntctttctgcaggatcccatcgattcgaattcggcacgagaagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtgcactttggcctgggcatggtggctcatgcctataatcccagcactttgggaggccaaggcgggtggctcacttgaggctaggagttcaagactagcgtggccaacatgaggaaaccctgtctctactaaaaatacaaaaattagctgggtgtgttggtgcatgcttataatcccagctacttgggaggctgaggcaggagaatcgcttgaacccaggaggtggaggtttgcagtgagcccgagattatgccactgtactccanccgtgggtgacagaatgagactctgtctcaaattaaaaaaaataaaaaaataattttttttttttaaaagtacccctttgntggctggggcacggcgactnacgcctgtaatnccagcacattggggaggccaaggcagggcagatcaccaaggttagggagttccanaccagccttggccaacatgggngaaacccctgcntttactggaaaann

SEQ ID NO: 3960 - DNA, 765 bp, Homo sapiens
  misc_feature 11, 12, 16, 19, 25, 589, 611, 633, 666, 695, 733, 749, 754,758: n = A,T,C or G
caatgcttgtnntttnaanccttgnccctttcaaatccttggctacttgttctttttgcagggatcccatcgattcgaattcggcacgagacaaggtgctggcagtgaagtgggggcagactgagcctgtgtagtgaagtgtcttgaggaacgtcagctgtatcttttaggaaaccaaaactgcatagacattgaacccaggcagaaggtcatgaagtcagagctaagaaatgctagtggggatagggggtgagatagagttgggaaatgtttcagagctacaggtgacagttgttggtgtccagttggatatgtaccatgaagggaagaagcagtcagagtgggcaccaagctttctagcctggaggactgaatggttctgtgcacatttcagatggaaagaatagaggcccacagaaagttaatgagatgcattttatacataccagttttgaattttaaggacctgtggggtagatatccaagatggctattcccagtaatttgtatttatatcttgctacatcgcagaaaggatttgaagcttgctaacacacataagatataagaattaaaataggctggaccntgggaacctcacacctgtaatnccagcatttttggggaaggccnaagccgggttggatcactttgaaggtcaagaantttccagaccaccctggccaacattggtnaaaacccccattccttattaaaaacttccaaaaattancaaaggtgtggtggtnccttncctntaatcca

SEQ ID NO: 3961 - DNA, 830 bp, Homo sapiens
  misc_feature 25, 48, 51, 57, 68, 73, 78, 79, 80, 81, 82, 91, 117, 119,131, 132, 133, 134, 141, 142, 146, 151, 179, 185, 189, 202,205, 206, 209, 214, 218, 219, 223, 227, 228, 231, 233, 234,239, 243, 250, 260, 262, 276, 277, 278, 281, 282, 286: n = A,T,C or G
  misc_feature 294, 295, 296, 297, 298, 302, 304, 305, 306, 310, 314, 321,323, 332, 336, 345, 356, 372, 383, 388, 395, 398, 407, 409,416, 417, 419, 420, 425, 426, 431, 435, 440, 442, 446, 462,465, 466, 467, 472, 478, 479, 488, 490, 491, 497, 498: n = A,T,C or G
  misc_feature 500, 502, 505, 506, 510, 515, 516, 520, 522, 523, 524, 525,533, 536, 545, 553, 554, 557, 559, 563, 564, 566, 567, 570,575, 590, 598, 600, 617, 625, 632, 636, 639, 652, 668, 672,678, 680, 711, 730, 739, 741, 746, 747, 755, 757, 758: n = A,T,C or G
  misc_feature 762, 768, 771, 774, 777, 778, 799, 806, 819, 820, 821, 825,830: n = A,T,C or G
gcttcaatgcttttcatttcaaatncttggctctttcaaatccttggnacncgatcnctttgcaggancccancagcnnnnntgcggaacnggcttaaccagttcgggacttacagnangctaccaatggnnnntggcccnncgangatanggatctgcgccacatggaggttttgggncgggancttnaacgctacctgcnacnnatnttggntggnntccntgtnnacnannttgtncttntgccaangggcactcantnatgcctatactatnnngcnnacancataacgnnnnnctcncnnnatgncttncacattncncaatcattntgcntacagtatnatgcatgatangcaagtagtcactgcntagtgagatanggacnggatctnccntacaatgtnangctgaanntnnacacnnatgcnacanactancntggnaatgggtataggacangtnnnttagntcatgnntgactatgnannagtgcnntngngannatgngatanntgancnnnncttgaagnttnaatggatgnatccagcnnatngnaatnngnnaancctcntactacaagactganataaatgnanttttgacgataatgctnaataatgnatctaanatgnaanttaccatgttggnaaacttgggcccatgngcanaatttnanaaaaggttttggaaaattggaaatggattgngtagcaattaaagcttttntacccctangngcccnntgacctcncnngggnattganatnaantgnnttccggaatttggcctctgantattttngcttataaatccnnnttgncgacn

SEQ ID NO: 3962 - DNA, 738 bp, Homo sapiens
  misc_feature 9, 21, 108, 545, 575, 646, 656, 661, 677, 688, 709, 712,717, 725, 727, 734: n = A,T,C or G
tttcaaatngcttggctactngttctttttgcaggatcccatcgattcgaattcggcacgaggcctggaccgctcattcggactcgtcgggcagagcttttgtgctgncttgcaccaggaactcagagaatactatcgattgctctctgttttacattctcagctacaactagaggatgaccagggtgtgaatttgggacttgagagtagtttaacacttcggcgcctcctggtttggacctatgatcccaaaatacgactgaagacccttgcggccctagtggaccactgccaaggaaggaaaggaggtgagctggcctcagctgtccacgcctacacaaaaacaggagacccgtacatgcggtctctggtgcagcacatcctcagcctcgtgtctcatcctgttttgagcttcctgtaccgctggatatatgatggggagcttgaggacacttaccacgaattttttgtagcattcagatccaacagttaaaacagatcgactgtggcaccgacaagtatactttgaggaaaatcgatgattncttcgtttatgaacgatggatcaagtctangaaaggtccttttgataggaaaatcaattaaatttcttgcccaaggtttggccatgatcagacttcccacnttcaaaaganggatnagcttggtgaaccaanttcttgcagangtcaccccaaggaatgcttgnaanacctntttcccananctttggnaaat

SEQ ID NO: 3963 - DNA, 794 bp, Homo sapiens; identical to SEQ ID NO: 3941
  misc_feature 2, 17, 19, 27, 28, 35, 36, 37, 42, 57, 65, 70, 604, 606,608, 612, 622, 624, 645, 646, 649, 651, 660, 673, 676, 683,686, 689, 691, 696, 708, 711, 716, 717, 748, 755, 760, 763,771, 779, 780, 782, 787: n = A,T,C or G

SEQ ID NO: 3964 - DNA, 746 bp, Homo sapiens; identical to SEQ ID NO: 3956
  misc_feature 1, 4, 6, 7, 12, 13, 14, 18, 22, 26, 37, 44, 107, 180, 202,204, 206, 207, 218, 237, 248, 253, 257, 263, 269, 272, 290,299, 313, 318, 326, 354, 360, 400, 420, 432, 445, 458, 459,476, 486, 496, 563, 577, 578, 587, 592, 595, 599, 617: n = A,T,C or G
  misc_feature 629, 644, 654, 655, 657, 671, 694, 700, 712, 719, 727, 736,740: n = A,T,C or G

SEQ ID NO: 3965 - DNA, 773 bp, Homo sapiens
  misc_feature 37, 493, 524, 564, 598, 681, 683, 684, 706, 734, 759, 768,771, 772, 773: n = A,T,C or G
gcccctttcattcaaatccttggctactcgttctttntgcaggatcccatcgattcgaattgatgagccttattaactatcttttcattatgagacaaaggttctgattatgcctactggttgaaattttttaatctagtcaagaaggaaaatttgatgaggaaggaaggaatggatatcttcagaagggcttcgcctaagctggaacatggatagattccattctaacataaagatctttaagttcaaatatagatgagttgactggtagatttggtggtagttgctttctcgggatataagaagcaaaatcaactgctacaagtaaagaggggatggggaaggtgttgcacatttaaagagagaaagtgtgaaaaagcctaattgtgggaatgcacaggtttcaccagatcagatgatgtctggttattctgtaaattatagttcttatcccagaaattactgccttcaccatccctaatatcttctaatnggtatcatataatgacccactcttcttatgntatcccaaacagttattgtggcatttaataatggaatgtncatgggaattttcccactggccttacctttctgnccttggggaagcttaaactctggaatcttctcaatctgtaaaatggggaattaaaagtatctacctaactgagttgggaatgnanntgaaaagaaaggccattttttntaaatcttggaatttagccaagcccacntccgattttatggccctttcccatngccctggantgnnn

SEQ ID NO: 3966 - DNA, 775 bp, Homo sapiens
  misc_feature 1, 14, 15, 25, 33, 672, 683, 691, 692, 693, 695, 697, 699,700, 701, 702, 704, 705, 706, 719, 720, 723, 729, 735, 740,744, 748, 749, 759, 768: n = A,T,C or G
nctctttgacctcnnttggctactngttctttntgcaggatcccatcgattcggtcagatggtagaaaatgaaataattaaatagataccatttgagttctgggagccaggtgaagaagtgtttgtttgtttttgagacggagtctcactctgttacccaggttggagtgcagtggcctgatcttggcgcactgcaacctccgccttctgggctcaagtgattctcctgctccagcctcctgagtagctggggctacagacgtgtaccaccacacctggctactttttgtatttttagcagagaggggatttcgccatgttggtcaggctggttttgaactcctgacctcaggtgatctgcccaccttggcctctcaaagtgctgggattacaagcgtgagccactgtgcccggccagaaggagtgttttgagaatggctaagagaagataggttgaatagctatgcctacatgtcactaattaacatctcagagatctctgctacaggttgtccgtcctcattttgtctaatatttttccaatggcatgagtataggaagataaacggggaatgttttgaagtaataaaaaaattccattcataaagaagaacaacatgtattaagctttgtgcaccaaacaacacaaacagggaagacacataaggcaanaagcttttagnaaaaaaannntncntnnnnannntaataaaaaactnnggncctttngaactntaggngagnccgnntttaccgtanaatccaganctgaata

SEQ ID NO: 3967 - DNA, 775 bp, Homo sapiens; identical to SEQ ID NO: 3966
  misc_feature 1, 14, 15, 25, 33, 672, 683, 691, 692, 693, 695, 697, 699,700, 701, 702, 704, 705, 706, 719, 720, 723, 729, 735, 740,744, 748, 749, 759, 768: n = A,T,C or G

SEQ ID NO: 3968 - DNA, 820 bp, Homo sapiens
  misc_feature 5, 9, 15, 24, 36, 325, 356, 488, 574, 580, 592, 601, 611,627, 632, 654, 665, 684, 689, 696, 699, 715, 720, 730, 747,762, 776, 784, 789, 814: n = A,T,C or G
tcccnagantccatncgtttggcnactcgttctttntgcaggatcccatcgattcgaattcggcacgagtgttcttgtagtgtttgttgctattgttagaaagattattagtgatatgtggggtgtcttagctaaacaacagacacatgtaagaaaacaccagtttgatcatggagagctggtttaccatgcattgcaattgttagcatatacagcccttggtattttaattatgagactaaaactcttcttgacaccacacatgtgtgttatggcatcactgatctgctcaagacagctatttggatggctcttttgcaaagtncatcctggtgctattgtgtttgctatattancagcaatgtcaatacaaggttcagcaaatctgcaaacccagtggaatattgtaggggaagttcagcaatttgccccaagaagaacttatagaatggatcaaatatagtactaaaccagatgcagtgtttgcnggtgccatgcccacgatggcaagtgttaagctctctgcacttcggcccattgtgaatcatccacattatgaagacgcatgcttganagcccnaacaaaaaatangttttactnaaatgtatangtacgggaaaggcacnccganggaaagtgaaaacgaggaactngattaaagttnaaaaggtggaacttattancattncctatanaantagttcatgggtgtgntaaanaaaggatccnaagcccctggtttgcangtttgccctggaaantttgggggatgttnggaagaanacctngcccaaatggcttggggcaaaaacnttccct

SEQ ID NO: 3969 - DNA, 776 bp, Homo sapiens
  misc_feature 1, 8, 18, 24, 30, 489, 541, 567, 585, 669, 693, 726, 732,733, 738, 747, 751, 772, 776: n = A,T,C or G
ntcctctnttgccttcgnttggcnacttgntctttttgcaggatcccatcgattcggttgagcaatatgaatataatgccaagtactgataaaatacggaattcatttagaatcaacataggtagacagactgtttttagtaaggttttgttttttggtgaataccatgtttgggctgtcagacttacttttcccctgagatccatattttgtacatgacataccagatatatgcaatatgaaacggaaacagtttttcaatctaatatccaggagtttgtgttaatatcttgtgaacttgtggctcttggtatctggcattgataaggctgtctactaatcctagagaaagggaagtagactccgttttaaagtctagtccagtcttattctttagttcatagaaatggtctaagttaatgatagactccgcacttatgttcagaaagcatcatcattacagctttgttgaagggacttctgagtaangattatgtttgcgtctcctgttggtggaaggcccatgaagcgtaatttcctnctcaccatgggcttctttattattgntgagtttttcatactcanggatgtgaattcaaccttgggtgttccagttcagagaaaatatttcatgaaaggatgaagtgttggttcaattctaggaccagnattgagtggcattatattccagangtccttatgggaaatgctgggatttattgagtnggtttnncaggncattttcgncccntttgccctgggactaactaanacan

SEQ ID NO: 3970 - DNA, 813 bp, Homo sapiens
  misc_feature 19, 30, 91, 152, 159, 206, 211, 221, 247, 312, 351, 353,372, 423, 457, 466, 500, 510, 523, 536, 537, 542, 604, 635,643, 660, 671, 672, 673, 676, 677, 691, 737, 742, 754, 763,766, 804, 810, 811, 812: n = A,T,C or G
gcctccttctttcaaaacncttggctactngttctttttgcaggatcccatcgattcgaattcggcacgaggccacacgggccgcatcatncctgcaatctggttccgctacgacctcagccccatcacggtcaagtacacagagagacggnagcccgntgtacagattcatcaccacgatctgtgccatcattggcgggaccttnaccgncgccggcatnctggactcatgcatcttcacagcctntgaggcctggaagaagatccagctgggcaagatgcattgacgccacacccagcctaatggccgangaccctgggcatcgccagccttgcctccagtgccctgtntnctttggccctcaatctggncccaaatctggctgtgtcccaaagggtgtgtgggaagtggggggaaagtanaggatggctcgatgttttgcagctacctcttttncccgtgttnctttttagacaaattacactgcctgaagttgcanttcccctttncctggggagcccnaagaacagagtcnnggcanggggtggggagtccagggatcttgggggacccctcctaaggagaagcttgcagtctcttccntaaggggaacatcccagaatgcattatcgantcagcttnttaagcccaggctttanacaaattcttnnnagnnccccaattagggtnggacaccatttaaatgaatttgggtttacttccccctggggcaagnccaanccttgcccccanaaggctacncanaaaccttgggggcttttaagccttttggggacccaggnttggcnnnt

SEQ ID NO: 3971 - DNA, 739 bp, Homo sapiens
  misc_feature 2, 3, 6, 7, 8, 9, 10, 11, 19, 21, 22, 23, 31, 641, 680, 725: n = A,T,C or G
gnnttnnnnnnttttcaantnnnggctctgntcttttgcaggatccctcgattcgaattcggcacgagcctagtcccagagtcctggagcggcatactgggggtggctgtgcagtcccagcatccccaacccagcatgtatagagagcatccatccttacatccagctgacccatgcccatgctcctccctgtggctggaggttcaacaataacataagtctcttctttgccctccagatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtacccgaggctcgctgacacagagaaaccccaacgcgaggaaaggaatggccagccacaccttcgcgaaacctgtggtggcccaccagtcctaacgggacaggacagagagacagagcagccctgcactggtttcccttcaccacagccatcctgtcccttcattggctctgggctttccactatacacagtcaccgtccaatgagaaacaagaaggagcacccttcacatngactccaactgcaagttggacagcgacattcaatcctgnactggttaactggggttactggatgactcctggttgcccaccatnctttttgactggga

SEQ ID NO: 3972 - DNA, 782 bp, Homo sapiens
  misc_feature 1, 12, 14, 15, 26, 31, 39, 507, 568, 681, 742, 768, 782: n = A,T,C or G
ntgcttcctctncnnaaccctttggnaactncctctttntgcaggatcccatcgattcgaaaatattttagtataagcaattggctgtgatgctcaaatttattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgnattttttattttccaatactgcatccatggcctggcagtgttacctcatgatgtcataatntgctgagagaagcaaattttctttcttttctgaatcccacaaagcctagcaccaaacttccttttttcttcctttaattaagatcataaataaaatgatcctgggggaaaaangcatctgtcaaaatagggaaaacattcccaaaactggagccactcttcttgtgcacctaanccatagcttggtgaccaaacaagatnggttgcttcaaggn

SEQ ID NO: 3973 - DNA, 1407 bp, Homo sapiens
  misc_feature 3, 4, 5, 8, 9, 10, 12, 16, 17, 20, 21, 25, 27, 28, 29, 31,34, 35, 39, 42, 43, 45, 47, 50, 52, 55, 57, 62, 68, 75,80, 81, 84, 86, 90, 91, 98, 103, 107, 108, 112, 114, 116,117, 129, 132, 134, 136, 140, 141, 142, 145, 147, 148, 158: n = A,T,C or G
  misc_feature 170, 172, 173, 174, 179, 180, 183, 184, 198, 199, 213, 214,216, 226, 230, 235, 246, 259, 261, 262, 266, 267, 269, 274,275, 278, 280, 282, 283, 292, 295, 306, 314, 315, 317, 318,319, 335, 339, 344, 346, 348, 351, 352, 356, 359, 360: n = A,T,C or G
  misc_feature 361, 369, 378, 386, 389, 391, 394, 396, 398, 399, 401, 402,407, 408, 413, 417, 418, 420, 424, 425, 426, 435, 436, 439,441, 450, 454, 455, 456, 457, 459, 460, 461, 462, 463, 464,465, 470, 471, 472, 473, 476, 480, 483, 484, 485, 490: n = A,T,C or G
  misc_feature 498, 500, 507, 509, 512, 513, 514, 517, 522, 530, 534, 541,547, 548, 549, 552, 553, 555, 570, 576, 586, 588, 589, 594,597, 599, 610, 613, 619, 622, 623, 625, 626, 630, 633, 634,636, 638, 639, 642, 644, 647, 650, 661, 662, 663, 670: n = A,T,C or G
  misc_feature 674, 684, 689, 694, 695, 701, 709, 733, 735, 740, 756, 766,768, 769, 786, 789, 791, 796, 798, 802, 803, 806, 809, 811,814, 821, 827, 832, 836, 843, 845, 862, 864, 870, 875, 879,893, 894, 895, 896, 899, 900, 901, 905, 906, 907, 920: n = A,T,C or G
  misc_feature 922, 930, 931, 933, 934, 940, 948, 950, 963, 965, 966, 970,978, 979, 982, 984, 987, 988, 990, 1005, 1006, 1008, 1021,1027, 1028, 1042, 1046, 1057, 1068, 1080, 1083, 1084, 1097,1101, 1116, 1121, 1123, 1126, 1136, 1138, 1139, 1150: n = A,T,C or G
acnnnacnnngnaagnnacnngaanannngnaanngacnaanngnanagngnaananaaggngggggngagaccnccagnnggngnccannaaccccntgggnaaanngccnananngcaggaacccancgnangnaaannnggnanngaggcagagnacccgcaggaancnnnaacanngannacaggcaggaaacnnacaaaaaggagganngngaaaacaaanacanacagngaggccaaagnaaaaaacatcagnanncgcnnanacagnncangnannccaaggaanaanaagggaagganaaacaagnngnnnaaaagaacaaaggagngaangccananangcnnagcnaannnaaacaaanacggggganaaggcganaancnacngnannanngcaannagaangaannanacgnnngacggcgannagnanggacagcgnagannnnannnnnnnaggannnnagnacanagnnnacgancggcacananggcggananagnnngancacangacacaanacanacacgancaggcnnngannanacacggaagcaaagnagaagngcagaaaganannagaancancnccgagaggcanagncacagnagnnanngcanagnncnannagnanagnaanagcgacagagnnncgaagcngagnaacacacaangaaancagannacgagnagacggangaaagggaagacaaagagagaggnangaaangaaagaaacagagagngcagaagacncnngagagaagagagacagnagnangagancncgcnnacngananganaagacanagaaanagagngcgnagagacnanagggagcgaacgcaganangagaanagacngaanaaagaggagcaaannnnagnnngaannncacgaggacagancncaacaagnncnnaggcanacgaaaananacaggacgaggangnnacanagcgcgannagncncanngnagcgcgaacgaggannanagagaacagcganagagannggaagggcagacanaggnaaaaggggganacacacgagangcgacacagganaanngcgaggacggacngggnggggagagaaaacgngcgancnggnaaggagaagnannaaggagaggannagacgacgcnagananangnagnanngaaagcacanngacggaacangnngcacgagcaggcanacnaaanaaganggnangaaggaanagannncaagngangaaacngaaagaggnaaagncncgangagngnaccagacgcagaannngnagcacaagagaacngagagagancganaggagaagggagnganaganaagaagaaaagcgggnaacaaaaaacangncncccnnagacaaagngggnggcgng

SEQ ID NO: 3974 - DNA, 876 bp, Homo sapiens
  misc_feature 11, 12, 14, 194, 366, 404, 405, 416, 417, 436, 439, 448,460, 463, 483, 487, 496, 497, 509, 515, 517, 532, 534, 539,540, 542, 547, 550, 565, 574, 576, 577, 593, 598, 605, 606,607, 611, 615, 638, 650, 651, 654, 656, 669, 677, 681: n = A,T,C or G
  misc_feature 682, 692, 696, 697, 714, 716, 717, 727, 729, 741, 742, 752,767, 772, 777, 792, 795, 796, 799, 812, 813, 820, 822, 827,829, 830, 831, 832, 838, 841, 844, 846, 847, 853, 854, 861,864, 865, 867, 868, 869, 870, 871: n = A,T,C or G
gtcccctttcnntnaatccctttgggtctttctgcaggatccctcgattcgaattcggcacgagatacaaatactacgttggacgcaaggctatgtttgacagcgattttaagcaagatgctggttatgttgacataggaaatggagattaggacaacatttagttcagcgactgacttcatgacctacacatnccgcatggagatgacttagaagcaggggatatgcccttggacctggtgtcaaagctctcgtttaaacagcctcgtgcagtgtgtcgctaccacaagagctcctgtttaaacagcctcgcacggcgtgtcgcttgccacacctgacactattggattagtttacgttgctgangagtacctgtcatttgcctttgagcattgtcacccgtnntaggtccgaannaaccaaaatgggttggatnctnggacccttntttggctttccngtnaaaaaatggctttttggggntcanaattgcccnncttgggggggangctttncntgaaaaaaaggtttntnccctnngntgccnaantttttggccggaaantttaccccnanncccttttaaacccaangggcnaaacctnnnttgnttgntttcaaacaaaggcccctttggnaaaaaccccggnnggncntttttttaaattnccttgggnggannttttcctcantccnnggaaaaacctttaaaantnnttccccttananggaacccttttnnaaaaaaaagnggttttcctttaccngaaanccccnccgattttttttggnatnnttnatagggttccctnnaaattcnancccgntnnnntgcccnttnaantnnaatcanntttaacnttnncnnnnnaatcc

SEQ ID NO: 3975 - DNA, 1195 bp, Homo sapiens
  misc_feature 1, 2, 3, 4, 8, 9, 10, 11, 12, 13, 14, 15, 16, 17, 18, 19,20, 21, 22, 23, 36, 37, 41, 42, 44, 47, 48, 50, 51, 53,54, 55, 56, 58, 59, 61, 62, 63, 65, 66, 68, 69, 70, 71,72, 73, 74, 76, 77, 79, 89, 94, 98, 100, 103, 126, 133,134: n = A,T,C or G
  misc_feature 140, 146, 155, 159, 163, 164, 169, 172, 173, 174, 180, 185,186, 187, 194, 195, 206, 209, 215, 216, 217, 219, 220, 229,230, 234, 238, 244, 245, 246, 264, 268, 273, 276, 277, 286,287, 293, 294, 295, 299, 307, 309, 312, 319, 321, 326: n = A,T,C or G
  misc_feature 331, 332, 333, 340, 347, 349, 350, 353, 357, 365, 368, 376,383, 390, 393, 394, 399, 402, 405, 406, 407, 410, 411, 412,429, 434, 439, 443, 447, 449, 460, 462, 467, 469, 473, 477,478, 482, 489, 492, 494, 495, 496, 498, 500, 501, 504: n = A,T,C or G
  misc_feature 506, 511, 512, 520, 525, 526, 527, 530, 534, 538, 540, 542,543, 544, 546, 554, 558, 566, 569, 572, 574, 577, 585, 588,590, 591, 593, 597, 600, 604, 605, 618, 621, 627, 628, 630,631, 632, 636, 639, 641, 644, 645, 647, 648, 653, 654: n = A,T,C or G
  misc_feature 659, 662, 666, 668, 669, 670, 671, 672, 676, 678, 679, 687,698, 705, 711, 712, 715, 718, 721, 730, 732, 737, 738, 739,741, 742, 744, 753, 755, 756, 757, 758, 761, 763, 767, 768,769, 774, 781, 782, 785, 787, 791, 794, 800, 801, 802: n = A,T,C or G
  misc_feature 805, 808, 809, 810, 815, 817, 819, 821, 823, 828, 831, 833,834, 835, 836, 837, 838, 841, 843, 846, 848, 850, 851, 853,854, 855, 858, 861, 865, 868, 871, 872, 874, 883, 885, 886,888, 890, 891, 896, 897, 901, 902, 906, 907, 909, 912: n = A,T,C or G
nnnngggnnnnnnnnnnnnnnnnggggggggggggnngganngnggnngnngnnnngnngnnngnnannnnnnngnngnggcgtttccnctttnctangntgnaaaaaaaacccggtttttggggngaaaaanngccccnaggccnaggggaatncccncaanncgggnaannngcgggnaaaannncggggcnnacggagggggnganagaagnnngnnaaggggagnngggnggcngcgggnnnaggcgatagggaaaaggngaangaggngcnnggggggganngagggnnnggangaccggangnganggaggcngngcagngggannnacggagnggggcangnngancgangaaggcgnagngaggaaanaaaaccngggaganggnngctgnagnaannnggnnnaggatgggaggaaaaancatanaaaanaggngccngnaggagagaatngnccccngnggangggnngggnacggggnaangnnnangnnagngnggggnngaagcggnggaannnagngggnaagngngnnngngagggggngcgnaggagagnggnggngnggngggagganaangnncngganccngagnnggggaggaagagnggngggganngnnnggangangnggnngnngggannggggnganaggngnnnnngggngnnatcaggcnggggagagganggaagcnggcggnncgnggngangagcaggcngngaggnnncnngnagagcgagngnnnngcnancggnnnagagnggagtcnnagngngganggngcgagnnnagngcnnngaggngnangngnagagnggngnnnnnnagngngcnangnncnnnggnggnagcntgngcnngngggaaggangnngngnngaggnnaagnnaggnngnggngagngcggnagngggcggacagncggggnggnnngagnnganangnagngnggggnngangaggngcgngantgnncganggcgcngncgggggagagnaganngnnggggngaggngngcngnnnanggnnggacggaggagnnggnnnaggnggggaggnngancgangnggnnanacggcgnggngngganggnngacnngagnggagggnngaggagagnggangggggggngngcnnggnaggggnaggngcgagnagncnacanganggggagngcg

SEQ ID NO: 3976 - DNA, 1195 bp, Homo sapiens; identical to SEQ ID NO: 3975
  misc_feature 1, 2, 3, 4, 8, 9, 10, 11, 12, 13, 14, 15, 16, 17, 18, 19,20, 21, 22, 23, 36, 37, 41, 42, 44, 47, 48, 50, 51, 53,54, 55, 56, 58, 59, 61, 62, 63, 65, 66, 68, 69, 70, 71,72, 73, 74, 76, 77, 79, 89, 94, 98, 100, 103, 126, 133,134: n = A,T,C or G
  misc_feature 140, 146, 155, 159, 163, 164, 169, 172, 173, 174, 180, 185,186, 187, 194, 195, 206, 209, 215, 216, 217, 219, 220, 229,230, 234, 238, 244, 245, 246, 264, 268, 273, 276, 277, 286,287, 293, 294, 295, 299, 307, 309, 312, 319, 321, 326: n = A,T,C or G
  misc_feature 331, 332, 333, 340, 347, 349, 350, 353, 357, 365, 368, 376,383, 390, 393, 394, 399, 402, 405, 406, 407, 410, 411, 412,429, 434, 439, 443, 447, 449, 460, 462, 467, 469, 473, 477,478, 482, 489, 492, 494, 495, 496, 498, 500, 501, 504: n = A,T,C or G
  misc_feature 506, 511, 512, 520, 525, 526, 527, 530, 534, 538, 540, 542,543, 544, 546, 554, 558, 566, 569, 572, 574, 577, 585, 588,590, 591, 593, 597, 600, 604, 605, 618, 621, 627, 628, 630,631, 632, 636, 639, 641, 644, 645, 647, 648, 653, 654: n = A,T,C or G
  misc_feature 659, 662, 666, 668, 669, 670, 671, 672, 676, 678, 679, 687,698, 705, 711, 712, 715, 718, 721, 730, 732, 737, 738, 739,741, 742, 744, 753, 755, 756, 757, 758, 761, 763, 767, 768,769, 774, 781, 782, 785, 787, 791, 794, 800, 801, 802: n = A,T,C or G
  misc_feature 805, 808, 809, 810, 815, 817, 819, 821, 823, 828, 831, 833,834, 835, 836, 837, 838, 841, 843, 846, 848, 850, 851, 853,854, 855, 858, 861, 865, 868, 871, 872, 874, 883, 885, 886,888, 890, 891, 896, 897, 901, 902, 906, 907, 909, 912: n = A,T,C or G

SEQ ID NO: 3977 - DNA, 791 bp, Homo sapiens
  misc_feature 10, 23, 24, 25, 28, 62, 68, 71, 95, 99, 101, 109, 112, 113,125, 137, 153, 155, 170, 211, 218, 223, 276, 283, 294, 301,308, 476, 602, 655, 707, 725, 749, 773, 780, 784: n = A,T,C or G
tgcctctttntgccttttgtaannnccnctttttgcaggatcccatcgattcggattagtangatttncangaaaaataaccaccgggtggggantaangngcccaaantcnngtcctaaatgcncagctttatgtnccctgtccaccatctngngcctcttctccattngcctcttccttcctatttcccttccgctaaggaaaaaaatnggggtcncattngtaaaagtaattttaatagttaatcatctctgagagtaacctgtattttaatngttgaancttaaccaaantaagatnctgtctnagctagggcttgtcatttgtgtatttagtgttaagataggaatgctagtgtctctttaattaattggaaatagatggaggctaaaaatgaaggtttttctttgaaactgaattaacttgggaatatttgttgttaaaacttctttttgcccaaaataactcattttgnattatctgaaaatatataatttctggcatgtgtatgttaaaatagaaaattttgaggaaaaatggaaatagggtggaaaagtactcggtaaacagtagtaaccaaatattttcactccagatttgngttttctcttggcaccagagtagatcttttgggaaaatatattatgaaaagtnggattaaagtttggactacccttatggttagcccccatctgggatgagaacnggttaccaaaggagtttngggcctcttaaggtggatttggtnccccagtggggtcaactttttgcnaaaattnccgnaatgggg

SEQ ID NO: 3978 - DNA, 781 bp, Homo sapiens
  misc_feature 1, 29, 114, 421, 422, 424, 427, 430, 439, 447, 448, 449,452, 454, 455, 457, 458, 461, 464, 465, 466, 468, 470, 471,472, 480, 486, 488, 492, 495, 496, 503, 505, 507, 509, 510,515, 516, 517, 519, 527, 528, 536, 562, 574, 576, 595: n = A,T,C or G
  misc_feature 603, 634, 644, 645, 653, 658, 674, 677, 710, 718, 736, 737,758, 765, 781: n = A,T,C or G
ncctttcaaacgcttgctcttgttctttntgcaggatccctcgattcgaattcggcacgaggtgaacacccgctgatcctttaacaaggatttctggcaggaaactcacaaaanggagaactgaaaatttagacatacagttggccattgtaaaaaacatcagtttcctctcatacattccaagtaaaccaagtaaaataagtgttggagtaacacttgcataaaagaatttaaggagtgatagctctttctgttctgccattcccaacattcctgggggaaaggagactcaatgagttaatactatttcactgagcccaagatggaaacttggtttgacctaaaacatctgattaatataggctagctgatttcttaaaaattcgttgcattgaaggatattttgcatgtctgtaacacnngncantcntggttggantggattcnnnatntnntnncanttnnntncnnntaattggncaaatnantttngcnntaaatantncngnntcctnnngncaaaatcnngaatcctnagggatggtccaaccccttttatggntggcctgaaaangngaagaatggggaattcctnttaaaccnttccattcaaaaaaaaaaaaaaaaaaacctnggcccttttnnaacttttnggggngcccgttttcccttanaanccgaccttggataggaaccattggatgaatttnggccaaanccccaacttggaatggcnntggaaaaaaaaggcctttaanttggggnaaatttggggaaggcn

SEQ ID NO: 3979 - DNA, 760 bp, Homo sapiens; identical to SEQ ID NO: 3917
  misc_feature 3, 9, 694, 718, 737, 747, 759: n = A,T,C or G

SEQ ID NO: 3980 - DNA, 813 bp, Homo sapiens; identical to SEQ ID NO: 3970
  misc_feature 19, 30, 91, 152, 159, 206, 211, 221, 247, 312, 351, 353,372, 423, 457, 466, 500, 510, 523, 536, 537, 542, 604, 635,643, 660, 671, 672, 673, 676, 677, 691, 737, 742, 754, 763,766, 804, 810, 811, 812: n = A,T,C or G

SEQ ID NO: 3981 - DNA, 744 bp, Homo sapiens
  misc_feature 2, 19, 25, 428, 596, 640, 649, 709, 713, 744: n = A,T,C or G
gntcaatacctgctactgntctttntgcggattccatcgttcgttcttcatgtttatatttcagagttcttaatagtgatacttaaatatactattttttccctgtactttcgaagatttggatatgagttttcagatttaaatgtgggaactcatttgagtataatccgtgaacagcatttgttcaacacatttttggggaggccctgctatatacaagtcattttccaagtcctactgaggtattggggttatccagattgtattatggagaagctagtggtctttaagaaataaagaaataaggctaaaactctttaacagggtagaaaggggcagttcataggggagggaaatagtatagaacattcatcctaggaatacaagtgaaatcactcaaattaccatgtagtcaatatacagattgntcagtgcctcctatgtgcccagcagtgtgctaggcccagggatacaatgaagaagaaccctgccctcaaaaaatgcagcctaaaagttttcttatggaaactggaaatcaagtttgggtctggcattagaggcttttcttaatgtattcacctggtgtgttcaggtantttctgaagatatagaaatgtttgatgaaatgaatgaagatacngaatggtangattccagtatcaagctctatctcataacagttacatttcctactaccttgcaaaccctntccntactattatttaatacccttttttcaccccn

SEQ ID NO: 3982 - DNA, 781 bp, Homo sapiens
  misc_feature 3, 12, 13, 15, 19, 24, 26, 29, 32, 36, 39, 43, 49, 51, 54,447, 540, 570, 677, 698, 731, 734, 759, 764, 780: n = A,T,C or G
aanccccttttnnangcgnttccntncanctnaaancgnttgnaactcncnctntctgcaggatcccatcgattcgctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatantgtgtgtatataagaaaaaatagatacacacattcttttttctcagtcaacacattgattgaacactctggcaaagatgctgtggtggatgangttggagttcgaaagaagaagcaagcgctngcctgccttgaaagaaccgaagtctttcccattcacttctctagaaagctgccaagacagaagcagaaagaaatgggatgatagttctgtcaaagcacacttctggnctcttagaaccttagaagtgnttctaagagaacagaagttattaagaagaaacnagntacgtgtgggaattcaacaaccttngggtnggaacccattggcttnt

SEQ ID NO: 3983 - DNA, 881 bp, Homo sapiens
  misc_feature 15, 18, 31, 163, 166, 180, 183, 187, 193, 198, 199, 200,206, 207, 217, 220, 223, 224, 241, 245, 247, 264, 269, 271,274, 276, 278, 287, 288, 295, 297, 299, 300, 301, 304, 305,310, 312, 314, 315, 316, 319, 324, 325, 330, 333, 335: n = A,T,C or G
  misc_feature 337, 340, 348, 350, 361, 384, 392, 399, 405, 407, 416, 436,437, 444, 445, 447, 456, 468, 479, 483, 494, 502, 505, 517,520, 522, 525, 534, 558, 568, 574, 575, 577, 578, 594, 597,601, 602, 608, 613, 618, 622, 627, 641, 649, 650, 658: n = A,T,C or G
  misc_feature 659, 662, 664, 665, 668, 671, 691, 694, 705, 706, 707, 709,713, 735, 747, 755, 756, 760, 761, 762, 765, 770, 775, 776,788, 798, 827, 833, 835, 839, 846, 847, 851, 854, 855, 865,876: n = A,T,C or G
ttcattccctggctntgntctttttgcaggnacccatcgattcgaattcggcacgaggttaaactgtcagtattggatcttagaagtaaatgattattaggactgtaatagtaattattaggactgtaaaaggtaaaggattattatctgcattagaatttcntanatctaaaggatttnganactngagacntttannnccaggnntcttttcctnaantcnnaaattccaaattcattngaantngggaaagtgatgggggnacaantngcntncnatccagggnntctaaantngnnncanntggcncncnnncgntaaanntactntantntnccntgagcccngntaaaaaactgngttaccccttgacgactagtggngattatcnatttttncccttnancgggccctnatttcttctaaccccccacnntgccttnntngatttaaanaaccttttgggngcaattccctncctntcctaatttangccccccngangagttttatccnccngnggnaataaattncccccaagggaattggaatccaanccccccaaanaaattnngnnccccccccttttaatnggnctgnnttgggntgggnaaaanaggnttttntttatccaaagccnggggtttnncaataaannagntnnccnggncccaataatatttttaaagngcnacccctttttnnnanaaanctttttccccccctttttttcnaggggggggggntattccanngggnnnaanccctnactgnnagggggccaatnttaaatgccnccccctttggcccttcacccccaaccccntttttntntttnttttttnnaccnaanncaaattccgntttttgggttnccccc

SEQ ID NO: 3984 - DNA, 725 bp, Homo sapiens
  misc_feature 1, 5, 13, 20, 22, 603, 634, 660, 682: n = A,T,C or G
nttcnataccttntctactngntctttttgcaggatcccatcgattcgggctcagaggggttatgattcggagggttctgccgcacggcatgggccggggcctcttgacccggagccaggcacgcgcagaggagcttttctctgggtaaagttgaggacgacagagggtattgtggttctgggttgtccccaacctccgactgtgtgtccttcaggacccgaaaccatggcccacactggcaggacagtgggtcggcttggggaagggggttagcttacctaccagagcttgtaggggctgtgcaggtgtatggctcccaaggcggcccttttcaggtggcaggtctcacatcattctccatttaagcttacagtcagactgattgataatcggtggcacagatgtgcattaagtcctgcccgtgttcaggatgctgtacttagtgctgttgcggtaaaggagtgaagagaagacgggattcagtgaatgttctggaaaatggctagagtgtacctagagagggaaaatttcaatagacagtaggccagttcaagactggatagaagccgggcgccgggcctgtaatcctagcactttgggangtcaagccggtggatcacctgagctcaaganttcgagagcacctgaccaacatggtnaaacaccgcttttctaaaaatncaaaattagctaggtgtggtggtgggctcctgtaatccaggac

SEQ ID NO: 3985 - DNA, 745 bp, Homo sapiens
  misc_feature 10, 11, 15, 617, 622, 653, 704, 718, 741, 745: n = A,T,C or G
ctaatagctnngccnactcgctctttctgcaggattcctcgattcgagaacatgaaggtagcacagaaaaagagatgctgtcttgcagggaatgttttatttcaggaaagatatttgcaaaggtggcaatgcagtggtggatggttgtggcaaggcccaaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtgggaaagtaaaactgactcatccaactagacattctacagaaagaaaaaatgcattattgacgaactggctacagtaccatgcctnttcanccagcccggtgtgtataatatgaaagaccanatgatagaactgtactgttttctgggccagtgacccagaaattggattaangctttctttggtanggtaaatctagaagtttatacantggn

SEQ ID NO: 3986 - DNA, 926 bp, Homo sapiens; identical to SEQ ID NO: 500
  misc_feature 18, 40, 229, 259, 273, 311, 372, 382, 423, 425, 432, 449,450, 451, 456, 457, 459, 462, 467, 471, 476, 482, 483, 488,490, 499, 501, 503, 505, 507, 508, 509, 512, 517, 518, 521,523, 525, 526, 529, 532, 534, 538, 540, 542, 543, 546: n = A,T,C or G
  misc_feature 548, 563, 569, 583, 585, 587, 588, 591, 598, 614, 617, 621,624, 628, 629, 633, 638, 644, 645, 646, 652, 654, 656, 663,664, 666, 669, 675, 676, 677, 679, 680, 683, 685, 686, 690,691, 693, 694, 705, 709, 710, 716, 717, 722, 724, 725: n = A,T,C or G
  misc_feature 728, 739, 744, 745, 748, 752, 754, 757, 761, 766, 767, 768,773, 776, 777, 779, 785, 793, 794, 796, 798, 802, 810, 813,815, 821, 825, 827, 828, 829, 830, 836, 837, 838, 839, 840,843, 845, 849, 851, 852, 853, 854, 856, 859, 865, 868: n = A,T,C or G
  misc_feature 873, 875, 882, 883, 884, 885, 886, 887, 889, 891, 895, 898,902, 903, 904, 907, 908, 912, 913, 915, 920, 921, 924: n = A,T,C or G

SEQ ID NO: 3987 - DNA, 805 bp, Homo sapiens
  misc_feature 2, 6, 14, 22, 40, 582, 604, 608, 629, 639, 640, 644, 646,651, 655, 666, 682, 686, 696, 698, 699, 702, 711, 712, 722,723, 726, 732, 736, 755, 763, 773, 774, 778, 786, 788, 795: n = A,T,C or G
tnaagncctttctnttgctctntttgcaggattccatcgnttcgcagagctgtatcttcagtggtgtgatgaagctacagtaggggagatcactcatgctaggtatggatctccttacccttggcctctgaatcatattttggcctatcaaaaacagtgggaagtcaaacgtaagatgaaagctattggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacatttagatatttggtgtcagaattttaaaacccaaatttactggctttttggaaaccttcnaaattatattaatggtatcttnatgnattgtgcctttataattggcnattttggggnntttncnttttnaaanaaaaattcctngaaatttattttaaantccnggaataatgntnnggnaattcctgnnattccttggnnaantttttntggngttccctttgggaaaccantggccttngcctttttannaaanttaaaagncntttaaancaaacctggg

SEQ ID NO: 3988 - DNA, 851 bp, Homo sapiens
  misc_feature 3, 7, 11, 14, 17, 19, 30, 88, 230, 381, 566, 577, 603, 642,660, 682, 693, 694, 706, 718, 723, 725, 729, 732, 736, 737,738, 745, 796, 815, 816, 817, 819, 824, 827, 832, 844: n = A,T,C or G
gtncttngtgnctntcngnaactccctctntctgcaggatccctcgattcggagaggagcaggtgcagtgattcatacccactctatngcttttgtgatggccacccttctctttccaggacgggagtttaaaattacacatcaagagatgataaaaggaataaagaaatgtacttccggagggtattatagatatgatgatatgttagtggtacccattattgagaatncacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactattnatttgatattgccgtatcaatgaagaaagtaggacttgatccttcacagctcccagttggagaaaatggaattgtctaagccaaaagaaagtctaattatatacagagataaagctaaacgtaattattatttaaatgaaagctatttttttaaatgaaattggaaattttttcatggatgcctnctaaatttggncacttaaatacctgcaaaaatgggcncccctggaaacctcttctgaccatttggaatggtaattnggccttaataattccttnaataaattttttaaaaatgaangggcccccagnnggaaaaattggnaaaaaatttttnaatancntccnaanggtnnnctggggntaaattttttttaaaaatcccctttaaaccagcccaaaaattatttttggnccctttaaatttccctttnnntnaaaantantaccntcttcaggaagnaaattcc

SEQ ID NO: 3989 - DNA, 758 bp, Homo sapiens
  misc_feature 5, 12, 15, 21, 39, 366, 370, 450, 460, 464, 536, 565, 567,569, 586, 610, 627, 650, 666, 669, 686, 692, 695, 696, 720,739, 743, 755: n = A,T,C or G
gctcnatgcttngcnatcgcncctttgcggattcatccnttcgggaacttttgaagagaaaaattcgagctagagggattcttaaagccttaagttacttgaaatctatgtatttgcaaccctttgtctctggaatcatattacactaaactggaatctcaggctgaatgagaataacccagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttatagaggaattttttcactatgcanttcngtggatctttataaaatactgaccttctaattagattcaggtcagtcttaattaaagggggaaaaaaagcaacgcaagcncaaccacagnaacnccatattcccaaatgaaaggaaatttggtttaaaatttcacagcattaaacattactttttaaagtaaaacnagttcatttgaagaaagtatgtattgcancnantggaacatgggcctggngcttttgcagtggccttcaacctnctgtgcctgtctggaangggcgtgttcccaagagtgaganggagaagcctggtgtncangaaacgctcctattaangaaagnttnncttggccaccgggccaacggggcnaagaatggtttggggtggntttnacctcttatcantgc

SEQ ID NO: 3990 - DNA, 880 bp, Homo sapiens
  misc_feature 11, 33, 101, 106, 110, 112, 114, 127, 133, 148, 186, 189,192, 193, 194, 222, 259, 263, 322, 337, 341, 369, 370, 371,377, 414, 427, 431, 439, 455, 456, 461, 515, 538, 545, 549,563, 573, 578, 590, 601, 604, 615, 636, 642, 645, 667: n = A,T,C or G
  misc_feature 674, 676, 677, 692, 705, 710, 719, 721, 743, 747, 750, 778,791, 810, 812, 813, 814, 818, 828, 833, 835, 836, 838, 840,842, 857, 871, 879: n = A,T,C or G
cgctttttcanatcgttggctactcgttctttntgcaggatcccatcgattcgttgagaacctgcctctatcccagaatgtgctggagatttgacactcanatcantgtntngncttctgcttggcnccatancttaacctgcagtgncttcaaaatgcccaatgccttgtttcctattaccttanatngcnnnccagtctagggaagtctatgagaaagtngcatttaattaaagtttaaaaaaaaaaaggttgggcnttgnggctcatgcctgtaatcccagcactttgggaggctgacgcgggtggatcactaggtcangagttcaagaccagnctgnccaacatggtgaaaccctgtctgaactnnnaatacnaaaattagctgagcatggtggcgtgtgcctgtatctnagctactcacganctgnggcagganaatcgcttgaacccannaggcngaggctgcagtgagctgagattgtgccactgcactccaacctgggaggacaganctagactcagtctcaaaacccanaaaaaangccnttttttctggtttnaaatggtttnggaanactttttttttntttgggtcccntanccttttccctngaaacccctttttcttggaancccctnaancccaaaaatttttattagcccnttttttnannaaggggggtttaatncttaaaggggccntttanccttcaatncnaaaaaaaaaaaattgcccggcnaggnccnttttacccgagttgcaaatttaattttnaataacccaactntgggcctttaaaatttaanannnaagnttcttgggtnacccnanntntntnggggcccttttttgnaaaaccctttatangggggggng

SEQ ID NO: 3991 - DNA, 723 bp, Homo sapiens
  misc_feature 12, 26: n = A,T,C or G
caatgcctgctngtcgtcgttgcggntcatcgttcggttttttggtgaacactgattttattggtgtcttagatccctagtctacccaaataattttaacagtactgttttttctaatcctgaagtctgatatttatgactcattagcaggaatcaaaactagtgatcagtagaacactttcaaaataaaaatttggaatgcagacttttatgaaaatttaaaagtgctccttaacagaatatcatgggttttcctataaaacttctttaagtattgtaattccagtctgccccaacttaaaaaaaaattcttattaatatgtcagtcattaattgctagtttgggctctcattatttcctgttttttaacaattttgtgataattttattattggcaaattaatacatcaacacttaaatcattgactataataataccttctggctacctctgtatcaaccaaattctgtaggtgcaaacatataccagggaattcttactggcaaaatgatcaatctggagtgtgcatccactgtgaatggagcaaattgccctatacccattgataacctagctttcttagtttgtagatgtaggaaacaaaatagtgacagagagagaagggggtccacagggcatggtatatttatcagcagtggaaaaaaagtgcatagatcatttagtccaagaacttaaaactaaattgagccataatttactt

SEQ ID NO: 3992 - DNA, 735 bp, Homo sapiens; identical to SEQ ID NO: 499
  misc_feature 10, 21, 71, 73, 78, 85, 87, 88, 90, 97, 113, 128, 131, 156,157, 165, 166, 175, 180, 183, 193, 204, 233, 246, 275, 325,434, 437, 446, 451, 480, 511, 521, 539, 541, 547, 558, 565,570, 592, 609, 613, 618, 619, 621, 625, 651, 657, 673: n = A,T,C or G
  misc_feature 691, 692, 693, 694, 696, 698, 703, 713, 715, 720, 722, 730,732, 734: n = A,T,C or G

SEQ ID NO: 3993 - DNA, 798 bp, Homo sapiens
  misc_feature 19, 21, 24, 25, 28, 46, 52, 69, 126, 130, 138, 187, 188,193, 194, 220, 246, 257, 263, 272, 273, 279, 283, 293, 294,333, 337, 350, 361, 364, 370, 372, 387, 411, 436, 445, 446,468, 470, 471, 472, 485, 486, 494, 495, 500, 502, 523: n = A,T,C or G
  misc_feature 529, 535, 537, 556, 557, 575, 578, 590, 591, 593, 603, 611,618, 619, 625, 627, 628, 629, 632, 654, 656, 659, 663, 668,672, 678, 681, 684, 685, 690, 692, 707, 725, 731, 734, 735,736, 739, 745, 751, 760, 763, 773, 779, 781, 795, 796: n = A,T,C or G
  misc_feature 798: n = A,T,C or G
gcttctaatgcttttcgantngcnntcnttgcaggatttccaaatncttggntgcatcctctgatggcnctgtaaagatctggaatatgaagaccacagaatgttcaaatacctttaaatccctgngcancaccgcanggacagatattaccgtcaacagtgtgattctacttcctaaaaaccctgnncactnngtggtgtgcaacagatcaaacacggnggtcatcatgaacatgcaggggccanattgtcagaancttcanttctggtannagaganggtngggactttgnntgctgtgccctctcttcccgtggtgaatggatctactgngtangggaggactttgngctctactgtntcngttcancnactggcaaactgganagaactttgacagtgcaacgaganggatgtgaatggtattgcacatcancctcatcannaacctgattgctacctacagtnannnatggacttctaannctctggannccatnantcaacttttcttgtataaatnagctcnaaagcntntactttaaatgaagccatnntcatggtaatgtgctttnatntgttttttgccnncntgttctaaancaaatacnattgtcnnaaattnannnccncaaataaattttttgtggaaananttnatgnttttnaaanttagcnaanctnnccccntntctctttgtgtgaanattaagcttttaaagggnagtttnggnnntantccatnctttcnaaactgggntgnccggtcaacnttaaangntcaaacaattaaanncn

SEQ ID NO: 3994 - DNA, 732 bp, Homo sapiens
  misc_feature 2, 3, 9, 12, 21, 686, 711: n = A,T,C or G
gnntctatnctnggctcttgncttcttgcaggatttctaatgcttggattcggcacgagatcaccctggcacgttcccctcagctgggctctgcagggcagctaagattgggcactgatgttcctggcttcagtcctacccgggttatgcagctacggcttcatacatacaccagttgcactaacttgggatgaaaattaagttaaaaccagtagaaaatttcatcctatgttttggtggtaaaagaagcaaatgaacaaatgaatagaggctgccaaacagttgtctcaccaactgttccgactagctaacaagattagctaggtcatacctagtcgtaaaagaatactataagaactcagaaattcgacatatttctactacttgcttgtcatgtagataaacagattaaaagaaccataaaaaaacaaagagaaaataatagtaggattagagagcatgttatcatctcatgggctcacttggccttagaaagaggtgtttatccatcatgaatatgaatccaggggtctgaatggatataagagaaccaaatgtaacagaaatttaatatcattttttcctctgagatgaaacattttacattttccagtttattagataaaattactaaacatgttctagaccctggagttgtagattttatgatgttggctgctgtggantggccatgactgggttttcaaatgntaatttgatttctttttaatc

SEQ ID NO: 3995 - DNA, 910 bp, Homo sapiens
  misc_feature 3, 4, 5, 26, 27, 97, 98, 131, 138, 143, 149, 151, 153, 156,164, 169, 172, 186, 194, 197, 243, 250, 260, 298, 301, 307,316, 339, 364, 386, 387, 392, 397, 405, 412, 419, 426, 438,451, 455, 462, 470, 486, 491, 497, 503, 522, 532, 534: n = A,T,C or G
  misc_feature 535, 539, 541, 547, 548, 553, 574, 575, 581, 585, 586, 595,596, 597, 602, 604, 608, 610, 612, 614, 616, 629, 632, 633,637, 639, 641, 643, 645, 646, 647, 651, 653, 657, 658, 663,668, 671, 675, 677, 689, 691, 694, 696, 699, 705, 706: n = A,T,C or G
  misc_feature 710, 714, 719, 738, 742, 743, 750, 759, 761, 765, 770, 780,786, 787, 792, 796, 798, 800, 801, 810, 818, 820, 822, 823,827, 834, 837, 844, 855, 857, 858, 860, 863, 864, 870, 881,883, 891, 895, 898, 909: n = A,T,C or G
gtnnncttcattcaatccctttgcanntgctctttttgcaggatccctcgattcgaattcggcacgagcttgacttccaactgcccctgagatttgnnctccagtataaggggcaagcgggtgccctggancgtccantcctnattcancnancanggcttggnttttntgnaaaaacttgttggnagtcctgncanaaaagctgcggcggaaatgggcactgtggctttccccgtttcaggntggtggngattcctgtngggagtgagcaagaggaatacgccaaaaagggacagcngancctgcnggctgcaanactggtcagtgacctggatgcanactttttgactgaccctttagaccngagaaatcctaccgggccccanntttgncccantaacaaanttttcangttttgntgggttnggcccataaaanaagcaactggttngaanaaacaanttgaaacnttttcgggaaaaaaangctantttggngcaccntttgccgcaatttgggganattttccctngnnaaanangttttnnccccnttggttcgacaatttttcccnnaaatantctnncggggtctnnnaaaantntccngngngnanaaatttttttttnggnnctcntntnanannntttntnttgnngatcnaaaanaanttgntnatttgacaaatnangcncnaantataanntggnaaanccccncaaacctgttgaaaacaantgtnnccccccnaaatttttnanaaanactgnttggagaccnaaattnnttatnttcntnannaaaaaaaanttttgttngngnncccnctcaatntgngggtggnaacttttcatncnnanttnntttggntaggtaaattntnatcttctncttnaanaaaaaaattcnc

SEQ ID NO: 3996 - DNA, 755 bp, Homo sapiens; identical to SEQ ID NO: 3957
  misc_feature 2, 5, 6, 7, 16, 18, 30, 35, 537, 571, 605, 645, 707, 754,755: n = A,T,C or G

SEQ ID NO: 3997 - DNA, 805 bp, Homo sapiens; identical to SEQ ID NO: 3987
  misc_feature 2, 6, 14, 22, 40, 582, 604, 608, 629, 639, 640, 644, 646,651, 655, 666, 682, 686, 696, 698, 699, 702, 711, 712, 722,723, 726, 732, 736, 755, 763, 773, 774, 778, 786, 788, 795: n = A,T,C or G

SEQ ID NO: 3998 - DNA, 766 bp, Homo sapiens; identical to SEQ ID NO: 645
  misc_feature 2, 3, 4, 5, 6, 7, 8, 16, 20, 22, 38, 94, 115, 136, 171, 198,234, 244, 303, 313, 319, 332, 335, 355, 377, 393, 419, 429,465, 479, 481, 485, 491, 498, 500, 501, 521, 548, 553, 581,589, 597, 610, 622, 624, 640, 648, 659, 661, 671: n = A,T,C or G
  misc_feature 699, 703, 706, 722, 735, 743, 765: n = A,T,C or G

SEQ ID NO: 3999 - DNA, 778 bp, Homo sapiens; identical to SEQ ID NO: 785
  misc_feature 3, 10, 15, 20, 24, 32, 51, 57, 59, 60, 69, 72, 223, 752,768, 778: n = A,T,C or G

SEQ ID NO: 4000 - DNA, 745 bp, Homo sapiens; identical to SEQ ID NO: 662
  misc_feature 1, 3, 8, 9, 11, 13, 15, 19, 26, 33, 35, 84, 92, 251, 510,540, 545, 586, 598, 639, 640, 643, 656, 661, 673, 723, 736,740, 741: n = A,T,C or G

SEQ ID NO: 4001 - DNA, 762 bp, Homo sapiens; identical to SEQ ID NO: 661
  misc_feature 3, 4, 5, 6, 7, 8, 13, 22, 26, 28, 32, 38, 40, 43, 111, 113,300, 304, 306, 324, 341, 351, 355, 363, 364, 365, 373, 388,391, 396, 400, 405, 409, 411, 427, 435, 439, 440, 445, 450,453, 462, 465, 467, 475, 477, 490, 536, 544, 581, 600: n = A,T,C or G
  misc_feature 604, 614, 616, 639, 645, 646, 666, 667, 668, 680, 689, 692,700, 703, 706, 735, 750, 755, 758: n = A,T,C or G

SEQ ID NO: 4002 - DNA, 755 bp, Homo sapiens
  misc_feature 3, 10, 13, 37, 45, 276, 297, 298, 304, 337, 354, 366, 369,376, 378, 386, 387, 393, 399, 404, 406, 433, 447, 448, 477,484, 493, 503, 505, 522, 523, 582, 597, 602, 611, 641, 645,655, 698, 705, 709, 722, 728, 741, 744, 755: n = A,T,C or G
tgntttcccnctnagatcctttctcacaaccttgtantgctgcangatcccatcgattcgcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaacatagaatttggatcctttggtcgggttctcccaaattcttttgaggtgtccatggtcaactgcttcagctttgtnttggcaaccccctgcccgaanncgcatntaggctgctcttcaccttgtttccaaggctgangaacagaaagtagcctntgttttgaggangtngaagttnantatacatnnattttntactgngactngntcaggaccacattttacaaaatgcctngtttccttcattgnntctggaaaggaaagttctattaatattgntttactntgaatatanaatagttttnantaattagggcttatttnnaaaaattctgagctaattcaaatgtatgccaataccttccaaagtaaggtaatattcanagacaagttgctgtnatcanatggcttanagaaaatctctggaatattcacattctaanattncttattaatngaatgtcctttgacttaaatctaccaaaaaactgcaacattantctttgncatnctcattatatagngttaanaagcttatttcanacnaataaaatctn

SEQ ID NO: 4003 - DNA, 753 bp, Homo sapiens
  misc_feature 3, 9, 14, 16, 34, 582: n = A,T,C or G
ttncccccnttttntncctttgtctcatccttgngccttttgcaggatcccatcgattcgcgtctgtaatcccagctgcttgggaggctgaggcaggagaatcacttgaaccctggaggtggcggttgcagtgagcacagatcatgccactgcactccagcctgggcaacaaaacgagacttcgtctcaaaaaaaaaaaacatagaatttggatcctttggtcgggttctcccaaattcttttgaggtgtccatggtcaactgcttcagctttgttttggcaaccccctgcccgaagtcgcatataggctgttcttcaccttgtttccaaggctgaggaacagaaagtagcctctgttttgaggaggtggaagttaagtatacatttattttttactgtgacttgttcaggaccacattttacaaaatgccttgtttccttcattgtttctggaaaggaaagttctattaatattgttttactttgaatatagaatagtttttttaattagggcttattttgaaaaattctgagtttaattcaaatgtatgccaataccttccaaagtaaggtaatattcanagacagttgttgtgatcagatggcttagagaaatttctggaatattcacattcgaagattccttattaatgaatgctttgacttaaatctaaccaaaaactgcaacattattctttgtacattttcattatatagtggtaacaagcttagttgcaaacaaatgaaatactt

SEQ ID NO: 4004 - DNA, 759 bp, Homo sapiens; identical to SEQ ID NO: 685
  misc_feature 3, 7, 8, 10, 11, 21, 30, 112, 113, 114, 473, 581, 690, 741,754: n = A,T,C or G

SEQ ID NO: 4005 - DNA, 783 bp, Homo sapiens; identical to SEQ ID NO: 658
  misc_feature 17, 29, 281, 355, 372, 392, 411, 412, 478, 520, 530, 546,583, 597, 611, 620, 622, 625, 626, 638, 640, 672, 673, 700,715, 718, 723, 733, 747, 763, 775: n = A,T,C or G

SEQ ID NO: 4006 - DNA, 772 bp, Homo sapiens; identical to SEQ ID NO: 690
  misc_feature 1, 3, 31, 39, 430, 674, 675, 681, 683, 685, 709, 716, 725,731, 749, 772: n = A,T,C or G

SEQ ID NO: 4007 - DNA, 759 bp, Homo sapiens; identical to SEQ ID NO: 644
  misc_feature 3, 4, 5, 7, 25, 46, 52, 74, 76, 79, 102, 103, 116, 130, 133,135, 137, 145, 155, 160, 161, 162, 169, 172, 182, 183, 188,190, 193, 197, 198, 204, 215, 227, 228, 236, 240, 248, 254,258, 264, 265, 266, 268, 270, 271, 280, 283, 284: n = A,T,C or G
  misc_feature 287, 290, 296, 297, 298, 302, 307, 310, 317, 337, 341, 342,346, 348, 360, 361, 368, 369, 371, 380, 381, 384, 390, 396,411, 412, 413, 420, 421, 436, 441, 444, 452, 457, 461, 463,465, 475, 483, 486, 494, 500, 501, 506, 515, 518, 522: n = A,T,C or G
  misc_feature 524, 530, 545, 546, 547, 552, 558, 563, 567, 576, 580, 590,606, 612, 617, 620, 639, 643, 657, 665, 676, 679, 683, 686,703, 709, 717, 733, 751: n = A,T,C or G

SEQ ID NO: 4008 - DNA, 853 bp, Homo sapiens; identical to SEQ ID NO: 637
  misc_feature 8, 11, 20, 21, 37, 44, 57, 79, 104, 245, 424, 506, 509, 609,628, 637, 647, 653, 678, 682, 687, 700, 703, 711, 731, 735,744, 751, 754, 760, 764, 765, 773, 775, 792, 804, 820, 825,827, 831, 841, 847, 852: n = A,T,C or G

SEQ ID NO: 4009 - DNA, 767 bp, Homo sapiens; identical to SEQ ID NO: 620
  misc_feature 19, 131, 158, 159, 402, 512, 518, 529, 549, 559, 601, 606,635, 650, 652, 655, 656, 670, 687, 688, 690, 701, 706, 712,721, 724, 732, 733, 738, 752, 754, 758, 763, 767: n = A,T,C or G

SEQ ID NO: 4010 - DNA, 767 bp, Homo sapiens; identical to SEQ ID NO: 620
  misc_feature 19, 131, 158, 159, 402, 512, 518, 529, 549, 559, 601, 606,635, 650, 652, 655, 656, 670, 687, 688, 690, 701, 706, 712,721, 724, 732, 733, 738, 752, 754, 758, 763, 767: n = A,T,C or G

SEQ ID NO: 4011 - DNA, 767 bp, Homo sapiens; identical to SEQ ID NO: 620
  misc_feature 19, 131, 158, 159, 402, 512, 518, 529, 549, 559, 601, 606,635, 650, 652, 655, 656, 670, 687, 688, 690, 701, 706, 712,721, 724, 732, 733, 738, 752, 754, 758, 763, 767: n = A,T,C or G

SEQ ID NO: 4012 - DNA, 754 bp, Homo sapiens; identical to SEQ ID NO: 619
  misc_feature 8, 23, 34, 36, 42, 450, 570, 590, 596, 602, 610, 616, 618,655, 658, 663, 704, 706, 722, 728, 746, 748, 752, 753: n = A,T,C or G

SEQ ID NO: 4013 - DNA, 734 bp, Homo sapiens; identical to SEQ ID NO: 660
  misc_feature 5, 6, 9, 13, 671, 715, 716, 731: n = A,T,C or G

SEQ ID NO: 4014 - DNA, 730 bp, Homo sapiens; identical to SEQ ID NO: 718
  misc_feature 4, 10, 11, 12, 16, 22, 721: n = A,T,C or G

SEQ ID NO: 4015 - DNA, 757 bp, Homo sapiens; identical to SEQ ID NO: 494
  misc_feature 1, 4, 8, 9, 17, 22, 26, 29, 35, 41, 47, 526, 621, 664, 669,707, 719, 747: n = A,T,C or G

SEQ ID NO: 4016 - DNA, 805 bp, Homo sapiens; identical to SEQ ID NO: 783
  misc_feature 2, 6, 17, 21, 26, 30, 37, 49, 62, 63, 66, 67, 69, 211, 213,434, 544, 555, 563, 564, 599, 600, 607, 615, 617, 618, 626,627, 636, 639, 640, 643, 646, 652, 653, 654, 659, 669, 671,672, 673, 701, 706, 709, 712, 719, 775, 777, 785, 793: n = A,T,C or G
  misc_feature 802, 804: n = A,T,C or G

SEQ ID NO: 4017 - DNA, 886 bp, Homo sapiens; identical to SEQ ID NO: 782
  misc_feature 4, 5, 6, 7, 8, 9, 10, 12, 18, 24, 28, 43, 58, 60, 62, 71,81, 84, 87, 88, 89, 95, 97, 102, 103, 107, 108, 113, 114,116, 118, 120, 127, 131, 135, 136, 137, 138, 140, 141, 144,146, 147, 148, 154, 155, 158, 160, 165, 166, 167, 168: n = A,T,C or G
  misc_feature 169, 172, 175, 177, 178, 179, 181, 183, 185, 186, 195, 196,201, 203, 206, 208, 209, 210, 213, 216, 217, 222, 223, 224,225, 233, 236, 237, 239, 245, 248, 249, 250, 252, 255, 265,267, 271, 272, 302, 305, 309, 311, 320, 324, 329, 330: n = A,T,C or G
  misc_feature 333, 334, 339, 348, 371, 374, 379, 383, 388, 400, 408, 413,418, 422, 425, 426, 427, 428, 430, 432, 438, 439, 440, 441,443, 449, 459, 460, 461, 462, 463, 465, 481, 482, 484, 486,487, 489, 490, 498, 499, 510, 511, 529, 530, 533, 534: n = A,T,C or G
  misc_feature 536, 537, 538, 547, 549, 560, 568, 569, 572, 573, 576, 581,587, 588, 594, 595, 610, 615, 618, 619, 620, 621, 622, 625,626, 629, 633, 634, 643, 645, 651, 659, 660, 663, 664, 679,683, 684, 692, 699, 701, 703, 704, 707, 708, 709, 714: n = A,T,C or G
  misc_feature 719, 721, 724, 727, 729, 730, 732, 733, 737, 741, 743, 745,747, 748, 750, 755, 756, 764, 767, 768, 772, 776, 779, 781,790, 791, 794, 796, 798, 801, 805, 806, 817, 820, 824, 825,828, 830, 832, 835, 837, 838, 840, 842, 844, 845, 851: n = A,T,C or G
  misc_feature 853, 854, 859, 862, 866, 868, 869, 871, 873, 874, 875, 876,877, 880, 886: n = A,T,C or G

SEQ ID NO: 4018 - DNA, 781 bp, Homo sapiens; identical to SEQ ID NO: 779
  misc_feature 7, 9, 10, 11, 16, 22, 25, 43, 53, 58, 59, 218, 219, 221,716, 737, 745: n = A,T,C or G

SEQ ID NO: 4019 - DNA, 775 bp, Homo sapiens; identical to SEQ ID NO: 778
  misc_feature 2, 6, 7, 10, 23, 24, 37, 41, 46, 48, 451, 549, 663, 678,688, 691, 719, 724, 734, 757, 765: n = A,T,C or G

SEQ ID NO: 4020 - DNA, 754 bp, Homo sapiens; identical to SEQ ID NO: 669
  misc_feature 3, 14, 626, 634, 659, 664, 669, 681, 687, 694, 704, 714,719, 728, 743, 753: n = A,T,C or G

SEQ ID NO: 4021 - DNA, 743 bp, Homo sapiens; identical to SEQ ID NO: 729
  misc_feature 3, 4, 5, 6, 9, 12, 15, 16, 17, 25, 32, 498, 515, 521, 655,666, 715: n = A,T,C or G

SEQ ID NO: 4022 - DNA, 786 bp, Homo sapiens; identical to SEQ ID NO: 610
  misc_feature 8, 9, 10, 12, 13, 25, 34, 37, 39, 40, 49, 50, 51, 54, 55,647, 665, 667, 674, 690, 721, 735, 745, 748, 768: n = A,T,C or G

SEQ ID NO: 4023 - DNA, 765 bp, Homo sapiens; identical to SEQ ID NO: 713
  misc_feature 7, 23, 37, 41, 43, 457, 626, 653, 679, 685, 686, 695, 698,700, 707, 720, 752, 756, 765: n = A,T,C or G

SEQ ID NO: 4024 - DNA, 783 bp, Homo sapiens; identical to SEQ ID NO: 712
  misc_feature 8, 10, 19, 20, 33, 37, 45, 48, 106, 107, 108, 206, 215, 257,276, 298, 304, 395, 400, 416, 420, 447, 454, 460, 479, 569,571, 576, 585, 601, 609, 612, 615, 625, 626, 631, 632, 637,644, 664, 676, 693, 699, 701, 704, 706, 712, 718: n = A,T,C or G
  misc_feature 721, 723, 725, 726, 730, 748, 751, 780: n = A,T,C or G

SEQ ID NO: 4025 - DNA, 760 bp, Homo sapiens; identical to SEQ ID NO: 706
  misc_feature 2, 11, 14, 17, 18, 26, 29, 79, 675, 737, 747: n = A,T,C or G

SEQ ID NO: 4026 - DNA, 769 bp, Homo sapiens; identical to SEQ ID NO: 703
  misc_feature 3, 4, 5, 7, 8, 9, 12, 13, 20, 28, 29, 37, 48, 669, 692, 702,705, 706, 757, 767: n = A,T,C or G

SEQ ID NO: 4027 - DNA, 748 bp, Homo sapiens; identical to SEQ ID NO: 692
  misc_feature 3, 12, 20, 616, 677, 701, 718, 724, 741: n = A,T,C or G

SEQ ID NO: 4028 - DNA, 755 bp, Homo sapiens; identical to SEQ ID NO: 691
  misc_feature 1, 9, 17, 38, 107, 571, 590, 597, 604, 607, 627, 633, 648,655, 660, 709, 717, 718, 734, 735, 739, 744, 747, 749, 754: n = A,T,C or G

SEQ ID NO: 4029 - DNA, 1009 bp, Homo sapiens; identical to SEQ ID NO: 775
  misc_feature 4, 11, 15, 25, 26, 29, 57, 63, 65, 67, 69, 71, 72, 79, 80,84, 92, 94, 96, 100, 102, 108, 113, 114, 119, 121, 123,124, 128, 140, 143, 147, 152, 154, 157, 163, 165, 168, 173,177, 178, 179, 181, 186, 191, 193, 202, 204, 207, 215, 217: n = A,T,C or G
  misc_feature 225, 227, 235, 241, 245, 252, 256, 260, 263, 271, 278, 279,285, 290, 293, 305, 310, 318, 322, 323, 330, 337, 342, 345,350, 351, 353, 356, 367, 374, 376, 391, 392, 395, 399, 405,422, 440, 441, 442, 445, 446, 452, 458, 460, 467, 479: n = A,T,C or G
  misc_feature 482, 486, 487, 489, 492, 493, 494, 495, 505, 513, 519, 520,527, 541, 543, 546, 547, 548, 553, 555, 571, 572, 574, 576,581, 584, 597, 598, 614, 617, 621, 624, 630, 632, 633, 634,635, 644, 647, 649, 650, 652, 662, 663, 664, 672, 673: n = A,T,C or G
  misc_feature 678, 682, 686, 690, 702, 704, 706, 708, 716, 722, 724, 733,739, 742, 745, 748, 755, 761, 765, 768, 775, 781, 785, 790,793, 795, 796, 807, 813, 815, 820, 822, 823, 830, 831, 834,842, 843, 844, 845, 850, 853, 854, 856, 859, 870, 872: n = A,T,C or G
  misc_feature 874, 876, 880, 885, 886, 887, 888, 889, 892, 902, 905, 906,910, 917, 918, 919, 921, 934, 939, 950, 956, 957, 963, 969,974, 978, 981, 984, 1001, 1009: n = A,T,C or G

SEQ ID NO: 4030 - DNA, 840 bp, Homo sapiens
  misc_feature 6, 7, 11, 16, 17, 21, 26, 28, 30, 37, 42, 47, 53, 55, 61,92, 93, 96, 97, 98, 131, 214, 256, 353, 412, 464, 477, 494,498, 506, 519, 537, 621, 685, 699, 702, 707, 713, 721, 722,737, 740, 745, 748, 752, 754, 756, 758, 759, 768, 772: n = A,T,C or G
  misc_feature 775, 800, 818, 819, 822, 835, 839: n = A,T,C or G
cggatnncgtnagganngatngtagnancntcgctcnccctntgagnaagggngngcgaantcggcacgaggacccaggtagaccagctcannagnnntttttctttgtcatcctcctgtgagctctctgnaagtctctttcttgcccatcaccacatccctagtactgggtatcagtctggccacttggctttctggtttgccccaatgtggnctattcttgatgcagctaccaaagtaatgttttaaaaccatnataccaagttactatccttgcaaaacccccagtaactgccaatctcacttagaataaaatccggactcctgtgaagcacacataactgggccactgnctatgcagcaacctcatctttaccgtttcctgccttgctcactccctttcaagcgccgntattcttcctgatgccctagtacacaacaactccttctgcttcaaagagtangaaaattactggnctctctgccagtgagantccncttctggnattacccttgctncaattgctgaaacttctncaaatatcaaccttctaaaaaagagcccttttaaaaacacccttttctaatatggcccctactcaaatttccaagtcccctggnaattgggcccaatttcccccaactttcaataagcaaccttaaatgggctaatcctggaaaattnacccccctaaaaanggngcaancctttnaatggaanngggtaagggccaaanttnaattnggncctntngngnnacctggggnaaanggnccctaggaaggaaacccaagccaancttggggcttcaaaaaanntanggggcaaccttcnaaana

SEQ ID NO: 4031 - DNA, 739 bp, Homo sapiens; identical to SEQ ID NO: 420
  misc_feature 4, 6, 7, 24, 33, 36, 39, 41, 42, 44, 50, 633, 666, 739: n = A,T,C or G

SEQ ID NO: 4032 - DNA, 738 bp, Homo sapiens; identical to SEQ ID NO: 419
  misc_feature 2, 3, 4, 6, 12, 17, 20, 23, 24, 32, 36, 38, 39, 41, 42, 44,45, 46, 52, 54, 527, 608, 684, 687, 693, 729: n = A,T,C or G

SEQ ID NO: 4033 - DNA, 757 bp, Homo sapiens; identical to SEQ ID NO: 418
  misc_feature 6, 7, 9, 10, 11, 35, 37, 63, 67, 475, 633, 706, 708, 736,757: n = A,T,C or G

SEQ ID NO: 4034 - DNA, 773 bp, Homo sapiens; identical to SEQ ID NO: 413
  misc_feature 2, 3, 5, 6, 7, 8, 9, 10, 26, 27, 28, 29, 30, 31, 35, 40,50, 55, 154, 192, 509, 541, 567, 589, 647, 665, 692, 727,729, 731, 752, 770: n = A,T,C or G

SEQ ID NO: 4035 - DNA, 773 bp, Homo sapiens; identical to SEQ ID NO: 411
  misc_feature 2, 4, 6, 7, 8, 10, 14, 38, 52, 60, 134, 181, 529, 600, 608,640, 667, 681, 683, 692, 727, 729, 746, 747, 751, 754, 761,770, 771: n = A,T,C or G

SEQ ID NO: 4036 - DNA, 754 bp, Homo sapiens; identical to SEQ ID NO: 614
  misc_feature 6, 14, 20, 24, 27, 33, 36, 41, 100, 102, 518, 596, 628, 646,679, 711, 728: n = A,T,C or G

SEQ ID NO: 4037 - DNA, 856 bp, Homo sapiens; identical to SEQ ID NO: 405
  misc_feature 8, 25, 30, 33, 35, 42, 44, 46, 51, 270, 279, 292, 295, 305,307, 314, 320, 322, 323, 325, 343, 344, 350, 352, 361, 366,373, 385, 386, 389, 390, 391, 393, 401, 402, 405, 409, 413,414, 419, 421, 428, 429, 440, 444, 445, 449, 451, 457: n = A,T,C or G
  misc_feature 460, 461, 470, 473, 476, 481, 483, 484, 486, 487, 489, 497,499, 500, 510, 521, 524, 527, 531, 535, 538, 544, 545, 547,551, 555, 557, 558, 560, 561, 564, 565, 566, 568, 569, 571,574, 586, 587, 593, 595, 599, 600, 605, 607, 611, 612: n = A,T,C or G
  misc_feature 613, 614, 616, 619, 621, 622, 625, 635, 641, 643, 644, 648,658, 659, 673, 674, 676, 681, 683, 684, 687, 688, 696, 698,699, 707, 709, 710, 712, 713, 715, 717, 718, 723, 725, 737,740, 743, 745, 751, 753, 755, 760, 763, 767, 769, 772: n = A,T,C or G
  misc_feature 776, 777, 783, 785, 790, 791, 793, 797, 805, 806, 807, 808,813, 814, 816, 817, 818, 820, 821, 824, 826, 834, 836, 838,841, 842, 845, 846, 854: n = A,T,C or G

SEQ ID NO: 4038 - DNA, 753 bp, Homo sapiens; identical to SEQ ID NO: 422
  misc_feature 3, 5, 7, 8, 9, 11, 12, 16, 17, 27, 31, 34, 35, 39, 41, 42,44, 46, 48, 54, 99, 579, 708, 714, 716, 720, 753: n = A,T,C or G

SEQ ID NO: 4039 - DNA, 840 bp, Homo sapiens; identical to SEQ ID NO: 4030
  misc_feature 6, 7, 11, 16, 17, 21, 26, 28, 30, 37, 42, 47, 53, 55, 61,92, 93, 96, 97, 98, 131, 214, 256, 353, 412, 464, 477, 494,498, 506, 519, 537, 621, 685, 699, 702, 707, 713, 721, 722,737, 740, 745, 748, 752, 754, 756, 758, 759, 768, 772: n = A,T,C or G
  misc_feature 775, 800, 818, 819, 822, 835, 839: n = A,T,C or G

SEQ ID NO: 4040 - DNA, 840 bp, Homo sapiens; identical to SEQ ID NO: 4030
  misc_feature 6, 7, 11, 16, 17, 21, 26, 28, 30, 37, 42, 47, 53, 55, 61,92, 93, 96, 97, 98, 131, 214, 256, 353, 412, 464, 477, 494,498, 506, 519, 537, 621, 685, 699, 702, 707, 713, 721, 722,737, 740, 745, 748, 752, 754, 756, 758, 759, 768, 772: n = A,T,C or G
  misc_feature 775, 800, 818, 819, 822, 835, 839: n = A,T,C or G

SEQ ID NO: 4041 - DNA, 833 bp, Homo sapiens; identical to SEQ ID NO: 560
  misc_feature 5, 11, 14, 15, 16, 17, 22, 32, 40, 41, 42, 187, 226, 279,615, 635, 640, 666, 667, 673, 676, 692, 695, 720, 733, 762,769, 770, 772, 773, 774, 775, 776, 777, 778, 779, 780, 781,783, 784, 785, 786, 787, 788, 789, 790, 791, 792, 793: n = A,T,C or G
  misc_feature 807, 822, 826, 828, 830, 833: n = A,T,C or G

SEQ ID NO: 4042 - DNA, 733 bp, Homo sapiens
  misc_feature 3, 4, 5, 6, 27, 31, 216, 441, 443, 447, 448, 454, 498, 505,506, 523, 533, 560, 561, 589, 618, 634, 671, 677, 692, 694,696, 717, 718, 719, 722, 728: n = A,T,C or G
gtnnnnttcaatgcttggctctttccnacgnaggatcccatcgattcgccaggctagtcttgaactcctggcctcaagcaatcctcccacctcggcctcccaaagtgctgggattaaaggcgtgagccaccgtacctggcccttggtggaatctttagggttttctattcatacatataaaatcatatcattggcaaacagagataattttacttnctcctttccaatttggatgccttagatttcttttccttgcctaactgctctgtctagaactcccagcactatgctgaatagagtggcaagagcaggcatttgccttgttcctaaccttagagaaaaatccttcagccttttaccattgaggatgatgtttgctgttagtttttcataaatgatctatatcaggctgaataaatttctatttctaaaaaaaaaaantncttnnctttanaaaaaatgctaaaaaaaaaaaactcgagcctttaaaactatagngagtcgnnttacgtaaatccagacntgataagatncattgatgagtttggcaaaccacactnnaatgcagtgaaaaaaatgctttatttgngaaatttgggatgctattgcttaatttgnaacccttttaagctgnaataaacaagttaacaacaccaatggattcatttatngttcangttcagggggaggtntngnagggtttttaattccgggccnnnggnccaaancattt

SEQ ID NO: 4043 - DNA, 870 bp, Homo sapiens; identical to SEQ ID NO: 553
  misc_feature 1, 8, 34, 37, 98, 100, 102, 105, 113, 125, 135, 139, 145,147, 151, 161, 169, 173, 180, 186, 192, 201, 206, 208, 212,224, 245, 263, 266, 274, 298, 324, 349, 405, 417, 502, 519,537, 559, 573, 589, 613, 685, 702, 711, 729, 764, 770: n = A,T,C or G
  misc_feature 786, 791, 803, 816, 819, 822, 836, 846, 849, 862, 869: n = A,T,C or G

SEQ ID NO: 4044 - DNA, 733 bp, Homo sapiens; identical to SEQ ID NO: 552
  misc_feature 1, 9, 10, 103, 105, 123, 131, 202, 217, 219, 228, 235, 240,281, 300, 333, 451, 482, 485, 500, 523, 652, 657, 659, 668,672, 680, 714, 719: n = A,T,C or G

SEQ ID NO: 4045 - DNA, 748 bp, Homo sapiens; identical to SEQ ID NO: 410
  misc_feature 20, 46, 50, 55, 58, 64, 68, 80, 83, 88, 101, 108, 115, 127,182, 207, 217, 227, 278, 365, 462, 504, 562, 622, 623, 629,641, 645, 676, 690, 696, 702, 725, 729: n = A,T,C or G

SEQ ID NO: 4046 - DNA, 748 bp, Homo sapiens; identical to SEQ ID NO: 437
  misc_feature 3, 4, 5, 6, 7, 9, 10, 11, 13, 15, 16, 29, 35, 41, 45, 50,52, 53, 54, 56, 58, 59, 67, 603, 613, 668, 685, 686, 687,689, 698, 705, 708, 713, 736, 738, 739: n = A,T,C or G

SEQ ID NO: 4047 - DNA, 780 bp, Homo sapiens
  misc_feature 16, 19, 20, 21, 32, 36, 38, 53, 58, 62, 67, 218, 221, 532,691: n = A,T,C or G
ctaaatgctttggganagnnncccctttgaancctntnaaatcctttggcaanttgcnctcnctgtnggatcccatcgattcgaattcggcacgagagacagggagaagagaggaagagggagctgcaggtgccagaagagaacagggcggactctcaggacgaaaagagtcaaacctttttgggaaaatcagaggaagtaactggaaagcaagaagncanggtctaaaggagaaaggggtcccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtgacctgtttccaggtgcctcatatctcgtgactcagattcccgggactcagacagagtccagggctgaggaactgtcccccgcagctctgtctcccttgctagagcccatcagatgctctcaccagcccatttctctacngggctcctttttgactgaggagtcacctgacaaggaaaaacttctatcagtactttgatatgtcacagtttcatgtttatccagttcaatgtatttttaaatttttccttgagacttctttgactgatagattattgtgaagtgtgtttttaaaatttncaaatgtttaagggattttcatatctttcttaatgctgatttccaatttggattccctacaatgattctgggattcatctgctctggac

SEQ ID NO: 4048 - DNA, 796 bp, Homo sapiens; identical to SEQ ID NO: 608
  misc_feature 17, 30, 354, 361, 362, 398, 458, 463, 485, 492, 507, 520,530, 537, 565, 582, 589, 596, 630, 639, 650, 653, 665, 667,686, 693, 697, 706, 707, 710, 729, 730, 736, 737, 743, 751,754, 759, 762, 763, 767, 768, 769, 770, 773, 775, 787: n = A,T,C or G
  misc_feature 791, 792, 795: n = A,T,C or G

SEQ ID NO: 4049 - DNA, 769 bp, Homo sapiens; identical to SEQ ID NO: 600
  misc_feature 10, 16, 20, 28, 31, 191, 272, 417, 423, 430, 569, 585, 602,606, 614, 643, 656, 699, 726, 732, 743, 744, 758, 760: n = A,T,C or G

SEQ ID NO: 4050 - DNA, 749 bp, Homo sapiens; identical to SEQ ID NO: 586
  misc_feature 17, 39, 48, 78, 79, 83, 90, 93, 94, 106, 111, 116, 131, 144,149, 166, 167, 172, 175, 186, 187, 210, 212, 225, 230, 231,255, 258, 269, 278, 279, 284, 287, 293, 313, 314, 320, 326,331, 334, 337, 350, 378, 423, 430, 451, 456, 460: n = A,T,C or G
  misc_feature 466, 467, 508, 521, 546, 577, 579, 587, 598, 612, 613, 615,616, 629, 630, 646, 652, 663, 664, 665, 682, 684, 699, 701,704, 709, 711, 718, 734, 739, 747: n = A,T,C or G

SEQ ID NO: 4051 - DNA, 848 bp, Homo sapiens; identical to SEQ ID NO: 450
  misc_feature 2, 6, 29, 30, 31, 32, 33, 34, 35, 42, 43, 53, 62, 63, 69,71, 81, 85, 87, 92, 97, 100, 128, 203, 233, 299, 317, 332,339, 349, 380, 382, 386, 428, 446, 461, 480, 498, 502, 503,504, 507, 509, 510, 514, 522, 523, 524, 528, 529, 530: n = A,T,C or G
  misc_feature 531, 534, 535, 536, 539, 540, 542, 544, 548, 549, 551, 552,555, 558, 559, 560, 563, 567, 568, 570, 571, 577, 578, 579,582, 583, 585, 588, 589, 591, 592, 593, 597, 598, 599, 600,601, 602, 603, 604, 605, 606, 610, 617, 618, 619, 620: n = A,T,C or G
  misc_feature 622, 623, 624, 625, 626, 628, 629, 630, 631, 632, 633, 634,635, 636, 637, 638, 640, 641, 642, 643, 644, 646, 647, 648,649, 650, 651, 652, 653, 655, 656, 658, 659, 661, 662, 665,666, 669, 670, 671, 672, 673, 674, 676, 677, 678, 679: n = A,T,C or G
  misc_feature 684, 685, 687, 688, 692, 693, 695, 698, 699, 700, 701, 704,707, 708, 711, 712, 713, 714, 715, 716, 717, 719, 720, 722,723, 724, 725, 729, 730, 731, 732, 733, 734, 736, 738, 739,740, 743, 744, 745, 746, 747, 748, 749, 750, 753, 754: n = A,T,C or G
  misc_feature 755, 757, 758, 760, 762, 763, 764, 765, 766, 769, 770, 771,772, 773, 774, 775, 777, 778, 779, 780, 781, 782, 783, 784,785, 786, 787, 788, 789, 790, 791, 793, 794, 796, 798, 799,800, 803, 804, 805, 806, 808, 810, 811, 812, 813, 814: n = A,T,C or G
  misc_feature 817, 818, 819, 820, 821, 822, 823, 824, 825, 826, 828, 831,832, 833, 834, 835, 837, 838, 839, 840, 841, 842, 843, 844: n = A,T,C or G

SEQ ID NO: 4052 - DNA, 770 bp, Homo sapiens; identical to SEQ ID NO: 446
  misc_feature 5, 6, 7, 9, 10, 13, 16, 19, 25, 26, 27, 42, 50, 51, 59, 60,72, 74, 75, 78, 88, 363, 516, 533, 537, 583, 592, 602, 605,607, 609, 621, 651, 653, 662, 663, 673, 675, 677, 694, 700,726, 733, 737, 740, 749, 751, 752, 757, 759, 761, 765: n = A,T,C or G
  misc_feature 766: n = A,T,C or G

SEQ ID NO: 4053 - DNA, 727 bp, Homo sapiens; identical to SEQ ID NO: 421
  misc_feature 10, 23, 25, 28, 35, 36, 38, 46, 49, 513, 597, 598, 631, 658,660, 703, 705: n = A,T,C or G

SEQ ID NO: 4054 - DNA, 744 bp, Homo sapiens
  misc_feature 2, 3, 8, 21, 22, 28, 31, 33, 38, 42, 45, 49, 51, 52, 53,58, 61, 605, 624, 675, 677, 679, 698, 701, 706, 708, 717,719, 737: n = A,T,C or G
gnngctancctttcctattannttgganctntnttctntctncangtancnnntgcgntgncgaattcggcacgaggattttcgaaactcttcagctacttgcccttttttatctgaaaccatcataccttctgaaagaaaaaagcatatcttcattgacataacagaagtgagatggcccagtcttgatacagatggtaccatgatatatatggagagtggcattgtgaagataacatctttagatggtcatgcatacctctgcctgcccagatctcagcatgaatttacagtacattttttgtgtaaagttagccagaagtcagactcatctgcagtgttgcagaacaaataataaagccccaaaagataaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggagggaagagctgccttcgcctggtacaaagcacacatgtgtatacacatgggtcaagcagtgctggtctgtggctgcctgtccagangaatggaaatatcctttgnctttagcacttcattttcataataaaatcagcaatttgtctaaaaaaaaanananaaaaaaaactcgagccctntanaactntngtgaggccnanttacgttgaatccagacntgattat

SEQ ID NO: 4055 - DNA, 753 bp, Homo sapiens; identical to SEQ ID NO: 422
  misc_feature 3, 5, 7, 8, 9, 11, 12, 16, 17, 27, 31, 34, 35, 39, 41, 42,44, 46, 48, 54, 99, 579, 708, 714, 716, 720, 753: n = A,T,C or G

SEQ ID NO: 4056 - DNA, 763 bp, Homo sapiens; identical to SEQ ID NO: 430
  misc_feature 1, 7, 8, 9, 10, 11, 12, 21, 28, 29, 31, 32, 34, 35, 36, 38,39, 40, 41, 51, 58, 75, 80, 81, 82, 83, 496, 717, 721, 754: n = A,T,C or G

SEQ ID NO: 4057 - DNA, 819 bp, Homo sapiens; identical to SEQ ID NO: 426
  misc_feature 2, 5, 6, 10, 28, 32, 37, 38, 53, 58, 59, 62, 65, 66, 67,68, 69, 75, 76, 420, 528, 574, 595, 637, 647, 733, 739,743, 774, 812: n = A,T,C or G

SEQ ID NO: 4058 - DNA, 819 bp, Homo sapiens; identical to SEQ ID NO: 426
  misc_feature 2, 5, 6, 10, 28, 32, 37, 38, 53, 58, 59, 62, 65, 66, 67,68, 69, 75, 76, 420, 528, 574, 595, 637, 647, 733, 739,743, 774, 812: n = A,T,C or G

SEQ ID NO: 4059 - DNA, 844 bp, Homo sapiens; identical to SEQ ID NO: 423
  misc_feature 1, 4, 5, 6, 9, 10, 11, 12, 13, 14, 15, 18, 21, 31, 43, 50,51, 52, 53, 93, 106, 171, 299, 368, 370, 382, 421, 450,454, 462, 481, 496, 513, 558, 565, 577, 582, 589, 609, 614,627, 636, 649, 652, 663, 672, 677, 686, 692, 711, 714, 736: n = A,T,C or G
  misc_feature 741, 752, 754, 782, 805, 807, 815, 824, 835, 844: n = A,T,C or G

SEQ ID NO: 4060 - DNA, 753 bp, Homo sapiens; identical to SEQ ID NO: 422
  misc_feature 3, 5, 7, 8, 9, 11, 12, 16, 17, 27, 31, 34, 35, 39, 41, 42,44, 46, 48, 54, 99, 579, 708, 714, 716, 720, 753: n = A,T,C or G

SEQ ID NO: 4061 - DNA, 754 bp, Homo sapiens; identical to SEQ ID NO: 614
  misc_feature 6, 14, 20, 24, 27, 33, 36, 41, 100, 102, 518, 596, 628, 646,679, 711, 728: n = A,T,C or G

SEQ ID NO: 4062 - DNA, 761 bp, Homo sapiens; identical to SEQ ID NO: 445
  misc_feature 16, 21, 51, 53, 66, 70, 76, 78, 83, 84, 87, 89, 91, 93, 583,600, 605, 619, 637, 664, 666, 678, 761: n = A,T,C or G

SEQ ID NO: 4063 - DNA, 813 bp, Homo sapiens
  misc_feature 6, 15, 18, 19, 20, 21, 24, 25, 28, 29, 30, 34, 37, 38, 42,43, 52, 625, 635, 637, 708, 711, 728, 746, 761, 772, 802,812, 813: n = A,T,C or G
caaaancccttttgnaannnnccnnagnnntttnatnncctnnttgcaaatngcttggctactcgttctttctgcaggatcccatcgattcggaattatagtattgacgtgaatcccactgtggtatagattccataatatgcttgaatattatgatatagccatttaataacattgatttcattctgtttaatgaatttggaaatatgcactgaaagaaatgcggcccatttagaatagctcgtgttatggaaaaaagtgcactgaatttattagacaaacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttttggaactgtatctgagtaacagaggacagctgtttttaaccctcttctgcaagtttgttgacctacatgggctaatatggatactaaaaatactacattgatctaagaagaaactagccttgtggagtatatagatgcttttcattatacacaccaaaaatccctganggacattttnangcatgaatattaaacattttttatttcaagtaaccttttccccctgtgtaaagttactatgggttggtggnacnaactttcattctatagnatattaagtgggaaagtngggtgaaattctacnttttatggttnggagtgggcccaatgtctatcaaggagtgnacaaattaann

SEQ ID NO: 4064 - DNA, 776 bp, Homo sapiens; identical to SEQ ID NO: 784
  misc_feature 42, 45, 49, 52, 55, 104, 106, 146, 151, 167, 185, 202, 204,210, 232, 246, 275, 278, 285, 323, 329, 331, 356, 388, 390,398, 399, 400, 401, 415, 418, 496, 510, 526, 550, 552, 553,561, 563, 579, 584, 585, 591, 600, 620, 645, 663, 666: n = A,T,C or G
  misc_feature 672, 697, 706, 707, 712, 719, 724, 731, 746, 756, 763, 767,775: n = A,T,C or G

SEQ ID NO: 4065 - DNA, 715 bp, Homo sapiens
  misc_feature 46, 397, 405, 463, 484, 499, 521, 538, 601, 623, 625, 635,663, 680, 682, 684, 685, 688: n = A,T,C or G
ctgctgtcaaggcttgaagagccggcacactcaatggcaaacacangcaccgagtctgctctgaatcctggaggatctggccctcctctcaacccccactcacagtcaccgtcttacaactcagggccacctgggatcagtcatcagtcagggtgcgtaagccttgaataccaggtagcctcaggagtgaaaagataaatgtcctagatcattaccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatctgagaggccccatttnaaaaaganagaacatgggtggtacattgaggagtatttacattttataaaatgacttaaaaatttnaaggcattttttgagcatttncaattatatggaagnagttacttttacggaatagttnttgctcatggaactcanaacagatgaagcaccactgttacagaattaatgtgctccagaatgaaaatggtctcgtttctngtgaatttcaatggaagaagcncnacatttcctnaagaattcttttgagcccagtaattcantcctggctcaaaaaaangntnnttnggcattttcctaacatctggaccaaag

SEQ ID NO: 4066 - DNA, 715 bp, Homo sapiens; identical to SEQ ID NO: 4065
  misc_feature 46, 397, 405, 463, 484, 499, 521, 538, 601, 623, 625, 635,663, 680, 682, 684, 685, 688: n = A,T,C or G

SEQ ID NO: 4067 - DNA, 786 bp, Homo sapiens
  misc_feature 8, 18, 23, 44, 538, 617, 662, 672, 678, 685, 693, 699, 715,717, 718, 734, 738, 749, 757, 768, 769, 774, 778, 783: n = A,T,C or G
ttgtgaancccttttganacccntttgctacttgctctttttgntggatcccatcgattcgaacgttcccccgctacatagtctttcttttgtgttatttagtttaccatttcttttttccatcttgttataacctccacgagttgtgtctcttttgttttctacattatacccaacggctagcacataacaggcacccaatatatactgaacgaactaaggaatgaatgaaggaatgaatgaataggtggcttataggaaacccctggggccagggactctgcaacatcaccatgtaactttttctttgtgctgagaagcagagagaaacaatagaagatatctcttaatctctcaaggatgctactcccaggactgcttgcaatttccgaggagataagccacaagttacagaaaggaagcagctgtgtagggcctgcaagtttcctgctgcaagtcaccctatgttcagaagttaccctggctgggccaggcatggtggctcacgcctgtaatcccacactctggggaggctgangcaagtggattgcttgagtccaggagttttgagaccagcctgggcaacatggagaaaccccatctatcaaaaaaattanctgggtgtggtggcatgaagcctgtaatacccagcttccttgggnaaggcttaangtgggnagaaatnaccctganccccangggggtcaaaggctgntnnttaagccaagatcacngccnactggaccttnaagccctngggcaaacccnnaattnaganccctntct

SEQ ID NO: 4068 - DNA, 769 bp, Homo sapiens
  misc_feature 12, 19, 28, 29, 37, 87, 92, 118, 234, 517, 518, 570, 586,595, 619, 624, 662, 670, 676, 692, 710, 711, 712, 716, 727,728, 742, 749, 767, 769: n = A,T,C or G
ggatcttttatncctttgnaatcccctnnctttggcnaatcgcccgaattcggcacgagagttggagaacattatgctggagagagnttttnaagaaagggagatgttggaaacttcncaagctgctgctctgtttctgcccaaccgcatggtgcctggacctgactacaattcctacaaaagtgcctacagccccagcccagtggaaccaccaagcaaggacttctgtaattntttgcccacctgccttgatttaaccatgcagtattcagggtctgggaatatggaactaatttcttctaatgtcagcgtggccacaacttatagacagtatcccttgtcctcaagatttttaagtttggcccaagtgtggccccattagcgacaccctcctctaccagcaatgcctgctaaatgccaccacctcagttcaagccctgaagcctggggccagctgggacttgaagggagcacgagtccaggatggactcagtgcatagcaggacatgatgccatnnaaattggaaggttccctggtgctgcctcacacttcctgagatccagaccacnagaaagtgaccttcanggtcatcangctgtcccagagaggtccgcgttnttccnaccccgaccgggaatttctcttcccattgttgacaccngacttccntggcancttcaaaggggcattntcttaaccgaagattcannnaaanctaaacaccanngcacccctttggcnacttaanccattaaatccaattccncn

SEQ ID NO: 4069 - DNA, 915 bp, Homo sapiens
  misc_feature 2, 10, 17, 22, 27, 28, 29, 30, 31, 33, 39, 40, 41, 42, 48,52, 54, 56, 57, 59, 64, 66, 67, 68, 72, 73, 75, 77, 78,81, 83, 87, 91, 93, 95, 108, 124, 126, 132, 144, 145, 157,158, 174, 175, 176, 187, 201, 211, 219, 229, 232, 233, 234: n = A,T,C or G
  misc_feature 261, 263, 289, 305, 312, 382, 387, 388, 402, 431, 435, 451,453, 458, 466, 467, 470, 473, 483, 487, 495, 508, 520, 547,567, 570, 572, 574, 575, 580, 585, 589, 592, 595, 602, 605,607, 618, 620, 622, 626, 630, 632, 635, 636, 643, 644: n = A,T,C or G
  misc_feature 646, 647, 650, 651, 652, 654, 657, 661, 662, 663, 670, 671,672, 674, 676, 686, 687, 694, 695, 696, 700, 702, 708, 711,712, 717, 718, 719, 720, 724, 731, 732, 739, 743, 746, 749,755, 764, 766, 768, 779, 780, 781, 783, 789, 791, 812: n = A,T,C or G
  misc_feature 818, 825, 834, 836, 837, 842, 846, 848, 854, 855, 863, 866,868, 871, 874, 878, 880, 884, 887, 891, 892, 893, 894, 896: n = A,T,C or G
gnggaggggngggaagnggggngcagnnnnncnaaaacnnnngcacancaancncnnangaacncnnncagnncncnncgnanacancaangngnaaccctttcaaancgcttggcaaatcgcncncgctgnaggacccacganncgcacccagccnnctcctccaacgccctnnngatccaagatngagtaagagacatnggcagatgcngagaaggncaacccaatngtnnnaacttgcagaccgagggggagatgggntncagtctgcacatgactcgagcacagnccccccaccccacccngacttanaaaatccaaaccgactacaagaccagaaacaaaccacatgccagtcgcccccttgactgtacacacatgnggagnncagagccacccatngagagaggctgctcagctcagcaccctgngcanggcttcctagaactancncagancgggggannccntancccgtattcngggnagctgacnacaggatgcacgnagtgaaacccangggttaggggagaggacccaccctggnaaaaagccacgtaaaatggnacnancnntccanggcanccanggnccnactacantcncnagcacctccgngncncaanccgnantcnngagaaanngnntannncncangagnnncccggannncngnaatggccagnnaagctgnnncccncnggaacnagnnaacgnnnnggcntatccanngtcgacncctnccnggncgccanctcccaaangncncgaacgaggcnnngncagaananctctgttaaaagaacaccgancaggcnaaggccnccacttgananncctcnaggnanccgggnnggagaaanctnanaangantatnanactnggnaacnnnnanagcctctaaaaaaaaaccg

SEQ ID NO: 4070 - DNA, 769 bp, Homo sapiens
  misc_feature 3, 4, 6, 7, 10, 11, 12, 13, 14, 21, 25, 33, 41, 42, 57, 192,195, 473, 664, 713, 714, 739, 767, 768, 769: n = A,T,C or G
agnntnnttnnnnntataaancctntggaactncctctttnngttgatcccatcgantcgaattcggcacgaggcaaggttgtgacattgtcacttttttgttctagactcttttaaattttctgcatttgcctgaaaagcacccctgtaagaatagatttctcatggctctaaaaattattcccaagaatnccntacttggttcaaaagcagactgtttctcttcatttcatctcaaatcagacttctgggcaagatgttctttagagtaagcaaacctacaacctaaaaatctcttcaagaggcatctctggtcttgtgacaagacctcttcaaaaacccacagtaaaactcccctccctccagttggccaccagtctgccaccaaacatgaacaaattctgctgctaatcggtttcccttgtgatctggttcctgaggtcttcggatctgtgcaatgaattatttattgntttattaaaccgacagtggtgtcccagagaggaaccataaataaaatggaaatctggtgctgtgataaagtaataactagcattaatgagacctggttttcctttcagaaagtccagtatacctgtaacaaaggttaaagcaatttatatttaatttgcattctgatgttaacatttaaacagcaattctnacaaaaaatgcatcgagtctaattcttacctctatcaaaaaacaactgnntaaatttatgaccaacatttaaacnaaaaccaaaatggaaaattttctttttnnn

SEQ ID NO: 4071 - DNA, 778 bp, Homo sapiens
  misc_feature 4, 9, 24, 28, 31, 37, 563, 586, 614, 657, 681, 700, 722,724, 739, 741, 744, 748, 750, 767, 771, 772, 774: n = A,T,C or G
atcnatccntttctttatagcttngttnctngttctntctgcaggatcccatcgattcgttagtgtactggatgtcaggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaagagacattccaatatctgctcctcagtggcttttcggcctcagaggcctcagagcctggtgtcatgtggactggatatgcaggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcacaagatggtaaggttcgaatctttcgggtgatgggagttaagtgtgaacaggaactgggatttaagggccacacttcangggtatcccaagtctgctttctnccagaatcctatttgctgcttactgganggaatgatgggaagatcacgttgtgggatgcaaacagtgaaanttgagaaaaaaaccagaagaagtnccacaaaaaccgtaccccncaggaaggaaaaccctaaaaananggaaccttgcacccnanccngggntnggaaaatacctaacccntttnntnacct

SEQ ID NO: 4072 - DNA, 813 bp, Homo sapiens; identical to SEQ ID NO: 4063
  misc_feature 6, 15, 18, 19, 20, 21, 24, 25, 28, 29, 30, 34, 37, 38, 42,43, 52, 625, 635, 637, 708, 711, 728, 746, 761, 772, 802,812, 813: n = A,T,C or G

SEQ ID NO: 4073 - DNA, 818 bp, Homo sapiens
  misc_feature 2, 3, 4, 5, 6, 7, 8, 11, 12, 13, 14, 15, 25, 30, 32, 36,37, 38, 41, 44, 45, 46, 50, 52, 53, 55, 58, 63, 67, 70,78, 122, 240, 248, 769: n = A,T,C or G
gnnnnnnnttnnnnntttgcaaatnccttngnaaannnccnagnnntttnanncnttntttcnaatnctnggctactngttctttttgcaggatcccatcgattcgaattcggcacgagagnaatcaatatcttgaaaatggccatactgcccaaagtaatttgtaggttcagtgctatacccatcaaactatcattgactttcttcacagaattagaaaaaactactttaaatttcatntggaaccnaaaaaagagcccatatagccaagacaatcctaagcaaaaagaacaaattttgaggcatcatgctacctgacttcaaaatatactacaaggctacagtaatgaaaacagcatggtactggtaccaaaagagatatatagaccaatgaaacagaacagaggcctcagaaataatgccatacatctacaccatctgatctttgacaaacctgacaaaaggaatggggaaaggattccctatttaataaatggtgttgggaaaactggctagccttatgcaggaaactgaaactggaccccttccttacactttatacaaaaattaactcgattcattaaagacttaaaagtaagttctcaatgtataaaaaccctggatgaaaacctaggcagtccattcaggacatagcatgggcaaatacttcatgactaaaacacccaaagcaatgtcaaccaaaagccaaaattgacaaatgggatctaacctaaactaaaaaacttggtgtgcagttttattttgggantgtgtgtgggggtacctctgagttttcaaaaaatgaagaaagtaagtcc

SEQ ID NO: 4074 - DNA, 789 bp, Homo sapiens
  misc_feature 2, 8, 9, 15, 17, 18, 26, 37, 43, 203, 204, 650, 698, 732: n = A,T,C or G
gnttgaanncccttngnnttcaaatngattgttactngccttntgcaggatccctcgattcgaattcggcacgaggatagcttaaagcaagtttacaagtaattaaaatggacagtttgccattaaagatttttaatagtggttttgcagtgtactggcttgaattttctggacttgagttaactgaaggagagcctcaaacnntagtaacttcatttttaaaagttactagaatttggtatcctgatttatattgcagtgtttcaaaggtgtcactgtcagacaaatagaaacactgccaacttggtgtaacttaagctttcatttaactaaaacattcttttcttgcaaaacttatttttcatgatcatttttggttatttattatacttgattccaaaatagtacagccttgaatctataaaactgtgcagtcattatgccagaaattatcttaaatatataatgggtcaccttgctgttcaaagggtggtgcaaggtcctgcagcatcttacatctgtagcttgttagaaatgtaaactctcaggccccacaacttacttcctgcattttaacaagatccccaagggatatgtatgctcataaaaaattttgagacactggtttaaatggaaaatggatataaggnatgtataactggggggtggggtgagggtaggaaggcatttaccaactnagattttatttatttttgaaattaatcaattggnttaaatcctaatttatttacccaaataggggtcttttaaaaaaatattttttattcc

SEQ ID NO: 4075 - DNA, 789 bp, Homo sapiens; identical to SEQ ID NO: 4074
  misc_feature 2, 8, 9, 15, 17, 18, 26, 37, 43, 203, 204, 650, 698, 732: n = A,T,C or G

SEQ ID NO: 4076 - DNA, 766 bp, Homo sapiens
  misc_feature 3, 4, 7, 10, 11, 12, 55, 133, 193, 194, 441, 643, 645, 689,712, 720, 735, 737, 745, 747, 750, 753, 760, 766: n = A,T,C or G
ggnnttnaannngctctactgaatgcctttggaaaggcccccatcgtttcgaatncggcacgagctttagttcagataaaggaaacatccaaaaatactgagattagtaaaattttattcaaagtaggttccngctttgtcttgatctcaatccattctaactcctgatgtcatttaccgtgtgagatcttanncacaatcatgaaaagaatatgagcatttatcaaaactctctgacatctgtatgtttagaaatgaacttacacagcaaaatatgatttccttgcacttatttaatttttctaacttcaatttctacctatgtgtctctgccagtttgacctgattcagacacccagaacttgaataaagaagccctcttctattttcattcttaatgaatataccttttcccatgtccacattgagcctcccttctgngtactctgtctaatgcagccacatgtctagttccccctctctgtcaccaccctcacttcttctttcccatcttcttacttctttggtgtgacctcttgtaggacaacatgccatttctgattccccacacacataccctatcattgatacctaccctcaggattagattctgtctaagtaatttgtagagccatcaggcttnantaagtattgggactgcaagtcaacacccattatctcatcaaaangggatgctgtgttggggccaganggagaaangagagagagagactnanagagagangnccnganagagagnaagacn

SEQ ID NO: 4077 - DNA, 831 bp, Homo sapiens
  misc_feature 4, 12, 18, 31, 38, 39, 42, 43, 55, 56, 62, 64, 71, 81, 82,95, 97, 103, 105, 114, 116, 117, 118, 120, 130, 133, 134,135, 142, 144, 148, 150, 151, 155, 158, 160, 161, 164, 167,176, 189, 190, 194, 197, 198, 199, 205, 224, 225, 230: n = A,T,C or G
  misc_feature 268, 270, 300, 311, 320, 327, 339, 346, 349, 353, 354, 373,382, 386, 397, 402, 403, 407, 409, 416, 419, 430, 434, 435,445, 450, 452, 453, 458, 463, 468, 473, 481, 489, 490, 493,504, 517, 518, 523, 525, 526, 527, 528, 535, 536, 539: n = A,T,C or G
  misc_feature 545, 546, 547, 558, 559, 560, 561, 564, 566, 573, 576, 578,580, 581, 583, 589, 592, 602, 609, 615, 618, 624, 633, 636,640, 644, 647, 667, 673, 674, 675, 686, 694, 699, 701, 702,721, 728, 733, 737, 741, 744, 745, 748, 749, 753, 754: n = A,T,C or G
  misc_feature 757, 758, 760, 767, 768, 772, 777, 779, 781, 785, 789, 797,800, 802, 815, 819, 826, 827: n = A,T,C or G
gaancccttggntttgangccatttttaatnccttggnntgnnccctcgattcgnnccggcncnaggctcngtacagatgnntcttatcctgacntnacgaangncttaactgncnnntntatggtgacngtnnntgaggcngnatgncnnggancanannctnaanctgaaaggnacctagtgacganngctncgnnntccctntgcaaactggatacggtannggaanagggagcctctgtgataaacgagacgaggaggaactcncngacatatgagctcaccaccacactaaaggnactgtgcatgnctgctgacngggttcnatagcgctcaangaccagnatngacnnggacgatgagttaatgggnactagggcncaantgtgcgatcanagaannttcncnaagctcngcncatccttgganaacnntttgctttanaacancnnccttncgtgnctacncacancctatgcnacagactnnatnacctgaacaanggtttactcaagnnagacngnnnncctacgnncancttagnnnccagggaaccnnnntgncnttacaangtngntnnangtcctnagntgagcatacnacccagntggganctnctgacnagtttcctncanactngtcnccngagtgggaacggccaagatnaacccnnngccaaaacttnttacgacnttggncnnttcaaagatcaaggggggnatttaanaactngaancctntannccnnttcnnaanntncttttgnngacnttagnanangggntgancccgggcnatntntcaaaaatccttnttanttcaccnntgcc

SEQ ID NO: 4078 - DNA, 772 bp, Homo sapiens
  misc_feature 2, 3, 4, 8, 9, 10, 11, 12, 13, 14, 15, 16, 17, 21, 40, 43,212, 549, 690, 721, 725, 728, 729, 730, 731, 732, 733, 734,735, 738, 739, 740, 741, 742, 744, 745, 746, 748, 750, 751,756, 761, 762, 763, 764, 765, 766, 767, 770, 771, 772: n = A,T,C or G
gnnntttnnnnnnnnnntttncaaatcgctttggctactnggntctttttgcaggatcccatcgattcgcagaggctttgctagtatccttcaaccaatttctagtaaaaatatcctatataaccataattatcaaaaccagaaaaacaacattggtaggatactataaagtactaatcttattttggatttgacgaattcctacatgtttntttcttttttagtttgtactctaagaagttgtattacatgtacagattcgtgtaaccactgcaaccacataaaactaatgaacacaaagtccctcatgctacctttttatgcttacactccatccaaacctaactctgccaaccacttttctcctatcagtataatttcatcatttcatgaatatgataaaaataaaattgtttttgtaaatggtttttataaattttatataaataagttatatgaatttttattgatagagagtatgtaagcttttggcatttttgtcactcagcaaattactcctaaggtttatatgagttgatgaatagttgntttattatttttttttaccaccatgtatctaaccagatgaaagttgtttatatttgagagtagtatacatatttgatgtagtagtttatccatttcacctatgagatatatttgcactggttttcctgggtttaagtgctntaaataaagatgctgtgaaatctaaaaaaanaaanaannnnnnnnttnnnnnannntngnnatatnataannnnnnnccnnn

SEQ ID NO: 4079 - DNA, 790 bp, Homo sapiens; identical to SEQ ID NO: 491
  misc_feature 9, 18, 20, 31, 46, 48, 57, 62, 64, 66, 96, 126, 613, 639,768, 777, 790: n = A,T,C or G

SEQ ID NO: 4080 - DNA, 781 bp, Homo sapiens; identical to SEQ ID NO: 3982
  misc_feature 3, 12, 13, 15, 19, 24, 26, 29, 32, 36, 39, 43, 49, 51, 54,447, 540, 570, 677, 698, 731, 734, 759, 764, 780: n = A,T,C or G

SEQ ID NO: 4081 - DNA, 764 bp, Homo sapiens
  misc_feature 3, 6, 7, 8, 41, 482, 544, 652, 663, 666, 671, 678, 682, 696,705, 713, 727, 735, 741, 745, 748, 754: n = A,T,C or G
gtnttnnntttctttctaatagcttggatactcgttctttntgcaggatcccatcgattcgaattcggcacgagccaaaatggggtggggccgcagtggctcacgcctgtaatcccagcactttgggaggccgaggtgggcggatcacgaggtagggagatcaagaccatcctggctaacacggtgaaaccccgtctctactaaaaatacaaaaaaaaaacaaaaaaaactagccaggcatggtggcaggcacctgtagtcccagctactcgggaggcagaggcaggagaatggcgtgaacctgggaggtggagcttgcagtgagccaagatcgtgccactgcactccagcctgggtgacagagtgagacttcgtctcaaaaaaaaaaagaaaataggcacaataagtaatacatttctgcccaagtaagagccttcccttttgtggatgtaatgaaaatatcttcaagcactttataaatnaattatatgtctgatactagccttccattgcctggatcacatctgattgtcctggtaatttnagaaaagggtagccccttggtatggatagtagcttgatgacatggaattcagggaaaagactatgatggtgtcacttgtaactgcttttgtgctgtaaaattgtcatngattaaagaanaanaattngcttggntgcngtggcttacacctntaatcctancacttttnggaagccaaataanggacttgnttgganccangantttcangaacaacctg

SEQ ID NO: 4082 - DNA, 764 bp, Homo sapiens; identical to SEQ ID NO: 4081
  misc_feature 3, 6, 7, 8, 41, 482, 544, 652, 663, 666, 671, 678, 682, 696,705, 713, 727, 735, 741, 745, 748, 754: n = A,T,C or G

SEQ ID NO: 4083 - DNA, 768 bp, Homo sapiens
  misc_feature 11, 12, 15, 19, 20, 21, 32, 45, 51, 574, 599, 609, 645, 752,753: n = A,T,C or G
atggctttggnnagntccnnntctttcaaatncttggctactcgntctttntgcaggacccatcgattcgaattgtaacttattccaggataaatgtcatatgcatatgattttcatatgactttgatgagtatcttcagggaaaattcctaaaaatgaaattgctggattaaggggtaaatgcatgtatagttttgttagacagggccacatacccttccttagaggtagtacccttttgtattcctgccagtaatatatgagagtccacagagtatgtggttaagctttagaatgcttgtccatctgatagggaagaaatcgtgttgccttaatttgcccttcttttattatgaatcagattttaatcttttgcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcangttcacggggaggtgtgggaggttnttttaattcncggccgcggcgccaatgcattggggcccggtcccancttttgttccctttatgaggggttaattgcgcgcttggcgtaatcatggtcataactgattcctgggtgaaattgtatcccgctcacaattccccaccaacatccanncccgggagcataaaa

SEQ ID NO: 4084 - DNA, 957 bp, Homo sapiens
  misc_feature 2, 3, 10, 11, 12, 13, 15, 17, 19, 20, 22, 28, 29, 30, 33,34, 35, 40, 41, 43, 44, 46, 48, 50, 56, 57, 59, 60, 61,63, 64, 65, 66, 67, 82, 84, 85, 97, 108, 117, 121, 133,141, 154, 157, 159, 160, 167, 171, 183, 189, 191, 192, 193,198: n = A,T,C or G
  misc_feature 200, 204, 221, 225, 227, 237, 246, 249, 263, 273, 280, 286,308, 333, 345, 366, 378, 379, 381, 396, 397, 408, 420, 428,430, 454, 460, 466, 471, 493, 500, 515, 557, 559, 570, 581,606, 618, 623, 645, 667, 675, 677, 701, 704, 705, 720: n = A,T,C or G
  misc_feature 730, 734, 736, 741, 753, 755, 764, 785, 795, 806, 817, 824,828, 834, 835, 837, 845, 848, 854, 859, 860, 898, 902, 908,910, 913, 917, 919, 927, 928, 930, 936, 941, 953: n = A,T,C or G
annggagacnnnngngnanngngggggnnnacnnngaaanncnnanananacacannannnannnnngaggggcaacaaacncnnattttcgaaaancccttttgggngtgaccccnttcnaacacttgcttntcgccctntgcaggatcccancgnanncgaaggnggcncgaaagcacggngtcccnannngatgngnaaanatgaccgataaacttcngggncngataatgaanggcactatnggncatactgatgctgnctcatgggcnctaccanagacgngaactggaaaaggctctgcagngtctgggatacgctcagtgctgcangggagggcaggngtgaggggaatggccccgganggtgatggggcnngngcatccgatgcagcnntatagctctgnaattaccacttncaaacttntnattacgaaaaatgtcaaggacccnggaatnacaagngaggnaggcaggataatggcccccaanatgcccntgttgagacccccanaccttgagagtgcctcacatggggaagactgtcctacgtcancntgcacgcccanggcagccccangggcccttaaagcttgagagccttncctgctgagacngaganatgccagaagcaaggagaggcnagaacccgaggagggcccgcancctgcccngnatggcccttagaaggaagggcccnaannagcgtggtggccccnctaaagcaanctgngngaccnggggggaccctnangtacccaangcccctgcaaagcaaaacccngaaatttccnggccaaaccanacacccccaanggaatgngaanggaaanngngaaaaggnacncccctngaccnntgggccaaaaaccccttggaacccccctgaaaccttcnaccnaaaatngngtnaaancncccgcganngngacttnagtgngcaagcacacancccc

SEQ ID NO: 4085 - DNA, 789 bp, Homo sapiens; identical to SEQ ID NO: 490
  misc_feature 1, 7, 33, 80, 91, 92, 102, 105, 107, 114, 116, 118, 119,124, 129, 132, 137, 140, 149, 150, 152, 154, 160, 163, 190,204, 206, 221, 250, 275, 368, 377, 414, 419, 420, 444, 449,451, 456, 461, 463, 464, 473, 477, 509, 522, 524, 529: n = A,T,C or G
  misc_feature 531, 534, 536, 545, 546, 548, 550, 563, 565, 582, 591, 611,612, 613, 617, 628, 639, 643, 651, 654, 668, 680, 681, 682,687, 690, 692, 693, 695, 703, 710, 714, 733, 742, 761, 771,782, 783, 787, 788: n = A,T,C or G

SEQ ID NO: 4086 - DNA, 804 bp, Homo sapiens; identical to SEQ ID NO: 492
  misc_feature 3, 16, 17, 20, 24, 26, 41, 44, 49, 539, 651, 662, 700, 715,747, 759, 764, 779, 780, 781, 782, 783, 784, 785, 786, 793,799: n = A,T,C or G

SEQ ID NO: 4087 - DNA, 784 bp, Homo sapiens
  misc_feature 4, 8, 99, 188, 189, 195, 481, 509, 517, 521, 579, 597, 616,633, 634, 659, 664, 699, 700, 724, 726, 729, 736, 747, 766,769, 783: n = A,T,C or G
ttcnaatngcttgttcacgccctttctgcaggatcccatcgattcgaattcggcacgagcttctgttgattggtttgtttaaagtacctaagtactacnctttgactccctaccaaaagttcttttgttttttaaacaacttttatttgtgacttactttcttgagaagtgttcttaatgaattgcannacccantggtagcagcttatttcttaagtactttattatttgtgctttaccatttcaggttcttatctttaacccttatttactcagttttccatctgaatgatcctatctctaaattaaggatttaataaatgctgcaaattgtccactttgcaaattgtccaaaagctttagttttggaaccttgtgaactttttttttaataacacattatttgggccggtcgtggtggctcaagcctgtaatcgcagcactttggaatgcctaggcagacagatcacttaaggcctgnagttcgagaccagcctggccaatgtggngagacctncgtnctatttactaaaaatactaaaaaattagcaaggcatggtggtgcacgcctgtaatctnagctactttgagaggcanagttcaggagaattgcttngaaaccttgggaggcannagattgagcccaagaattggaccantgganttccacccctgggtgaccagagtgaagaaatcttnnctcaaaaaaaccataaaaaccctntnctntaaaatnaaaaaaaactntgagcctttttataacttnagntggagtcaggaatnc

SEQ ID NO: 4088 - DNA, 790 bp, Homo sapiens; identical to SEQ ID NO: 491
  misc_feature 9, 18, 20, 31, 46, 48, 57, 62, 64, 66, 96, 126, 613, 639,768, 777, 790: n = A,T,C or G

SEQ ID NO: 4089 - DNA, 784 bp, Homo sapiens
  misc_feature 2, 3, 17, 23, 57, 60, 61, 63, 65, 663, 698, 704, 773: n = A,T,C or G
gnnttttctaaatcccntttgcnttactccctctttcaaatcgcttggctacttgcnctnntngntttgcaggcatcccatcgattcgaattcggcacgaggaacaaagaaggaatgtcttcctcatgtttgggtctatagaagacgttaaagaaaacttccagaaagtgggtttgaggcatgagccaccacgcctggccaaaggatttaatgaattaatggatgtacagtgctggggctgttattctagggcctgcattgagactcacattttgccatcaaaagccttttaagaggtggaggttgcggtgagctgacatggtgccactgcactccggcctgagtgacagagtgagactctgtctcacaaaaaaaataatgccctttaaataatgaataatagtgatagaaaatgtcatttcttggacaaatgaaaaattgaaattaatgtatataattagatattattagctactcttaggtagcttcatttgttgaaagtttgacaagtgaatgaagttcacatctggaaatcgttgaacatttttcgttcatggaactcaatggctacgttagtccgtttatgcttttcactgttgtggtaggggctttggaagtaaatgccatcaacaatggatacagaagacctggatttggaataanggcaaaatttatttgatggggctgaattgctctgncaggancatttggtatgagatgaaatggcctctcttgagactgaactgccaacctggcaattattggctgctaanggttctctttt

SEQ ID NO: 4090 - DNA, 784 bp, Homo sapiens; identical to SEQ ID NO: 4089
  misc_feature 2, 3, 17, 23, 57, 60, 61, 63, 65, 663, 698, 704, 773: n = A,T,C or G

SEQ ID NO: 4091 - DNA, 776 bp, Homo sapiens
  misc_feature 6, 11, 20, 21, 22, 23, 24, 25, 26, 36, 267, 373, 462, 478,486, 533, 548, 565, 576, 606, 625, 641, 651, 652, 660, 662,667, 681, 722, 762: n = A,T,C or G
gtttcnaatancttgctttnnnnnnntcttcaaatngttggaccccctgcaggatcccatcgattcgaattcggcacgaggtgtgcttgtgaaatgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccatangagggaagttttggaaacacagaatgattccaaggtgctctcgttcctgagggggactggtttgtaacccatgacatctgtgggcgagagaggcagctgggagcangacacttggagggtcaccccacgggggtggcacctgcactctgagtgccccccactgtcatcagctgcctcttaccgtggacacagttntggttttggggactanggggcccnactcctggtggtaccgtttggacttactagggcagtgggacatatangcccggggctagtgngataacggggagttacncctgatgactnttttgatggaatcctgcattagatagcttngtgggaccccccccctcanaatttggggaactgangagaattccnngaaggtgncnttcanggagagcacctttnaaggggccccctaacttcctgagcctggaaattagaataancattaaaggggcatacacaccttttcccaaaaaacccctntccatttggttttt

SEQ ID NO: 4092 - DNA, 777 bp, Homo sapiens
  misc_feature 11, 13, 15, 16, 39, 50, 666, 671, 677, 719: n = A,T,C or G
gttctaatgcntngnntcatcctttcttcaaatgctgtngttcttttgcngatccctcgattcgaattcggcacgagaccctctctggccacatggaggcagtttcctcagttctgtggtcagatgctgaagaaatctgcagtgcatcttgggaccatacaattagagtgtgggatgttgagtctggcagtcttaagtcaactttgacaggaaataaagtgtttaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtctcctacccatgaacagcagctgatttcaggatctttagataacattgttaagctgtgggatacaagaagttgtaaggctcctctctatgatctggctgctcatgaagacaaagttctgagtgtagactggacagacacagggctacttctgagtggaggagcagaccaataaattgtattcctacagatattcacctaccacttcccatgttggggcatgaaaagtgaacaataatttgactatagagattatttctgtaaatgaaattggtaagagaaccatgaaattncatangatgcngatgcagaaagcaacctttttgaaagtttatataatggtttnacccttcataaccagcttaacctttcactttttcttattttggatttataaataagaa

SEQ ID NO: 4093 - DNA, 770 bp, Homo sapiens
  misc_feature 2, 7, 8, 9, 18, 35, 537, 633, 663, 675, 697, 710, 713, 724,728, 730, 741, 746, 748, 751, 755, 757, 761, 769, 770: n = A,T,C or G
gntcctnnntttcttatncttggctactcgttctntctgcaggatcccatcgattcgtagggattgaggaagatctagcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctgagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggangaggtccaagactaactgtgaaagccctgtgtaaggaatgtgtagtagaacgttgtcgcatattgcgtctgaagaaccaacttaatgaagattatnaaactgttaataatctgcttgaaagcagcnagtaaaaggccnatggattttggggtgggggaantcccttccttgcngantttggccccanctancntctttgaacancttgntnaancaanangggnggatgcann

SEQ ID NO: 4094 - DNA, 800 bp, Homo sapiens; identical to SEQ ID NO: 493
  misc_feature 3, 4, 6, 7, 11, 38, 42, 46, 54, 60, 79, 702, 713, 752, 755,784, 798: n = A,T,C or G

SEQ ID NO: 4095 - DNA, 1144 bp, Homo sapiens
  misc_feature 2, 3, 4, 5, 6, 7, 8, 9, 10, 11, 12, 13, 14, 18, 19, 20, 21,22, 23, 24, 25, 26, 35, 50, 60, 68, 71, 83, 84, 115, 116,129, 142, 170, 177, 197, 211, 255, 265, 281, 294, 297, 302,316, 328, 346, 354, 359, 368, 371, 380, 441, 443, 460: n = A,T,C or G
  misc_feature 461, 468, 470, 481, 489, 491, 493, 495, 503, 505, 509, 587,603, 652, 702, 775, 867, 910, 914, 922, 931, 966, 1012,1022, 1026, 1067, 1078, 1082, 1088, 1106, 1112, 1133: n = A,T,C or G
gnnnnnnnnnnnnntttnnnnnnnnntttttttgnaaaaaaatccccccnttttgggccnaaaaattnggnccctcctttttnntgggcaagggggaatccccccaaattttttnnaaaaccggaccantttttcgggggcnaaccggaaggaaaccaatttaaaggccncctctcncaaaccccccctttgggaanggggggaaattggnaaaggaaaccaaggccttttcccccctttgggccaaaggggccnaagggggccntgggttggcccccccnaaagtttccaaanttnttttnaaaaagggcccccnttaaccaaaagncctttgggggggcccttnggcccttnggggnccttggccnaanggggggttncctttggggaaaaggggggcccgggggttggggggggggaaaagggggtttggggccaaangnaacaaagaaaagtttannccaaaangnaaccccccccnaacttttncncntngggccctncntttnaacaagaaccttgccgttcaatggcccgggggccttggggaaccggcaagcaaaggcccctggcttctttctggcccnggccatgaaacaccgncatgttgggagcacccgatcacaagcgcaacaaggtagaccagctcaanggccttttggctatgtcgagatcccctgtgtggccaagaactggtgtgcngagatgaaagtctcggggccatggctgaagtggggaccatcgtggacaaagtgaaaagaaagtcctctttcancacaagtggctttcaacagaagttgacctgggatttctgtcatgggtgtccctctggactcaaaaatgggttcaaggcccaagtcggtgaanatggatgttggcaaaaataggaaggataccctcattttgctgnaatngggggaanctgctcttnaccttgcccaaggggccaaggcctggttcaggttnaaacttgggaccggaaaggcccaagtcttaatttcttttcaaaccnaggaaaaggnccgnttgccttaaaaaccccttcccaactttttcctgggatgggntgaaggcaaanccangaaaanccaagcaatggttgttcntcaacnggaaggaagggacttgaaccnaactggggaaa

SEQ ID NO: 4096 - DNA, 818 bp, Homo sapiens
  misc_feature 1, 8, 9, 11, 12, 14, 33, 36, 54, 102, 139, 216, 217, 219,380, 401, 482, 528, 537, 549, 567, 582, 611, 616, 619, 624,626, 629, 631, 638, 639, 648, 654, 663, 690, 691, 692, 693,696, 697, 703, 714, 716, 720, 722, 726, 739, 740, 746: n = A,T,C or G
  misc_feature 749, 751, 752, 755, 757, 760, 762, 765, 768, 769, 780, 787,788, 790, 791, 793, 794, 803, 807, 808, 809, 810, 811: n = A,T,C or G
ntttctanncnngntttcaaatcccttgcattngcncctttgtttgatcccatngattcgaattcggcacgagagaagattggggatgaggagtgaggagantgctggagaccagttagaggctaccgtagcagcgtanagaggctgaaaatctaactagggtggaagcagccaggcaggctggtcctaatgttgggagttgttcagatctgaccnnanaggtcattacttatagagttattaatttataccccaccttaattgcaaagagattcaaagcagtaagccatcactttagaatttaatgttctgttttcctttttatttactcattcagcagctatttcaatgcctgctgtgtgccaggtgctattcttagngctttacttgttgtatgtgtnatctaatgctgtgtaacaaattactcctgaacttaccaactcacaacaacatttattagctcacagtttctgtggagcatnggatctagatgtggcttagttggggttgctggcctggggtcttctnctaaggctncaacgaaaagtngaggcccgggctgcagtnatctgaaggctctantggggcaagatcccacttcaagctcactnaatgngcngttgncntangnttagttnncttgcaatnctattnggatttggngccctaagttcctgggcatatagcccnnnnctnntatggncaaggttcacncnttgngngcanttttacacccttnnaagtcntgnanntangntgngnagnaanngaaactaaacnaatttannannanntatataaanctcnnnnncccttcc

SEQ ID NO: 4097 - DNA, 797 bp, Homo sapiens
  misc_feature 20, 198, 199, 565, 590, 650, 652, 664, 675, 678, 699, 740,742, 753, 757, 765, 773, 775, 777, 792, 795: n = A,T,C or G
caaatcccttggctacttgntctttttgcaggatcccatcgattcggacttgaaaaaaagtcacatccagcaaatgcagggtcacatgaaatatgggcctcctggaatccctacagtggatggagactggctcataccttgccagatccctctctcagttccagccttctggacaaggcctgggctaagaggagctgnntcgttatctcttcacccactgccctctcagtatcaccagtcccaaagacaggatacgtccctgtaacccaatctctcggttgattgatagcagaacagctcttgttggtctgagaaggcaggataagtgaccacatatttatgccactacctccaccagggagagtccttctccacaggcttgataaattcaatcaccaactgtgctgtcgtccctgactctgctactcccgttcttcctgctttcctgctccgtatctcagtctgcactgaccccaaggctgggctgacatcaagatgggagcccagcccacgggctttataaacacccaagaaccgtttcagatcttctctggtgctgatgcangtagttttaaatttttctcaagttncagtgatagaaaacccacacaatcatcctctggccagtcttaatagaatatcagaggttnanaagggccttcanaagaacttttnacncaatgcctgcttgggggaaanggaaagttgacttaacccccgggttcaaacctggccatttnanggggaaaaaancttnaaggttcnttaccccntngnttggcatgcttgccnccncc

SEQ ID NO: 4098 - DNA, 794 bp, Homo sapiens
  misc_feature 2, 3, 4, 5, 6, 7, 8, 9, 13, 14, 15, 16, 37, 41, 159, 200,220, 585, 666, 675, 679, 687, 712, 730, 754, 757, 766, 769,775, 776, 784, 793: n = A,T,C or G
gnnnnnnnnggtnnnntttcaaatccttgctcttgcntgtngttgatccctcgattcgaattcggcacgagggagcaaataataagcccttgtgtgtgtttttggcagaaaagccatgaagacaagcagatgctaataaaagaatctgcatctttgttngttattccatgttaaagggttgaaataaaggtaagagaatntttgtactgttgttatcccnaatccatctcctgttctactctctattcaaaataatcgtacagtgactaacagagctttcagaccaacagtattttttatttttcattttaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacaccgaatggggagaagaaggtttcatggctcatgtagacagggttatttgatttctatagtaaccagaangatgcaatactggcagctggagacaagtggttaactggttggcagaatggcatgttcctgctgctggaatggttttatggnttaaaggtnaagnctttatgntgtaaagaacctgtttgaagaaaangccgttaagatggggggntttaatgcctccctggaaaatggnttnttccgtcgntangttaannttcctagncccttcttnc

SEQ ID NO: 4099 - DNA, 794 bp, Homo sapiens; identical to SEQ ID NO: 4098
  misc_feature 2, 3, 4, 5, 6, 7, 8, 9, 13, 14, 15, 16, 37, 41, 159, 200,220, 585, 666, 675, 679, 687, 712, 730, 754, 757, 766, 769,775, 776, 784, 793: n = A,T,C or G

SEQ ID NO: 4100 - DNA, 784 bp, Homo sapiens
  misc_feature 6, 10, 13, 14, 16, 22, 23, 24, 27, 111, 138, 154, 203, 204,499, 511, 593, 629, 650, 659, 666, 680, 695, 720, 740, 742,771, 780, 782: n = A,T,C or G
ctaatncttntcnntngctttnnngangatccatcgattcgaattcggcacgagagactcttcattctatcaccctgtctcacaaaagacttgcccaaggctacgaagcanggcagtgactagagtccagacatcagnaactagttccatgttntttttttcactaccagtccctaggccccaaaccgcagatcctgctgtgnngaccattaagcccctgactgttctaggctcaacttccaaccctttctgcaggtcctattacctctgcctcatcctcccaacatgataaccagagtcttccttcacattgtactgcctacccccttatgttcccaggctctcccttggttttattacctccttgcagtccattttcagatcctgtccattgatctccacccgcacaatgatcacctcataataccactcccgccggatgggtgtataccagagactgcctgtgtacaagcgagtggtcgatacctcaatgatctanggaaaaaaagangcaggtcccgtgtcctggcacagaaggagagtgagtccccaaggaccaagcaataagatcagtgatttcttggggtggcaangtcttctacaggctacccttttcatcttcctgcttntaaacaaatcatacccaaagngatttctantttcttnaatgtgttcagggngaaaagacttttccnggaatttttaatttatttggttcanaaatcatacaggccttgganantaaaggtattttaaatctaaaactggccncaattaaantntc

SEQ ID NO: 4101 - DNA, 822 bp, Homo sapiens; identical to SEQ ID NO: 489
  misc_feature 3, 4, 5, 6, 7, 8, 11, 12, 13, 16, 17, 22, 26, 38, 207, 209,423, 662, 683, 687, 690, 702, 711, 715, 722, 724, 725, 736,737, 744, 776, 788, 799, 807, 809, 811, 812: n = A,T,C or G

SEQ ID NO: 4102 - DNA, 1052 bp, Homo sapiens
  misc_feature 8, 20, 21, 29, 37, 60, 61, 62, 63, 64, 71, 88, 89, 99, 116,144, 180, 181, 182, 183, 184, 186, 197, 208, 214, 226, 229,246, 257, 258, 259, 268, 278, 279, 280, 291, 316, 317, 326,328, 330, 397, 419, 420, 426, 432, 536, 542, 600, 611: n = A,T,C or G
  misc_feature 629, 646, 679, 720, 749, 783, 823, 859, 865, 875, 886, 903,910, 911, 932, 941, 958, 960, 962, 987, 1000, 1007, 1010,1020, 1022, 1038, 1047, 1048: n = A,T,C or G
tttccctnaaaaaaattggnncccttttngggccctnaaaaattgggcccttttgggggnnnnnggccaangggaaatccccccaatnntttttataanccgggcctccggttaanttccaaagccaattttaatttaaccttnagggggccttgggcccctccccaatgggttgggttnnnnntntccaaaaaaanggccccccccnaatttnccaaaagggttnttntttaacctttttccttnaatggggggtnnnaaaaccctnaaaaattttnnnttaaccaattnacccacccaaaaaaatccttttttnnccaattttntntncctgggaaaaccttttcccctttttaatggggctttttaaccttggtcaaccccccaacttaggtantttggatggtctttaagctaanngaaccnaaattnctggatcaatttcactttgtcacatcagggaaccctatcctcttagttctcccattgagatttcactgctggactaagattattcttgattcgtagtcattggnttctgnttccattcattttcagcactgattatgttaatcgtattgctttgagttttttctttgntcaaatgttgnttattacattcattttgnttcatatacacacattntttttttttaactggcattttgaggatattggngttaatgggaaggaaaaaggaatggtgcaaaagcacatggnatttgaattccaaagaccttgaccctcangcattagcaaggtcacttggtttctgagcctcanttttcttactctcaaaatggagggtaatatcccgaaaagnactttgacaaccacaccttaaaagcctggatgcaanaatttnccttttttgnaagtaaattgnggctgggttcttaattncataatnngggataatggggaattcctanggggaattngggctattaggaatccntncnattttaaaaaatggtattttaacangccttggtaaaanggttcanttncatggccatngnggaacaatgttccccntttatgaanntacc

SEQ ID NO: 4103 - DNA, 800 bp, Homo sapiens
  misc_feature 2, 3, 4, 5, 6, 7, 11, 12, 13, 14, 15, 16, 17, 18, 24, 28,43, 47, 58, 478, 521, 523, 712, 714, 723, 750, 772, 777,785: n = A,T,C or G
gnnnnnntttnnnnnnnngtttcnaatncttggcattgatccnttgnttgatcccttnattcgctgacaacttgattgggttctccttcaggtttgaagcgccctcgagaagtgtctaaaggagacagttgatagccaaacaacagttttggattcactgactgattatgaaagaagcagtagactggtatcaagaatcagtcagcaaggaggccctcaccagacgccagtgccatgttcttggacttctcagcctccatattcatgaactaagtttttggaatccttaggcttccacgtgtggaaagcctgagctaacctactggaggatgagccatcacctggagcagattcaggccatcctagttgaagcctccctaggccaagcaaccgtccaactaccagacattgaccattcagccttgaacattcagcacaaagacaaaacagaccagaccagaagagtcccacagaatangggaaactattcagagaaaacttaagccactaagttttatggngntttgttctgtagcagaagcataggcatactgacaatacaaaccgaaatccttctaacgtagtggaccttttcaggccagcatttttttcttgaaaacctggagcatgtattccatcttatagcagagatcactttcacaatggttggggctcttggatttggaatggatgatgtaatgaagccctcttntncagattggnaactaattactcttggggaattgactnggattccacaccccttcttaanaattntacttttnctctttttatcaaac

SEQ ID NO: 4104 - DNA, 1098 bp, Homo sapiens; identical to SEQ ID NO: 484
  misc_feature 2, 3, 4, 5, 6, 7, 8, 9, 13, 14, 15, 16, 17, 24, 29, 41, 46,48, 57, 63, 75, 81, 127, 133, 139, 166, 228, 234, 236, 246,250, 341, 368, 633, 682, 683, 690, 700, 773, 793, 811, 816,847, 856, 871, 876, 877, 887, 891, 896, 901, 906, 909: n = A,T,C or G
  misc_feature 921, 934, 939, 948, 961, 973, 1006, 1009, 1015, 1039, 1042,1064, 1081, 1090, 1092: n = A,T,C or G

SEQ ID NO: 4105 - DNA, 849 bp, Homo sapiens; identical to SEQ ID NO: 483
  misc_feature 2, 3, 4, 5, 6, 10, 17, 22, 25, 27, 32, 50, 54, 70, 76, 79,80, 88, 89, 114, 129, 143, 144, 146, 153, 172, 189, 210,212, 229, 233, 235, 237, 272, 286, 407, 415, 472, 478, 512,518, 523, 525, 545, 561, 564, 567, 573, 578, 589, 594: n = A,T,C or G
  misc_feature 615, 625, 638, 643, 670, 671, 675, 680, 683, 690, 695, 701,704, 711, 717, 726, 727, 738, 742, 746, 757, 763, 768, 778,781, 782, 783, 787, 801, 804, 806, 816, 817, 818, 841, 847: n = A,T,C or G

SEQ ID NO: 4106 - DNA, 858 bp, Homo sapiens
  misc_feature 2, 3, 4, 5, 6, 7, 10, 11, 12, 13, 14, 27, 29, 34, 41, 54,62, 111, 179, 182, 221, 223, 243, 282, 461, 468, 494, 508,519, 533, 586, 606, 627, 633, 683, 685, 697, 712, 716, 738,749, 768, 776, 794, 799, 800, 801, 805, 807, 811, 822: n = A,T,C or G
  misc_feature 824, 857: n = A,T,C or G
gnnnnnnttnnnnntttctaatgcttntnaaatnccttggnagcaggatcccantttcaaancgcttggggcctataccaggagagcggatcccagacgtggctgcattgnccatgggcttctctgtgaaagaagacctttcttggccaggactcgcagtgggtaacctgtttcatcgnccncgggctaccgtcatgggtgatggtgaagggagtgaacanancggccctacccccaggcagngtcatttcgtaccctttggagaatgcagttccttttagncttgacagtgttgcaaattccattcactccttattttctgaggaaactcctgttgttttgcagttggctcccagtgaggaaagagtgtatatggtagggaaggcaaactcagtgtttgaagacctttcagtcacctttgcgccaagctcccgtaatcgcctgtttcaagaaaactctgntctcagnttcaactcccctcaattctctgagtnggaacaatgaaagntgacctgctcntttctttctgaacngcaagtgctacaatgatatttcaagctttgctggcctcggacattaagcattntagcccaaggatcaattctncctggaattaataattccacntgggangcctggcaaggtttggaatgaaaaattggggaagcccttatgggggaaanancttttgaacaanttcaataagaatgcnttcnaaagaacccttggttgaccccnttgccaaaaantttggcaacaatgaacatngttcaagncttttatggggggggaantgccnnngggntngaanttaggcccctngnaaaaatcaattttggacaacctccccttcatanc

SEQ ID NO: 4107 - DNA, 835 bp, Homo sapiens
  misc_feature 2, 9, 17, 23, 109, 111, 112, 128, 134, 148, 149, 151, 155,157, 161, 163, 171, 174, 175, 181, 193, 204, 207, 214, 216,220, 222, 233, 239, 241, 259, 266, 270, 278, 285, 288, 298,301, 302, 305, 320, 328, 337, 339, 342, 360, 378, 379: n = A,T,C or G
  misc_feature 382, 391, 406, 415, 417, 418, 420, 421, 428, 429, 437, 439,447, 449, 450, 452, 461, 462, 467, 468, 474, 478, 482, 487,494, 502, 504, 514, 520, 521, 523, 525, 530, 543, 549, 552,553, 556, 567, 575, 580, 584, 588, 589, 592, 594, 600: n = A,T,C or G
  misc_feature 601, 602, 612, 614, 618, 621, 622, 623, 624, 627, 635, 642,651, 658, 661, 662, 665, 666, 667, 669, 671, 675, 678, 690,696, 698, 711, 714, 726, 728, 730, 732, 734, 735, 738, 744,747, 751, 756, 759, 760, 761, 762, 764, 765, 773, 775: n = A,T,C or G
  misc_feature 776, 780, 788, 791, 792, 797, 808, 811, 818, 820, 823, 824,825, 835: n = A,T,C or G
tncctttcnaatccttnttgcangatccatcgattcggagtttttttttttttttttttttttttttttttttttttttttttttttttgaagtttttagttaattaangnncttgcgaaaaatccanaccagntttatttcaggggnnanagtnanaaancnctgcaatntgnncttaangggattcgattngaggccccccnccnggggganantgtnanccagggatacnacaaantncttggcaagtcactgganaccgacnttcntgcatttngggaaanaanctgggtttgnggnnaantaaagcattttgacnatgactgntgcctaaananccntggcattggccagggatnctgtggaacccttttttnnttnaatgggtgntgagcattaaactgncacttgttnanngnnattagannctttgatngnaacttttnannancccccgaannctggnncccctnaatntttnaattngcccctntttttccnanggggatatantatttnntntngggtnggaaaatttttanaggatnaanntcnccctttttttnttttttantcccnatcntttnnttntncttttnnncccttttttntnttgngcnnnntanaaatttcnctgtaantggattttnaattttnggnnaannnantntaanggntccctttttttnaatttnanaaaatgggttttnatnttctactcttcnancncntnnggnttttcnacntcanatgtngcnnnngnnaaaaaaantnntttnccatgggnctnnctaanataaatcttcnttnaatggtntntannntttttcaaan

SEQ ID NO: 4108 - DNA, 758 bp, Homo sapiens; identical to SEQ ID NO: 799
  misc_feature 18, 593, 613, 643, 654, 662, 680, 684, 687, 696, 699, 711: n = A,T,C or G

SEQ ID NO: 4109 - DNA, 1050 bp, Homo sapiens; identical to SEQ ID NO: 795
  misc_feature 22, 28, 45, 76, 80, 97, 167, 168, 204, 239, 283, 306, 312,349, 354, 359, 375, 377, 385, 397, 401, 424, 430, 443, 452,466, 468, 469, 470, 472, 473, 475, 478, 479, 480, 482, 485,496, 500, 504, 508, 510, 511, 513, 520, 523, 532, 537: n = A,T,C or G
  misc_feature 544, 547, 550, 551, 552, 553, 554, 557, 560, 564, 566, 567,568, 570, 579, 581, 583, 586, 588, 589, 591, 593, 596, 601,606, 608, 610, 616, 618, 623, 626, 629, 631, 641, 662, 664,665, 668, 671, 677, 678, 683, 684, 687, 689, 696, 699: n = A,T,C or G
  misc_feature 702, 705, 706, 707, 716, 717, 719, 727, 728, 730, 731, 733,735, 738, 739, 744, 747, 748, 749, 750, 751, 752, 761, 763,764, 765, 766, 767, 771, 772, 773, 775, 778, 780, 783, 784,791, 796, 803, 804, 806, 808, 809, 810, 818, 821, 822: n = A,T,C or G
  misc_feature 824, 826, 828, 831, 836, 841, 843, 845, 846, 847, 848, 855,856, 858, 861, 863, 869, 871, 881, 882, 890, 891, 894, 897,900, 901, 905, 906, 908, 909, 910, 912, 916, 918, 919, 920,921, 929, 933, 934, 935, 940, 941, 943, 944, 946, 950: n = A,T,C or G
  misc_feature 951, 956, 957, 958, 960, 961, 963, 964, 965, 968, 969, 974,975, 977, 982, 986, 987, 991, 998, 1000, 1001, 1005, 1006,1007, 1011, 1012, 1014, 1015, 1024, 1027, 1028, 1030, 1032,1033, 1037, 1038, 1044: n = A,T,C or G

SEQ ID NO: 4110 - DNA, 798 bp, Homo sapiens; identical to SEQ ID NO: 485
  misc_feature 2, 3, 4, 5, 6, 7, 9, 11, 12, 13, 14, 18, 27, 28, 42, 52,57, 64, 200, 220, 458, 635, 675, 691, 696, 729, 740, 756,772, 797: n = A,T,C or G

SEQ ID NO: 4111 - DNA, 817 bp, Homo sapiens
  misc_feature 1, 3, 4, 5, 6, 7, 13, 14, 15, 16, 42, 218, 222, 304, 525,578, 640, 649, 681, 689, 722, 724, 731, 770, 776, 798, 803,805, 807, 812, 816: n = A,T,C or G
ngnnnnntttttnnnnccggtttgaaatccctttgaatttgnaatcgttggtgatcccatcgattcgagaaatcggaacaaaagtagaagttgtggaaaggaaagaacatttgcatactgacattttaaaacgtggctctgaaatggacaacaactgctcaccaaccaggaaagacttcactgaagataccatcccacgaacacaggatagaaagaangaanccccgcctgtatttttccagcaaatataacaaagaagctcttagccccccacgacgtaaagcctttaagaaatggacacctnctcggtcaccttttaatctcgttcaagaaacactttttcatgatccatggaagcttctcatcgctactatatttctcaatcggacctcaggcaaaatggcaatacctgtgctttggaagtttctggagaaagtatccttcagctgaggtagcaagaaccgcagactggagagatgtgtcagaacttcttaaacctcttggtctctacgatcttcgggcaanaaaccattgtcaagttctcagatgaatacctgacaaaagcagtggaaagtttncaattgagcttcatgggattgggaaatatggcaacgactttttacccgaattttttggggcnaatgaagtnggaagcaaggtgcaccctggagaacccccaanttaaattnaattttcatgacttggcttttgggaaaaaaaananctgcttnttaaaaaaaaaacttggagcctttttgaacttttggggngtcggntttacctagatccggaccttgntaagntncnttggntggnc

SEQ ID NO: 4112 - DNA, 725 bp, Homo sapiens
  misc_feature 2, 3, 4, 18, 413, 437, 438, 478, 669, 699, 725: n = A,T,C or G
gnnnttgttctaatgctnggctctcgttctttctgcaggatcccatcgattcgaattcggcacgaggataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtaccctttttttttaatgaatagggaccaatgccacattgctttttatatttctttcttttttaatgttgccaaaaccaaaagtagctttgttttcctttgtattttgctactttgcagtatttgtgtgtgtggttttntttccttaatttgaaagggacagnnctgtgtatgtttataaactaaatgaagataagatattatnttgtataaacattcatctgagaacaatcaaagcagtagccacatggtgctggctcctttgcagcacaaacctggtcattttgatgactgtcaacaggaagacttgaaaaatcacgtggattcatattaccaccgctctcatttcatggagtcttctgatcaaaaaaaagctcacgtcgtatttcttctttnctttctcttttctaagaaaattgggtgttntgaccagaatgggaattttgcttccn

SEQ ID NO: 4113 - DNA, 786 bp, Homo sapiens
  misc_feature 2, 9, 10, 17, 19, 24, 27, 37, 44, 46, 47, 60, 206, 207, 606,613, 618, 628, 664, 688, 695, 705, 715, 728, 736, 756: n = A,T,C or G
gntttgaannccctttngnttcanatncttgtttgangcccttntnnaggaccccatcgnttcgaattcggcacgaggctatttgaagtacctgtaacaaaacagttggccctctgtttccatgtactctgcatctgtggattaaaccaattgcagatcaaaaatattagaaaaaataaaaataatacaaataaaaatacagtatnnccagttatttaaatagcatttacattgcattaggtattagtctagggataaagtatacaggcggatgtgcgttggttatatacaaatatgtcattttatgtaagggacttgagtatacttggatttttggtatctgtgggttggggggacggtccaggaaccaataccccatggataccaagggacaactgtacttatttacctttattgtcattgcaagcttcttatggaaactttataggaatgaaaatatacatgttaagaagattaaacattagatagtagatggtttgttgcatgctagaactgttagtattgttgaatcaattactttggtttcatgaaaaaataaacgataaatatctttaaagagaactagaagaattttttgtttgagtnattccangctgnagtatgatcntttactgaagtagtttgattggctggctaaacttanaattattggtttcttggtttgtanctgccantaggggttantaattgtaangataaaaatggtntgtgtggnttaaagggaaattaggtggnggttaaaaatcttgggaaaattttccgaac

SEQ ID NO: 4114 - DNA, 784 bp, Homo sapiens
  misc_feature 16, 26, 28, 30, 41, 99, 176, 186, 187, 195, 382, 393, 396,403, 410, 505, 549, 551, 562, 572, 574, 587, 590, 611, 623,626, 638, 643, 660, 664, 673, 677, 682, 689, 717, 724, 732,733, 741, 742, 743, 750, 758, 764, 773, 776, 780, 781: n = A,T,C or G
tttcaaatccttgttnacgccctttntnanggacccctcgnttcgaattcggcacgaggttttgttctcttctttgactattaaaaagctcagtgcctnatatttctaacatatggcaagtgtttctgtgtaccttacaagtctatatataaatttttcttctcttgacagggttntatctatatnncccaagtnacccctaattcttttagaataaggcagaaaataaatcaacgtaaaggttgagaccaagccagagacagctggccaaagtagctggttcagggatataacctgcaagttgccaacccagcgcattcttctcacccttcttccaccctacgaaaggccatatcttacaagagatgctggtaaatgccanacattcactgngtnaggcttnctcacanctagcagtggcatgagatcagttcaatccaatgacactgaaatggaactctccaagtgagtttctgcaaaagacttctctgttaacagggagttnttaagggaaatattgcaccttcctttcccctgctttttcaatcnangcatgatgtcnggtgctaccngnaacccatactgcnaancatgagggcaaatgagcctgngggaatttaaanctntaacactaattnaagangaaaaaagatgcagaancctngatccttantggnccatnatttaanccccttggacccactttttgaaaccagncctctanaacctatnngtgagtcnnntttactnggatcccntaactngataagaanccnttgnntcc

SEQ ID NO: 4115 - DNA, 762 bp, Homo sapiens; identical to SEQ ID NO: 488
  misc_feature 7, 8, 16, 182, 185, 186, 617, 639, 655, 690: n = A,T,C or G

SEQ ID NO: 4116 - DNA, 780 bp, Homo sapiens
  misc_feature 23, 47, 200, 206, 639, 652, 672, 681, 697, 703, 707, 708,730, 742, 761: n = A,T,C or G
ccttttctaatgcttggcatttnaatccttgttgatccctcgatttnaattcggcacgaggcactgcgtcaagccactcctggagaagaatgatgtggagaaagtggtggtggtgattttggataaagagcaccgcccagtggagaaattcgtctttgagatcacccagcctccactgctgtccatcagctcagactccntgttgnctcatgtggagcagctgctccgggccttcatcctgaagatcagcgtgtgcgatgccgtcctggaccacaaccccccaggctgtaccttcacagtcctggtgcacacgagagaagccgccactcgcaacatggagaagatccaggtcatcaaggatttcccctggatcctggcggatgagcaggatgtccacatgcatgacccccggctgataccactaaaaaccatgacgtcggacattttaaagatgcagctttacgtggaagagcgcgctcataaaggcagctgaaggggcacctgcaccccactgatgcccaaactgtcagactttgggggatccccgccttagggcagtgctgcatggctgccctgattccaaagtgctcttatcgcctctgtgtgtgggatcgcccgccccaaccccggggccgcttnagtcttgcttggnaggatgccttcccccagganggcagtgangggatgccgcaacctngacttnttannctcctggggtttccgccgggcnaaaactggctgncttaaatactgggcttggnagttgtttcaataaaaggc

SEQ ID NO: 4117 - DNA, 926 bp, Homo sapiens
  misc_feature 2, 3, 4, 5, 6, 10, 13, 14, 23, 27, 41, 49, 102, 107, 133,168, 173, 224, 226, 239, 356, 376, 395, 397, 405, 408, 415,418, 421, 429, 431, 453, 480, 489, 495, 502, 511, 517, 530,542, 565, 570, 572, 584, 590, 591, 592, 608, 613, 614: n = A,T,C or G
  misc_feature 615, 617, 619, 622, 635, 639, 646, 651, 655, 662, 666, 670,673, 676, 690, 691, 693, 700, 702, 708, 709, 713, 718, 723,727, 728, 729, 735, 739, 742, 749, 750, 755, 763, 766, 767,769, 774, 776, 778, 781, 789, 794, 800, 807, 811, 812: n = A,T,C or G
  misc_feature 825, 826, 828, 830, 832, 833, 835, 843, 847, 850, 859, 862,865, 874, 880, 887, 894, 895, 913, 914, 918, 919, 921, 923: n = A,T,C or G
gnnnnntttntanncccttttcnaatncttggaatttgacntcgttgtntgatcccatcgattcgaattcggcacgagagaagttctagcacatcttaattnccttnatagtttaattgatgaagagcattgntgaagagttaggaggtctccctttgtcctacattntccgnttttttagaatgagaagatgagaacgacctccagttcacatgacggctgcngngaggatccagtangggagatacagtgctcagcaccaagcatgtgcaagtgagcacaatccaattttacatcatgttacccctccaggacagttgctttgacgtggaaggtatagagggagttgaaagganggtttgcatggttggcagangtgccctgcagccttcctntncaagctgnaanccgtttntgnccncctggaancngttggaaagtgtgtggtatggnatgaagatcccattttgactctgttcntgatcttgnttactnaagtganccttgttcnttgacngtattggatgatncattgatcctanctatcccttaactggtcgggtgntgctncngggggacattgntttttnnncaatttccaatgcatnccttnnngnanctntttcctgtcacanccanccaattnaattnatancctgtgnattngaanccnaanttcccagggccgtnngntagtctntntaaaanngggntcaantaaantttnnntatgangccnttngtataannttttntaaccatnggnntntatgncnanttncaacctgnggttnctcttnataactnggcnnttttgtaaattcnngntntnntntgataatntacnttnttttctttnatnagnggctttatntcaaantaatccncgaatanntaatataattgttctatnnatgnnancngcc

SEQ ID NO: 4118 - DNA, 789 bp, Homo sapiens
  misc_feature 4, 5, 6, 7, 14, 15, 18, 34, 38, 43, 58, 219, 222, 327, 605,635, 649, 653, 656, 689, 739, 745, 759, 760, 784: n = A,T,C or G
aggnnnnttgtaannccntactgaaatcctttgnatcncctcnttgtttgacccattnattcgggccggttattctctctttacagatagctatagacatcattttaggaagtgttgcagtctggcatttgtgctattgttcattctctgtgaaggctgttcatagttgctatagcctgtgtttagttttgtgatttcatcaatcccatctttccgcgngantaatgcattctaaacatcctaccccactttagaaacggacgtggggaacgcttggtcatttaagccaacaataaatttaggtgaatgtccctaagtgtttactgnttttatccagtcaaggatttgcttttccttgaacatttgttttaaattctggggccaaaatgcaaaggagaagttctattcaaaggcagtagttgaaatctattattttagttagcctacttggcatttactacatcggtcacttctccaggctgccctaaattaggttgatggagtgagacatgccaaacattcacctttgggaccatagcatagttaaaattaaatgtagttggaatagctagcattgcagctacagtaggggaactgtagtctanttcccctcagaaaaacccaaggagttgaanggacaggattttgnctangcnaaaaatctaagactcgtgcccttctggtacatnggggttttaagactggaatgtgtaataggagcactgcctttgcccaatcnaatgantgacaggttaactnngaaaatgggacaatcacatttccncttac

SEQ ID NO: 4119 - DNA, 814 bp, Homo sapiens
  misc_feature 2, 3, 4, 5, 6, 7, 8, 9, 12, 13, 14, 15, 16, 20, 24, 37, 38,226, 227, 337, 542, 585, 591, 595, 605, 620, 632, 668, 669,672, 673, 674, 676, 683, 684, 690, 717, 720, 730, 731, 735,747, 753, 756, 767, 772, 784, 785, 792, 797, 810: n = A,T,C or G
gnnnnnnnngtnnnnntttnaaancccttttcaaatnncttggcattgaatccttgcagatcccatcgattcgaattcggcacgagtatcagacaatattttattattttttcatagatgttctgccacacaaagaacttggggtgtaaggataaggcaaaagctccaatcccatttttcagttctcctaggatgcacccctcagggagcctggccagagttccgnngcccgtgagcgtcagctgttgctttattttccatcaaagccctctgagaagtgagacctcagcaattccgggagccacatagagacagacttggcaagggaccccctggntctgagccagtagctgccatctggaaattcctcttttagcctctccttagaggtgaatgtgaatgaagcctccaggcacccgctgaatttctgaggccttgcttaaagctcagaagtggtttaggcatttggaaaatctggttcacatcataaagaacttgatttgaaatgtttttctatagaaacaagtgctaaagtgtaccgnattatacttgatgttggtcatttctcaagtcctatttctcagntctatnattntagaacctangtcagttctttaagnattataactggncctacattaaaaaaatgcttctcgaaaaaaaaaaannatnnnantacaaannaaaaancttcgaccctttaaaaccttttggggngcngatttacctnngaancccgacctgatnagaaanccntggttaaagtntgganaaaccccacctnnaaaggcnagggnaaaaaaaagcccntttc

SEQ ID NO: 4120 - DNA, 800 bp, Homo sapiens; identical to SEQ ID NO: 4103
  misc_feature 2, 3, 4, 5, 6, 7, 11, 12, 13, 14, 15, 16, 17, 18, 24, 28,43, 47, 58, 478, 521, 523, 712, 714, 723, 750, 772, 777,785: n = A,T,C or G

SEQ ID NO: 4121 - DNA, 817 bp, Homo sapiens; identical to SEQ ID NO: 4111
  misc_feature 1, 3, 4, 5, 6, 7, 13, 14, 15, 16, 42, 218, 222, 304, 525,578, 640, 649, 681, 689, 722, 724, 731, 770, 776, 798, 803,805, 807, 812, 816: n = A,T,C or G

SEQ ID NO: 4122 - DNA, 785 bp, Homo sapiens; identical to SEQ ID NO: 486
  misc_feature 2, 3, 4, 5, 6, 7, 15, 23, 27, 38, 597, 709, 711, 717, 735,741, 780, 784: n = A,T,C or G

SEQ ID NO: 4123 - DNA, 785 bp, Homo sapiens; identical to SEQ ID NO: 486
  misc_feature 2, 3, 4, 5, 6, 7, 15, 23, 27, 38, 597, 709, 711, 717, 735,741, 780, 784: n = A,T,C or G

SEQ ID NO: 4124 - DNA, 785 bp, Homo sapiens; identical to SEQ ID NO: 486
  misc_feature 2, 3, 4, 5, 6, 7, 15, 23, 27, 38, 597, 709, 711, 717, 735,741, 780, 784: n = A,T,C or G

SEQ ID NO: 4125 - DNA, 800 bp, Homo sapiens; identical to SEQ ID NO: 4103
  misc_feature 2, 3, 4, 5, 6, 7, 11, 12, 13, 14, 15, 16, 17, 18, 24, 28,43, 47, 58, 478, 521, 523, 712, 714, 723, 750, 772, 777,785: n = A,T,C or G

SEQ ID NO: 4126 - DNA, 828 bp, Homo sapiens
  misc_feature 8, 90, 97, 104, 112, 137, 153, 155, 179, 187, 189, 197, 210,220, 222, 236, 336, 341, 354, 369, 376, 379, 382, 396, 420,432, 433, 474, 477, 481, 513, 523, 529, 560, 565, 569, 575,577, 585, 592, 594, 597, 601, 605, 610, 614, 620: n = A,T,C or G
  misc_feature 621, 625, 630, 631, 632, 639, 649, 650, 671, 679, 685, 689,698, 708, 711, 723, 741, 745, 761, 763, 770, 773, 779, 781,793, 798, 802, 819, 822, 823, 826: n = A,T,C or G
ttctaatngcttggttactcgcctttctgtaggatcccatcgattcgaattcggcacgaggcaagccaggagtgctggcacaggcctgtngtcgcanctactcnggaggctnacgccggaggatcgcttgagcccancaggtcaaggctacantnagccgtgatcatgccactgcactncaaactgngngacacagngagaccctgtctnttaacaacanancccatgagcggcangccccccagtctggatggtggtaaagaatccttaagatcaaacccacgcagtgcttaaagcttggcctgattctagggctggggctggacaaactgctanagatnatgccgatagccngtgtgatccccctgncctgatngtnaanggcatagtgcagantggaaccctttccctccccaaaanattcagacctgnngggctgagtgggccttattgagtccccaaagttctgagaanctnggtntctggcttttagccttcagctttcttaggttntgatgcaatnagttgngttcccctgcccttttcttgccatgcacttncgaangaanggtttncngggttgcntgggaancnttncccnaacngcctnttanccaccnnaagnttttnnngaatcancacttccctnngggggggaatacttttaaatnccggaagncctttnaacncccttgggntccttccccngantacccaagcttnaaatccaaaattaccggnatcnttagggctttgtagcntntgggttnggntttgcntnttttttcttaanctttntttnaataaaccaatttcttntgnnacncc

SEQ ID NO: 4127 - DNA, 898 bp, Homo sapiens
  misc_feature 6, 7, 16, 49, 51, 53, 65, 74, 120, 205, 207, 217, 375, 406,480, 489, 507, 521, 532, 562, 564, 570, 603, 607, 610, 611,621, 622, 626, 628, 632, 657, 662, 665, 666, 668, 673, 684,695, 707, 758, 770, 773, 775, 776, 782, 796, 816, 828: n = A,T,C or G
  misc_feature 831, 840, 849, 868, 870, 892, 894, 896: n = A,T,C or G
ttgtannccttttctnatagcttggtcttgactccttgttgatcccttntncnaattcggcacgngattacctncaaatctcaaggcggccttgaacattgagaaagaactaccaaagcntagacacgttttcagaaggaagacagcctcctccaggagcatcttacccgacctcttgtcaccgtaccaaatggcgatccgagcnanccgactggangagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggancatggtggcatcaaagattcctctgccacanatctgatagataacaggaaagttccactgaatccgcctggaaaaatgaaaccaagcaaagagaaatcgccacangcaagtaangaaatgagtgccctgcangagagaaatttagnagagaagattnaacagaccgttcttcaaatgcgtttagccnangaaganttccttgggctatgcccccacttggtaaggaanattnatnnaaaaggcttnncctnangggnttctggggaaaatttggcccaccantatgnttnncntgggnatttgaaaaantatttttgganaaagccttaaanaattttggggggaatttaaaccctttggtaacccaataggtatttggtatntaactgggggtnggngnncctttnacttggggaaaacntttttccctttgggcccttngccctgtcagcnacnaatgctttntaaaaattnccttttatttttaacctcnanatattttgggttaaatatttangnancc

SEQ ID NO: 4128 - DNA, 705 bp, Homo sapiens
  misc_feature 1, 33: n = A,T,C or G
nctaatgctgggctctcgttctttccgcaggancccatcgattcgaaaaattgtgatgtaagtggtacagtggggagaatttagggctctcagaatgcagaaaactagccacctccagttctgtgcctgaccaccatctgactttggataaatcccttctgctctcccacctagctttatcatttgtaaaatgagtctctaggtacagccctttctggggttgagacagagtttctgaggagtaaaagccatgtcattgtggaaacaggcagctattctcacagctggcatgagcccactactcccctataatcagtgctgataaactgctctcatttgttggacttcagactttcctgacccactttgaatgggggccactttgaatggaaactttctatgtattgaattaaaagatctccaagataaatggttaaatgaaaaagcacagtgcaaaatggtgcatatgatatcctaccttttgggtaaaataaaaaaaaaaaaaaaaaaaaaaaactcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcat

SEQ ID NO: 4129 - DNA, 701 bp, Homo sapiens
  misc_feature 2, 3, 5, 6, 31: n = A,T,C or G
gnngnnctaatgctggctacttgttcttttngcaggatcccatcgattcgaattcggcacgagtttacattttgtttgaatcaggatccaaataaggtttaaatattgcaatttgattaatacattaagattcttttaatctataagttcctgctccatctgtcattttatttttatcccttgaaatttatttattgaagaaactatatcctttgctttgtaaaattttccacagtgtggctggctttggctgattgctagcgtcatttgctatttatttttgtcctgtatcttggatctggcgccttgatcagatttaagttgatttttggggacgtaattacttcataggtattatgcatttttggatagaggagtaaagtagtgaaagtaatgtttttaggatggtttgtctggcagcagtgtgcaaaatgaattggtagaggagaaatggagagctgcgaattagaaggcaggttcaatcagtgcaggaaggaaaggctacagtaaggcagaggcagggaaaagaaaggcaatagagatgagagagattttgaaagaaggaattttcaataccttttaggcttaactataagaaatggagagtcggctgggcatggtggctcatgcctgtaatcccagcactttggaaggccaaggccagtggatcacctgaggtcaggagttcaagaccaacctgc

SEQ ID NO: 4130 - DNA, 705 bp, Homo sapiens
  misc_feature 11, 14, 21, 33, 36, 37, 41: n = A,T,C or G
actaatggtgngtngctcgtncttccgcagganccnngcgntgtcgaattcggcacgagattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaag

SEQ ID NO: 4131 - DNA, 700 bp, Homo sapiens
  misc_feature 1, 16, 24, 29, 670: n = A,T,C or G
nctaatgctggctatngttctttntgcangatcccatcgattcgaattcggcacgagccaagcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagacctnccacctcaccttgcttccttcaggactcaa

SEQ ID NO: 4132 - DNA, 704 bp, Homo sapiens
  misc_feature 10, 13, 14, 38, 51, 688, 703: n = A,T,C or G
gtacaatgcnggnngctcgttctttccgcaggatcccncgatgcgaattcngcccgagcagagctgtgatctgcccccaggtattctgacccccaaactggctctcaaccatgtttacatgatgaaaagaagaggtgactgttgtatcagctctaaaggcctcacttttggtgaaatgggacctaaatttgattgcatacttgattacttgctgtcaatactgaaattggcacttcataattttaatactattgaactttcaccataaccctgtcctataaagttgacttgcaaatgaagaaactctatctcttcaatattataaaatatatccaagagtcacaactagtgagaaaaggacaggatctaactaacaatgtgaggctgtgtcttcacaccaattcaacagagtatcttgtaaatgttgagaggagaggtactttaggtcatgggtgtctttcaataagtgctttagaaaacaggtgacaactgattgggccttgaggtatgaatggatttagccaggcaattaaataggaaagcagatactcaagacagattaaaacagcttgagagaagtgaaatgagcaagtgtaagacaattgatactgtccatggattttagaaagtgtgaagtggagtgattgtgatgaagcttgaaagattgcctggggccaggctgttgaangcttggtttgcttant

SEQ ID NO: 4133 - DNA, 704 bp, Homo sapiens; identical to SEQ ID NO: 4132
  misc_feature 10, 13, 14, 38, 51, 688, 703: n = A,T,C or G

SEQ ID NO: 4134 - DNA, 700 bp, Homo sapiens
  misc_feature 15, 24: n = A,T,C or G
ctaatgctggctctngttctttcngcaggacccatcgattcgcagagatcaaacaattgtagatcccttcagttcaaaacataatgtgattgtgggcagaaatggatctggaaaaagtaactttttttatgcaattcagtttgttctcagtgatgagtttagtcatcttcgtccagaacagcggttggctttattgcatgaaggtactggtcctcgtgttatttctgcttttgtggagattatttttgataattcagacaaccggttaccaatcgataaagaggaagtttcacttcgaagagttattggtgccaaaaaggatcagtatttcttagacaagaagatggtcacgaaaaatgatgtgatgaacctccttgaaagcgctggtttttctcgaagcaatccttattatattgttaaacaaggaaagatcaaccagatggcaacagcaccagattctcagagattaaagctattaagagaagtagctggtactagagtgtatgacgaacgaaaggaagaaagcatctccttaatgaaagaaacagagggcaaacgggaaaaaatcaatgagttgttaaaatacattgaagagagattacatactctagaggaagaaaaggaagaactagctcagtatcagaagtgggataaaatgagacgagccctggaatataccatttacaatcaggaacttaac

SEQ ID NO: 4135 - DNA, 704 bp, Homo sapiens
  misc_feature 693: n = A,T,C or G
ctaatgctggctctcgttctttctgcaggatcccatcgattcgcactgggttccaagttgctttgctgaataaggatttgaagccacagacatttagaaatgcttatgacataccaagacgaaatcttttggatcacttaacaagaatgagatctaatcttttgaagagcactcgcagatttctgaaaggacaggacgaagatcaagtgcacagtgttcctatagcacaaatggggaactaccaggaatacctcaagcaagtaccttctccactaagagaacttgatcctgatcagccacgaaggttgcatacatttggcaacccctttaagctggataagaagggtatgatgatagatgaagcagatgaatttgtggctggacctcaaaataaacataaacgacccggagaaccaaatatgcaagggatccctaaaagacgtcggtgtatgtctccactactaagaggcagacagcagaatcctgttgtaaacaatcatattgggggaaaaggaccacctgcacctacaactcaagcacagccagatcttattaaacctcttcctcttcataaaatttcagaaaccactaatgattcgataatacatgatgtggttgaaaatcatgttgcagaccaactttcatcagacattacaccaaatgctatggatacggaattttcagcatcttctncagccagttag

SEQ ID NO: 4136 - DNA, 701 bp, Homo sapiens; identical to SEQ ID NO: 520
  misc_feature 13, 678: n = A,T,C or G

SEQ ID NO: 4137 - DNA, 705 bp, Homo sapiens; identical to SEQ ID NO: 4128
  misc_feature 1, 33: n = A,T,C or G

SEQ ID NO: 4138 - DNA, 710 bp, Homo sapiens
  misc_feature 2, 3, 4, 13, 42, 43, 710: n = A,T,C or G
gnnnctaatggcngggctctcgttctttctcgcaggatcccnncgattcgaattcggcacgagctctatcttgtttattgttgatgccatcttagaggaaaaaatgtaaaggtaagtaattaagcatatgacagcaacaaataagatacttataacctaatgggactttattttgtagttttatgtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattan

SEQ ID NO: 4139 - DNA, 1073 bp, Homo sapiens
  misc_feature 3, 7, 233, 235, 242, 243, 245, 246, 255, 258, 260, 262, 265,274, 277, 278, 283, 291, 294, 298, 302, 303, 307, 317, 323,326, 331, 337, 342, 344, 354, 358, 359, 367, 368, 371, 373,374, 377, 381, 391, 393, 397, 408, 423, 427, 450: n = A,T,C or G
  misc_feature 453, 475, 476, 479, 480, 482, 499, 502, 507, 520, 528, 529,541, 543, 546, 547, 571, 574, 579, 589, 594, 596, 604, 608,618, 628, 653, 657, 669, 671, 674, 684, 689, 700, 701, 718,733, 735, 743, 747, 754, 762, 767, 789, 794, 800, 805: n = A,T,C or G
  misc_feature 807, 813, 815, 837, 843, 845, 849, 853, 857, 863, 866, 867,874, 897, 900, 905, 925, 936, 944, 949, 950, 958, 964, 969,992, 993, 997, 1007, 1011, 1013, 1021, 1026, 1035, 1039,1042, 1044, 1065, 1071, 1072: n = A,T,C or G
ttnactnatcgcttggcttgttctttttgcaggatcccatcgattcgaattcggcacgagggtaaagagcaagtaatgagcttgtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaaactggtggagcantncatatannanntctggtcgnctntngnctntttgtttantcnnatccntccccctnccnctcntctnntccnccctcttatnacttcnttnttccntctttnttctntncccctctccncttnnatcttccnnttntnnttntccntcccttctcncncctnctcttctctcnttcctcttcattctntccnctcccttctctctttcactctcntcncttctcttctctattctcttcnntcnntntcttctcctatccactnacntcctntctctctcatccnatctcatnnctctctctcatncntanntcttctctccactttctctctacnatntctcnctactctctnatcananacctcttntccntcttctatcnctctctactnctctctctctcttactatctctctntctnttctttcctctncntcntctcacttcntactnttatttctctnnttctcatcagtctcttnctatctctttctctncngtttactntctncatctcntatctctnctatntctccttctctctcctcctatntctanatcatntctcntncatctnantctctccctttcatccgtctcnaccaantncttntacntgcntcctcnccnnctcttcnttttcatattctctctctcttcnttnttctnactctctccctctctctctnttcctactgcntgcttctncactnnctccttanctacanccatnactcacctcatctcatctcctcnnctcnctctctctcncatntntttctctnctttntatccatcnttcntcntncctcttctctcacactacttntctctnnt

SEQ ID NO: 4140 - DNA, 706 bp, Homo sapiens; identical to SEQ ID NO: 518
  misc_feature 12, 13, 33, 37, 42: n = A,T,C or G

SEQ ID NO: 4141 - DNA, 709 bp, Homo sapiens
  misc_feature 1, 18, 26, 32: n = A,T,C or G
nctaatgctgggctactngttctttntgcagnatcccatcgattcgaattcggcacgaggacagccccaatccgggagcaggagggcctcctgccttggcatatagacccctgggcgcctccctgggatgcccaccaggcccagggatccacctaggtgggtttggcaaccctggtgatggcagtggtagtggcacatcctgcctttgcagccagccctccgtcacacggactgtgcagaaggatggacccaacaaggggcgccagttccacacatgtgccaagccgagagagcagcagtgtggctttttccagtgggtcgatgagaacaccgctccagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagtggccatttagtgtcctggaaacttagaggacagtgttggcctttggagtcgggccttcttgtgttaaggggcacaaggtccagatcactctggagcaggccagcttctgttgg

SEQ ID NO: 4142 - DNA, 709 bp, Homo sapiens
  misc_feature 3, 5, 9, 11, 13, 24, 25, 47, 508, 531, 539, 542, 551, 561,585, 594, 607, 609, 611, 618, 629, 631, 633, 635, 636, 639,640, 642, 666, 671, 679, 681, 682, 683, 687, 691, 692, 697,702: n = A,T,C or G
gtncnaatngntntgtagatcganntagcctaaacaaattggcttgncgccccttccttctgtctctggagacccttgacttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactgctttagtttcctgtttgctggtgggaggggatacggtctgtgactctggacttgctctgggggaacagttgtcactgcccccggggagaggggcagcttgggctggagaagcacagccagagacagagcccctcgagagggatccttggctgcttcattgtcttccccccagcaagccctgctctccacaggcacctctggggtcttggtatggtccccgctcacctccttccagagtcctgagtggtgtgggtgtgggtggcacaggatctggggcatgggangggtcagagcttccagagccccntgtcctgncanactcagctngtgggctggngtgttaaccccagtcctggcgtangtttacagnctctcaaggtacntngncccctgntctcctgggananangnntcnntnatgatccctaccaaagcacatgtnggatnaaggctgncnnntgcnttgnntcganagccngaagccc

SEQ ID NO: 4143 - DNA, 783 bp, Homo sapiens
  misc_feature 5, 12, 16, 25, 37, 45, 47, 469, 521, 553, 554, 556, 557,562, 565, 570, 571, 573, 578, 580, 581, 582, 584, 588, 589,592, 593, 595, 597, 602, 606, 607, 611, 613, 615, 621, 625,628, 637, 640, 641, 645, 656, 663, 669, 673, 676, 680: n = A,T,C or G
  misc_feature 682, 684, 687, 689, 692, 693, 696, 697, 700, 701, 704, 713,718, 720, 725, 733, 744, 745, 753, 758, 759, 763, 770, 773: n = A,T,C or G
gtaantaattanctgnagctcgaantagcctaaacanattggctngncgaattcggcacgagacccgaggctcggtgtactaggtgcgaatgccgccttctgtggtgaccactgtcttctcatcctttgcacctataggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatgaggtccacggcatgcccagtgccaacacgcacaatacgtggaaggccatggaaggcatcttcatcaagcctagtgtggagccctctgcaggtcacgatgaactctgagtgtgtggatggatgggtggatggagggtggcaggtggggcgtctgcanggccactcttggcagagactttgggtatgtaggggtcctcaagtgcctttgngattaaagaatgttggtctatgaaaaaaaaanntnncccantcnccaanncnttctncnnnanctcnnttnntncntccantttnncctntncnccctantctnccnctacttccnatnnaccnatacatccccntcacttnattaantccnatnttanantngcncnctnntcnnacnntcntctcatacntggtntnatcanttctctanatcctctctcnnctctccgncgctnnactncttcctntancactcaccct

SEQ ID NO: 4144 - DNA, 705 bp, Homo sapiens
  misc_feature 9, 15, 21, 44, 678: n = A,T,C or G
atgctgganctaatnctggcntctcgttctttccgcagcacccncgattcgaattcggcacgaggcctgctgcttcatgccgccggcgtcctgctccacgtctctgtgctgctgggccctgcactgtcggccctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggcccgtgacttangcagaggagtgcagaggagggtctggc

SEQ ID NO: 4145 - DNA, 710 bp, Homo sapiens
  misc_feature 2, 6, 10, 13, 15, 16, 19, 47, 48, 51, 58, 60, 63, 67, 74,468, 558, 597, 671, 707: n = A,T,C or G
tntctnaatntgntnncgnatcttgaggacccatcgttcaattccgnnccnagggggnanctncccntactccntggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgnatctggctggactgatctgtctcacaagaagccatgaggccatagggagaagctccctctccccttcatcttctgctccaaaggtggtancaagaggagtacccagttaggggttggagcccccatatnacatcttcctgtcagaagactgatggatctttttcattccaaccatctcccttttcccccgatgaatgcaaatnaaacttttgtgacaccagcaacccattgctctttanaat

SEQ ID NO: 4146 - DNA, 709 bp, Homo sapiens
  misc_feature 1, 2, 10, 11, 27, 35, 36: n = A,T,C or G
nnatgctggnnctaatgctggctactngttctttnngcaggacccatcgattcgaattcggcacgagggactaacttacagaggagctgtgtatcctgaagattcagcgactggcaaggaatttccttgggagcaatgtgtgagggaggccatctgaggagatctgtggctttcttttgttgtgggaatctggcttatggatgaatctacgacacaggattgtgaaattacagctctttgggaacaaaaggaaggcagtattgcatgacttagtttcccagcttcactttccctttggcatggtgagtttggggtcttgagagtctattttctttcacacccatcagcactgttaagtaagcaggaagacaacctgaggttgtctctttactttgagttcctacataataaattgcagcctaatttagtacataaacccaaacctaatttaggagtaaattttttgtagcagatagccagatttcagccaatcacaggcttccagctaacaagactatgcccaaataaggcaaatgcctcatcacatgatgctcaaataaggcagccacctaggcgaggccaatcaggtaacttttctactttgcttaattgttcagcctgtacaaatttgctgcttatgactgctgagcagagctgtctaaacctcttctggtttggagtgctgccttatatatgaattgttctttgg

SEQ ID NO: 4147 - DNA, 712 bp, Homo sapiens
  misc_feature 9, 10, 41, 43, 47: n = A,T,C or G
aacgctggnnctaaatggctggctatcgttctttccgcagnancccntcgattcgaattcggcacgagctgcgacccctcggaccagtgcccgccccaggcccgctggagcagcctgtggcacgtggggctcatcctgctggcggtcctcctgcttctgctgtgtggtgtcacagctggttgtgtccggttctgctgcctccggaagcaggcacaggcccagccacatctgccaccagcacggcagccctgcgacgtggcagtcatccctatggacagtgacagccctgtacacagcactgtgacctcctacagctccgtgcagtacccactgggcatgcggttgcccctgccctttggggagctggacctggactccatggctcctcctgcctacagcctgtacaccccggagcctccaccctcctacgatgaagctgtcaagatggccaagcccagagaggaaggaccagcactctcccagaaacccagccctctccttggggcctcgggcctagagaccactccagtgccccaggagtcgggccccaatactcaactaccaccttgtagccctggtgccccttgaaggaggtaggagaacggaccagagcttggagaactaatgcttggagccaagggccccagcccaccccaccgtcccacacattgctgtggccccaacctcggtgccatgttacaccggcccctgg

SEQ ID NO: 4148 - DNA, 707 bp, Homo sapiens
  misc_feature 2, 4, 10, 13, 19, 39: n = A,T,C or G
gnanctaatngcntgggcnactcgttctttccgcagganccctcgattcgaatcggcacgaggagttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtgccaggaacacacacatcctccatcccagcata

SEQ ID NO: 4149 - DNA, 707 bp, Homo sapiens; identical to SEQ ID NO: 4148
  misc_feature 2, 4, 10, 13, 19, 39: n = A,T,C or G

SEQ ID NO: 4150 - DNA, 703 bp, Homo sapiens
  misc_feature 15, 17, 615, 620, 622, 625: n = A,T,C or G
ctaatgcttggctantngttctttttgcaggatcccatcgattcgaattcggcacgagattagctgcttgtggtggggccccaaccgccctcgggcactggggagctgggctggggctgctgctctggggtctccgggggccacagcttggggtgagttgaagacctcaggggatgtggaggggtctgcggggccctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaagctccagcaggggtgggggccgggctgagggtgggggtgcgaggtggtcactcccatcgtgcccctggccgtccctccactcacccacacctggcccagtccacgttgaggtccaggactgggaaggaccgggtgagtgcaccggggacccaggccaggtgccccccggagcctgctggggtggccagagcaggagggggtgtgtttcctttttgtgggtgttgcatgcaaatcaagtggacaagaaaaaataacanaacananaanaaaaaaaaaaactcgagcctctagaactatagtgaagtcgtattacgtagatccagacatgataagatacattgatga

SEQ ID NO: 4151 - DNA, 710 bp, Homo sapiens
  misc_feature 2, 3, 6, 12, 27, 40, 42, 45, 46, 47, 50, 709: n = A,T,C or G
gnnccntaaatngctgggctactcgtnctttctcgcacgnanccnnncgnttcgcacaaagggagaacttcctcgaggctggaactgggttgatgttgtgaagcatttaagcaaaactggctctaaggatgatgagtagcacttggaatttgagacaaggaaagagcattctttaaagagtaaaactgggttcaaaatctttcattactattttctggtattgaggcgactttttataaaacacaattttttgtatgtttcttacattaaaaaggttgtaagttgaaagttcatgaagagatcttgttgtattaaattattttcacaaacttgccttaataaaaggtgaaaatgttactgtttagtatactttatgaagccccttgagctttataaatggacaggcatggggaataagaatcagtgttaatttaaatgatcttatcctggtggatgtgctattttcttaaaggagtatgaagcccttttcaaactatcatcccagtggagcggagtactcagtgaacagttactccatagtgcaatccatattaataggcttcttctcttaagtcttcatctcttcttttgcttaattactgaaccgtaaattacttcagagaaatttaaatgctggtatttgaactttatacatgatactttttgtagtttcttttaatttttgaaagatgaactgcttccttttaanc

SEQ ID NO: 4152 - DNA, 757 bp, Homo sapiens
  misc_feature 1, 2, 4, 5, 6, 7, 8, 9, 10, 12, 13, 14, 15, 16, 17, 18, 19,20, 21, 22, 23, 24, 25, 26, 27, 28, 29, 30, 31, 32, 33,34, 35, 36, 37, 38, 39, 40, 41, 42, 43, 44, 45, 46, 47,48, 49, 50, 51, 52, 53, 56, 68, 92: n = A,T,C or G
nnannnnnnntnnnnnnnnnnnnnnnnnnnnnnnnnnnnnnnnnnnnnnnnnngtnctaatgctggcnatcgttctttccgcagcagcccancgattcgaattcggcacgagataacacagactttcaaggaccaaggattggaggttttaaagcaggaaacagcagttgttgaaaacgtccccattttgggactttatcagattccagctgagggtggaggccggattgtactgtatggggactccaattgcttggatgacagtcaccgacagaaggactgcttttggcttctggatgccctcctccagtacacatcgtatggggtgacaccgcctagcctcagtcactctgggaaccgccagcgccctcccagtggagcaggctcagtcactccagagaggatggaaggaaaccatcttcatcggtactccaaggttctggaggcccatttgggagacccaaaacctcggcctctaccagcctgtccacgcttgtcttgggccaagccacagcctttaaacgagacggcgcccagtaacctttggaaacatcagaagctactctccattgacctggacaaggtggtgttacccaactttcgatcgaatcgccctcaagtgaggcccttgtcccctggagagagcggcgcctgggacattcctggagggatcatgcctggccgctacaaccaggaggtgggccagaccattcctgtctttgccttcctgggagccatggtggtcctggccttcttt

SEQ ID NO: 4153 - DNA, 710 bp, Homo sapiens
  misc_feature 12, 18, 37, 45: n = A,T,C or G
ctaatgctgganctaatngctgggctctcgttctttncgcagganccctcgattcgaattcggcacgaggtcacatcttagatggatggtggcagacaaaaagagagagcttatttagggaaactctgtttttaaaaccatcagatctcatgcaacttattcaccatcacaagaacagcagggcacagacccatccccatgattcaatcatttcctactgggtttcttccacagcatgtaggaattatgggagctacaagatgagatttgggtggagacacagagccaaaacacatcagatgccatggaaatacaatgaggaaaagacagtctttccaataaactgtgctgggaaacctggctatccatatgcaaaagaatgaaactggatctccatctccctccttatataaatataaaatcaaaatggattaaagatttaaatctaagaccttatactataaaactaaaaaagaaaacagtgggaaactctctgggacattagtctgggcaaaaatttcttgagtaatacccctcaagcacagacaacaaaagcaaaaatggacaaatgtgaacacatcaagttaaaaactatctgcacatcaaaggaaacaatcaacaacgtgaacagacagcccacagaatgagagaagtatttgcaagatactcatctgacaagggattaatagaatatataaggagctcaaata

SEQ ID NO: 4154 - DNA, 710 bp, Homo sapiens; identical to SEQ ID NO: 4153
  misc_feature 12, 18, 37, 45: n = A,T,C or G

SEQ ID NO: 4155 - DNA, 695 bp, Homo sapiens
  misc_feature 18, 32, 33, 695: n = A,T,C or G
ctaatgctgggctggcgntctttccgcaaganncctcgattcgcccaggctgacaggggctctgccgtctttaacatgtgactttctaggtcagtcatctggtcattgcttttccacacagcagataagacaaaggagtggaaatagaggggtagagattttctcttaaacgtgtgaggctggagtggtatgcttcattggcaagaacctggtcctagcctgcctagctgaaaggaggggagtcagggagatgcactttgcagccaaaattctgttgccaagaaggggaaagtagatttggttggattttgatctgtgtttgctgctgtgttactctataattcagccatgtactctggaggtttagctatgttgtagccaattgatctatctcattcctttttactactgtacattataccacaataagagcatgctacgctttgtttagctgctagctgtttccttcctaatggatagttagctgatttctgttgtttttctctgagaaccaatgttgcaacgcccatcgaggaactctgccccccagatatatgtacatgtgtgatgtttctcttttatgggaactgggtcatcaagcatgtgtctttagtctggatagctattgttaaactgcctacaaactgagcagatctattaatatcagttacacttgggcctttggggtttgagan

SEQ ID NO: 4156 - DNA, 695 bp, Homo sapiens; identical to SEQ ID NO: 4155
  misc_feature 18, 32, 33, 695: n = A,T,C or G

SEQ ID NO: 4157 - DNA, 701 bp, Homo sapiens
  misc_feature 1, 701: n = A,T,C or G
nctaatgctggctgttgttctttttgcaggatcccatcgattcgaattcggcacgaggtccagaaatactctgatactagctatggtcagcaacatttaatgaaaacccttatgttaaaaataaacccctgcctcctggcttcaagcgattctcctgcctcagcctcctgagtagctgggagtataggcacgtaccaccacacccagctaattttttgtatttttactagagatgggtttcacagtgttagccaggatggtttcgatctcctgacctcatgatccgcccgcctcggcctcccaaagtgctgagattacaggcgtgagccactgtgcccggcctcaaaatcttaagaaaaggttcttttggtgcatggagttttacatggaataagttagtgcctctgcaatttaaatattttttacacagatttgatgctgtgcaaatgccctctccccttttaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttn

SEQ ID NO: 4158 - DNA, 704 bp, Homo sapiens
  misc_feature 1, 2, 3, 4, 28, 644: n = A,T,C or G
nnnnctaatgctggctactcgttctttncgcaggatcccatcgattcgggctaaaacccaggttcagcaacttcttgtctcaatcacccttcagtcagagtgtgatgctttccccaacatatcttcagatgagtcttatactttacttgtgaaagaaccagtggctgtccttaaggccaacagagtttggggagcattacgaggtttagagacctttagccagttagtttatcaagattcttatggaactttcaccatcaatgaatccaccattattgattctccaaggttttctcacagaggaattttgattgatacatccagacattatctgccagttaagattattcttaaaactctggatgccatggcttttaataagtttaatgttcttcactggcacatagttgatgaccagtctttcccatatcagagcatcacttttcctgagttaagcaataaagtgagtaaattgtattgtactctgtctacaaaaacattgggtatagtttcattacaagtttgtagcttaaatgtttgttcttatggatagaatcaaagtgtaaaaatcagatgtttatggtttttaatttttttggctgtgacttagcattttacatccataaaactttttttgttattgntataacggttactgtaattgttactgtgaatatcaacaatcttggggaagtgtaaatccg

SEQ ID NO: 4159 - DNA, 702 bp, Homo sapiens
  misc_feature 2, 3: n = A,T,C or G
gnnctaatgctggctcttgttcttttgcaggatccctcgattcgttttttaagagataaggtcttgctatgttatctaggctggcctaaacttctgggctgaagtgatcctcctgtgtagctgggactacaagcatgtgccaccaatgcctggcttctcacactgttttgtaacatagatatgtgaagatgtgtattatagaattgtttgtaatactgtagtgttgtaggcaatgtgactgtctatagggaagtggacaggttatttgtggtaaatactcatggaaaacggtcaagcagttaaaagcaatcaattatggtcacccagcaatgcagataaatcttaaaagcatatgatgctatgataccaaagcacaagcaccgcccctgtaaatagaggaattagatttcttcagcattaaaactttgtgcatcaaaggatagtatcaagaaagtaaaaagacaaatggagaatgggagaaaaatacttgcaaaccatgtatctgataaaggtctagtattcagaaaacaattcaacaataaaaaagacaaataactgagttataaatggcaaaggatttaaatagacatttctctatgtaaagaagatttacaaatagtcaataagcacatgaaaaagatgttcaacatcattactcatcagcaaaatgccaatcaaaaccacaatgaaataccatttcat

SEQ ID NO: 4160 - DNA, 761 bp, Homo sapiens
  misc_feature 2, 3, 4, 5, 9, 10, 11, 12, 13, 14, 15, 19, 24, 26, 562, 583,605, 620, 624, 634, 643, 645, 657, 731, 738, 760, 761: n = A,T,C or G
gnnnntttnnnnnnntttntaaananacaggctacttgttctttttgcaggatcccatcgattcgaattcggcacgaggccacacgggccgcatcatccctgcaatctggttccgctacgacctcagccccatcacggtcaagtacacagagagacggcagcccgcttgtacagattcatcaccacgatctgtgccatcattgggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttcctggggagccccaagaacagagtcaggcaaggggtggggagtncagggatcttggggacccctnctaggagagctgcagtctcttnccttaggggaacatnccanaatgcatatngatcagctntnagccaggctttngacaattttccagcccccaactaggtgggacacattaatgaatttgggtttttcccttgggcaagccaacctgncccaaangcaccaaaactggggcttttann

SEQ ID NO: 4161 - DNA, 716 bp, Homo sapiens
  misc_feature 84, 96, 313, 362, 437, 456, 544, 549, 577, 596, 615, 637,644, 651, 668, 671, 716: n = A,T,C or G
tacagctacttgttctttttgcagatcccatcgattcgttctcagatacctgatggatccagacacattcactttcaactttantaatgacccttnggtccttcgacggcgccagacctacttgtgctatgaggtggagcgcctggacaatggcacctgggtcctgatggaccagcacatgggctttctatgcaacgaggctaagaatcttctctgtggcttttacggccgccatgcggagctgcgcttcttggacctggttccttctttgcagttggacccggcccagatctacagggtcacttggttcatnttctggagcccctgcttctcctggggctgtgcccgggaaagtgcgtgcnttccttcaggagaacacacacgtgagactgcgcatcttcgctgcccgcatctatgattatgaccccctatataangaggcgctgcaaatgctgngggatgctggggcccaagtttccatcatgacctacgatgagtttgagtactgctgggacacctttgtgtaccgacagggatgtccttncaccntgggatggactaaaggagcacagccaanccctgagtgggaggctgcnggccattctccagaatcanggaaactgaaggatggcctcantctctanggaggcngagacctgggttggcancanaataaaagatttttttcaagaaatgcaaacagaccgtcaccaccn

SEQ ID NO: 4162 - DNA, 726 bp, Homo sapiens
  misc_feature 635, 686, 689: n = A,T,C or G
caggctacttgttctttttgcaggatcccatcgattcgaattcggcacgagtgaagaatggcgtgggttggttcctttcaaatgcacttgagcagcggtctccaaccacagggccacagagctggaggtgagcagcaggcgagtgaagggaaacttcatctgtatttctagcccctcccatcgcttgcatgaccacctgagctccatgtcctgtcagatcagcagcagcattagattctcacaggagcacaaactctgttgtgaagtgtgcatgcgagggatctaggttgtgtactccttatgagaatctaatgcctgatattctgttactgtctcccatcaccccagatggacagtctagttgcaggaaaacaagctcagagatcccactgagtctacgttatagtgagttgtagaatcatttcattatatattactatgtagtaataatagaaataaagtgcacaatatatgtaatgcacttgaatcatcctgaaattattccctcattcccagtctgtggaaaaattgtcttccacacattcactctgttttttggtagaggcagggtcttaatatattgcccagtctgatctcaaactcctggcctcaagtaatatacctctcttagcctnccaaaagtgctgagattacaggcataagcccccccctcaaccaagactttnttnaaccaaataaaaattaagtgagattactttggcccag

SEQ ID NO: 4163 - DNA, 841 bp, Homo sapiens
  misc_feature 5, 480, 527, 530, 566, 599, 613, 620, 649, 665, 668, 671,696, 700, 702, 720, 723, 745, 770, 771, 772, 777, 779, 786,809, 810, 815, 826, 831, 833, 839: n = A,T,C or G
tacangctacttgttctttttgcaggatcccatcgattcgaattcggcacgaggtcccttgctcggggccatggagacactgcggccagtacggcggcgcctctgtctgaagaaggggaagtgacctccggcctccaggctctggccgtggaggataccggagcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggcttgcccacggtactctggagctgcaagcccgagatccttgccccgcccggccttccacgccggaggcccanaaccgaaaaggaaaagatcccgatgaaggagcccggaggcccaaaanaanaaggaaagagggaaaaaacccacacattgccccacnggaatttggaatttttgattgaatgagcccaantggaccacccaaanggacttncccttgattggaacccgggagaaccccancccccaagggaaagcnttnaancccccgggaagccccagaaaaaccngggnangggcccccccccttgggnacnaaagggtggcctttttccgggnccctttgaaaggagggaccccccannnaaagncnttgggangggaaaccaaaaaatcccctttnngtaanccccggggaanggggnancccttntt

SEQ ID NO: 4164 - DNA, 741 bp, Homo sapiens
  misc_feature 2, 3, 4, 5, 6, 9, 10, 11, 12, 13, 14, 15, 16, 17, 20, 22,25, 27, 478, 515, 543, 576, 595, 606, 608, 623, 631, 634,642, 651, 659, 673, 679, 688, 689, 690, 695, 698, 701, 740,741: n = A,T,C or G
gnnnnnttnnnnnnnnnttntntananacaggctacttgttctttttgcaggatcccatcgattcgcagaaattcaaataattcttttctgcttcaatgccagcagaaggtcccccaggtagacatggagaagcactttgttttaaataggagggtttcatagttgcatctgaagccacctggttctgttaaactgtatcgtgcaggttttgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtgtgtgtgtgtgtgtgtatgtatatatatatatataaatatctttcccaatatgccccgttgacagtgtttaaattccanactaggactgctgatctgcacaatttaattatgtggntattcgagcacttaatttcactcaaggntcattgggctctgctcttctccctgccattacnggagctgtggacagagctncctccttcaanantctagtggttttgcncaacaggntgnccaatganaaaactganttgcgtgnctgtaaatgttgcncagggngcacatctnnnagggntcnatnctccggcctgtcctccaaaagggctgggccttgggcccnn

SEQ ID NO: 4165 - DNA, 751 bp, Homo sapiens
  misc_feature 3, 4, 5, 6, 11, 12, 13, 14, 15, 22, 24, 30, 105, 463, 505,687, 701, 719, 728, 732: n = A,T,C or G
ggnnnnttttnnnnntactganancctttngctacttgttctttttgcaggatcccatcgattcgaattcggcacgagaggcgatatccctgagctgagagcatnaccctgtccccgaatccttctttcctctctgttttgtttttcattcccctccctctctcccctccccctccagtccacgacgactgggctgttgaccctgttcaggcctcggtgaaggcttttggttactccccttcccaccccatcccttaattttattcttttgaagagtgcatttcaagctgccaaggtggagagagggattacagaaaggagaacaccttatttcagaaaaggtgtaccatacctgagagcaccaggaagtcgcatgagagatcacctgatacatgaacgtatgatgttccatctgcgcattgatgaataggcagcatttacaaattaactgatgtgttgctgnatatcatctctttgatgattgctcctcttctttgtatcctgncttataatttcaacacatttgcgatactcaatgtctattctaaattaaccatgttttgtaccacaaactcattgcccatggatctgttgctgaaacaaggaagtcttaaacaagaagtggaatctttctgttatcagattgggtctgaatcaaatgatcagaagggtgggaatattacaaantgaagaataacagntgcaaccttcagtttctnaaaaataanaagngagcttttcagggcaaatt

SEQ ID NO: 4166 - DNA, 705 bp, Homo sapiens
  misc_feature 1, 14, 26: n = A,T,C or G
nctaatgctgggcncttgttcttttngcaggatcccatcgattcgaattcggcacgaggtctagtataatcttgatgctcaaaccagataaggacaatacaagaaaggaagagtataggctaattctacccaataactaaatgaagtattagcaaaccagattcatcaataatcttttaaaaatcaagaattaattggatttaggaatataacactgtgtataacaagtttaagagaaatatatgagaatgataagactgcaattgaaagtagaggctttctctggagggaaaggtgaggaggatgtgatttggaagaacagcatggggaggcatcagttgtattgtaatgtttattttttaagctgaatgataggtacgtagatgttcattgtgttctttttgcctttttgtatatcttaaatatatggtagtgccatgattagcaggcttaatagccttgtgagtttaaatgtcactttcaaatgctgtatttttggtggagttgcttaaacacattccccttggaatctatacaaccagttaaaaaaatcatgtataaaccaccatgaaatataatgaaatgtactgtatatgcattttcatgaatgttgtgtcaaagggcttgtaggaaaaaaagatcgttaactcttttgcattcagtgaaaataggtggctttggaaatagtttcagccttgctaacac

SEQ ID NO: 4167 - DNA, 761 bp, Homo sapiens; identical to SEQ ID NO: 4160
  misc_feature 2, 3, 4, 5, 9, 10, 11, 12, 13, 14, 15, 19, 24, 26, 562, 583,605, 620, 624, 634, 643, 645, 657, 731, 738, 760, 761: n = A,T,C or G

SEQ ID NO: 4168 - DNA, 712 bp, Homo sapiens
  misc_feature 3, 9, 11, 13, 18, 23, 24, 39, 44: n = A,T,C or G
gtnctaatngngngctcncggcnngtccgcaacagcccngcggntcgaattcggcacgaggccttttgtggggtctcatacataactcagtttccacaaagctgtgccccagctcagccctatggatagaagcatggtctggggttcctttgctgaccagggtgtgtgctttgtccaagttactgaccttcccaaacctcatcaatgcacataaaaagagcacttgcaaacaatgaatctagacatggaccttcacaaagaaataactcaaaatggatcccaggcctaaatgaaaaatgaaaaactataaaactcctagaagataacataaaagaagatctagatgacctagggtttggcaatgactttttagatccagcaccaaaggcaggatccaggaaagaaataattgataagctggacttcattaaaacgaaaacttctgctctgtgaaagatgctgccaaaaaatgaaaagacaagccacagactgggagaaaatatttttgatggaaatatctgagaagagaggcttgttatccaaaatatacaaagaatttctaaaactcaataatttgaaaataaacaacccaatttaaaaagtgggccaaagatcttaaatgacgcctcaccaaagaagatacacagatggcaaataagcatatgaaaagatgctcccggctgggcacggtggctcacgcccgtaatcccgc

SEQ ID NO: 4169 - DNA, 1249 bp, Homo sapiens
  misc_feature 2, 25, 26, 27, 33, 34, 35, 36, 217, 278, 383, 401, 431, 450,458, 465, 490, 546, 556, 566, 579, 584, 603, 613, 622, 630,632, 656, 679, 696, 729, 745, 785, 791, 805, 823, 830, 834,885, 985, 1025, 1055, 1085, 1249: n = A,T,C or G
angctactttgttctttttgcaggnnntttttnnnnatacagctcttgttctttttgcaggatcccatcgattcgaattcggcacgagaaaacacacacacacacaacacaatgttttcacgcctgtaaacctagcacattgggaagccaaggtggggagggattgctttgaggccagggaagttcaagggctgcaagtggagcttatgaattggcncacctggtacctcttagccctgggggaggaacaagaagtggaggaacacctggtcttcttnaaaaaaaaaaaaaaaaaaaaggtttttttttggaaaccccttttaaaaaaattaaccttttttggttttttgggaaaatttttcctttaaaattccaattccaanttttccaaaaaaaaaggnaaggcccaaggtttaaaaaaaaaaaaaatngggggttttaaaccttttngggttttnccttttngggttaacccaaaagggccctttancctttaaaaatttttaagggaaacctttaatttaaggtttaaggggggaaattaantttttttttnaaaaaaaggnaaggcccttgggnaaaanttccaaccctttttttttngggggttaanttttttttngggggttnanttaaaaaaaattaatttttttttnccaatttttttgggttttaaatnggttccccccccaaggntaaattaaattttcccttttaaaccttgggggnaaaaaaaaattttccnttttgggttttttttgggaaattccttgggcccccttggnaaaagnaaaaaaaaattaanttccttggggtttttttnccttaanttanttaaaaaaaaaaaaaaaatttttttttttttaaaaaaaaattaaaaatttnggttaaaaaagggttttaagggaattttttaaaaaaaaattttggttaaaaaaaaattatttaaaaaaaattccaaccaaaaagggggaaaattggttanccccttttaatgggaaaatgggtttgggtttgggacccantttttttaattggaaaaaatttaattggtnggggatttccaattatttacctgggtttanccaaaggaataaggaaaatttggaaatgggccaaaaaaggacccaaaaaccctcaattaaaaatttgagggaaaacgtggttattatgtaattgaaataaaaacattttataattgtaaaaaaaaaaaaaaaaaaactcgagcctttaaactataggggtcgtn

SEQ ID NO: 4170 - DNA, 760 bp, Homo sapiens
  misc_feature 6, 8, 9, 11, 39, 43, 56, 729: n = A,T,C or G
ttaaananntngctcttgttctttttgcaggacctttcnaaanacagctcttgttnttttgcggatccctcgattcgtttctatacaatttttccttctgatccagagacacggaaaaacaaagggcaagatggaaataagggatgagaaggtctatgtggaaaaacagttacaactgggagtgggtaactgcaaaaccaagcagcttcatgtgatcgttaggacagaagaaatttctcctttgtagcctagagcaatattctcaaaatttaatgcgcatgttaatcatttggggatcttttattcattttttcatgtggggatcttttaaaaatgcaaattctgatttggtaagtctggagtaggtcctgagcttctgcatgcttcaaaagctgattatgttttgagaacatggatctagatgctggtattgaggtgggagacaagtactgccacctgaaacaacagtcttggtaaatttagcccgacgagggtaaacacatcctaacagggaaggtaaactgtcgtccatcagtaccactagagggcatcactggtttatagttcaatacagtgaatatatcagaataatggcctttagttttcctgaaagattaaattaggcttgctaacttgtttaatgagataatcaaacatatgatgtaattttaaagggtttacatttttaaaaattaatagggtatcagttactaattttacttaaatggnactctgtaagcttaataggtatgcttaaata

SEQ ID NO: 4171 - DNA, 760 bp, Homo sapiens; identical to SEQ ID NO: 4170
  misc_feature 6, 8, 9, 11, 39, 43, 56, 729: n = A,T,C or G

SEQ ID NO: 4172 - DNA, 752 bp, Homo sapiens
  misc_feature 32, 720, 752: n = A,T,C or G
agctcttgttctttttgcaggatcctttcaanatacagctcttgttctttttgcagggtcccatcgattcgtttctatacaatttttccttctgatccagagacacggaaaaacaaagggcaagatggaaataagggatgagaaggtctatgtggaaaaacagttacaactggagtgggtaactgcaaaaaccaagcagcttcatgtgatcgttaggacagaagaaatttctcctttgtagcctagagcaatattctcaaaatttaatgcgcatgttaatcatttggggatcttttattcattttttcatgtggggatcttttaaaaatgcaaattctgatttggtaagtctggagtaggtcctgagcttctgcatgcttcaaaagctgattatgttttgagaacatggatctagatgctggtattgaggtgggagacaagtactgccacctgaaacaacagtcttggtaaatttagcccgacgagggtaaacacatcctaacagggaaggtaaactgtacgtccatcagtaccactagagggcatcactggtttatagttcaatacagtgaatatatcagaataatggcctttagttttcctgaaagattaaattaggcttgctaacttgtttaatgagataatcaaacatatgatgtaattttaaagggtttacatttttaaaaatttaatagggtatcagttactaattttacttanatggactctgtaagcttataggttgcttaaan

SEQ ID NO: 4173 - DNA, 752 bp, Homo sapiens; identical to SEQ ID NO: 4172
  misc_feature 32, 720, 752: n = A,T,C or G

SEQ ID NO: 4174 - DNA, 757 bp, Homo sapiens
  misc_feature 5, 6, 7, 8, 9, 10, 11, 12, 13, 14, 15, 16, 22, 23, 24, 26,32, 33, 34, 36, 37, 636, 657, 663, 667, 697, 708, 724, 753: n = A,T,C or G
ttggnnnnnnnnnnnnttttannntncagctnnngnnagctcttgttctttttgcaggatcccatcgattcgaattcggcacgaggttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagccggcacactcaatggcaaacacagcacccgagtctgctctgaatcctggaggatctggccctcctctcaacccccactcacagtcaccgtcttacaactcagggccacctgggatcagtcatcagtcagggtgcgtaagccttgaataccaggtagcctcaggagtgaaaagataaatgtcctagatcattaccttattcagtgtccccaccttgcagcgcattccaaccacctgggagcatttaaaactccagatgcccacaccacaccctggggcccccatcagaccttntggaagcaagacctgggcctncatggncccnaaaactcctaggggatccgatgtgcagccnaatcttgaaanggcccatttaaaaaanaaagaacatgggtggtacattggggagtnttta

SEQ ID NO: 4175 - DNA, 755 bp, Homo sapiens
  misc_feature 2, 3, 4, 5, 8, 9, 10, 11, 12, 13, 14, 15, 19, 21, 22, 24,146, 755: n = A,T,C or G
gnnnnttnnnnnnnntttntnnanatacaggctacttgttctttttgcaggatcccatcgattcgtctccttgcctttctcctgaaaggtatgagactacttgccttactgtcatattattgaggggaatcagccgcaaagcctgnggaaaatgaacagtagctgtggggtcaaagccatgtctccaggttcacgggctcactccccccaggacaagcctagttaggtagtgggctgcatctgggtatccctgggacagaaatgcaggtgagaaggggtatcaagaatgcctcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaattcgcggccgcggcgccaatgcattgggcccggtacccagcttttgttccctttagtgagggttaattgcgcccttggcgtaatcatggtcatagctgtttcctgtgtgaaattgttatccgctcacaattccacacaacataccagccgggagcataaagtgtaaagcctggggtgcctaatgagtgagctactcacattaattgcgttgcctcactgccctttccaan

SEQ ID NO: 4176 - DNA, 705 bp, Homo sapiens
  misc_feature 14: n = A,T,C or G
caatgctggttctngttctttttgcaggatcccatcgattcgaattcggcacgagggatgacccatgccaaaaatactatgagctcttactagtcaaccctatttggttggtcccaccaacaaaggcacttgcagttacattcaccacatttgtaacggagccattgaagcatattggaaaaggaactggggaatttattaaagcactcatgaaggaaattccagcgctgcttcatcttccagtgctgataattatggcattagccatcctgagtttctgctatggtgctggaaaatcagttcatgtgctgagacatataggcggtcctgagagcgaacctccccaggcacttcggccacgggatagaagacggcaggaggaaatcgattatagacctgatggtggagcaggtgatgccgatttccattataggggccaaatgggccccactgagcaaggcccttatgccaaaacgtatgagggtagaagagagattttgagagagagagatgttgacttgagatttcagactggcaacaagagccctgaagtgctccgggcatttgatgtaccagacgcagaggcacaccgaaagaaagcagtactgaaagcagccagtcggccaagcctgtctctggccaagacacatcagggaatacagaaggttcacccgcagcggaaaaggcccagctcaagtctgaagc

SEQ ID NO: 4177 - DNA, 703 bp, Homo sapiens
  misc_feature 7, 19, 20, 25, 36, 43, 44, 45, 701, 703: n = A,T,C or G
tgctggnctaaatgctggnnatcgntctttccgcantagaacnnncgattcgaattcggcacgaggctacctgggcggcgacgggctggacgtggacgtgcccacgcgtctggagggctggttcttctgcacgcccgcccgcaagctgctctggctggtgctgcagcccttcttctactcactacggccgctctgcgtccaccccaaggccgtgacccgcatggaggtgctcaacacgctggtgcagctggcggccgacctggccatctttgccctttgggggctcaagcccgtggtctacctgctggccagctccttcctgggcctgggcctgcaccccatctcgggccacttcgtggccgagcactacatgttcctcaagggccacgagacctactcctactatgggcctctcaactggatcaccttcaatgtgggctaccacgtggagcaccacgacttccccagcatcccgggctacaacctgccgctggtgcggaagatcgcgcccgagtactacgaccacctgccgcagcaccactcctgggtgaaggtgctctgggattttgtgtttgaggactccctggggccctatgccagggtgaagcgggtgtacaggctggcaaaagatggtctgtgagcccaggctgcctcctggtggtggccattgtcccccatcggcccctcaccttgcaccccancn

SEQ ID NO: 4178 - DNA, 696 bp, Homo sapiens
  misc_feature 12, 21, 28, 696: n = A,T,C or G
tgctgggctctngttcttttngcaggancccatcgattcgaattcggcacgagaaggacctgcagcttcagcatcacttgagaagttgttaggaatgcatactagtgggccccgcccccagacatagtgaatcagaaaccaacagggaggcgcctagcattgtttttttaacaagtgctgggttattctgatgcacagtctagtttaagaaccactactttgggtaaacgttttgactgtttaaagtttatggcggtgaagtgggcatcttcaaagactagtacttacacagtttagaagatttcaaggtactgctgacagtagtttattatgtcagtatacatacgtgtagagatcataatttagttcccttcttaatgttacaatttcttagtttacttttcctaaagggccatagcataattcttgattcctggtggaaatcttttctgaggtgtgggggtgggcaaggtgtggattgctgtttacgatagtgccttcattagttttagttctgtctgttttcattcattattgactcaaaggtattagaacaggcccttatctttttcctattagatttatttttgttttttactttatgtaagttcagaatccttttttaagtgatgactactgatgaaataatgttactagtagctgaattttagacttgatgctatgttgattaatatn

SEQ ID NO: 4179 - DNA, 736 bp, Homo sapiens
  misc_feature 3, 9, 10, 11, 13, 17, 18, 23, 28, 36, 39, 65, 74, 80, 87,131, 133, 140, 141, 148, 174, 177, 189, 195, 200, 202, 210,213, 214, 222, 223, 225, 236, 239, 247, 249, 254, 256, 270,275, 303, 345, 373, 376, 393, 394, 404, 405, 415, 420: n = A,T,C or G
  misc_feature 450, 456, 461, 462, 466, 485, 487, 489, 490, 493, 497, 498,500, 502, 507, 518, 521, 522, 530, 538, 540, 541, 549, 551,558, 560, 561, 564, 565, 568, 573, 575, 578, 580, 583, 588,592, 594, 600, 608, 618, 622, 623, 625, 626, 629, 630: n = A,T,C or G
  misc_feature 637, 638, 642, 650, 652, 654, 668, 678, 689, 698, 701, 716,717, 718, 720, 735: n = A,T,C or G
gtncctaannngngtgnnggcangctcntatctctnaanagaattgggctttgtcgaattccgcncggagacantctgancgtgctngagcagctgattatcaagcccggggtgcgccagatccatctgtncnacggacnngcgcggnttgaccgagcatgaggctgcctgaangangaccaggggctntttgtncacangngtccaggncannaccgctgnntnccttgtggtgntgngctatggngnccagntnttgcacattgacanacttnactgcactgggtgggagctcgcacattngcccatttgtggtagaatcaaggcatcacccgataagattgncgtggtggaaacgtcacagtccgaccanttngactgtcaccatgccanntgacagcatnnatactttctngcttntagatcactacggggaagatactctctatngtcaanggganntatncttccgaaactgcctcctnancnnccnctanncntntgacngataccgtcanaannatatctgnctgaaggncnnatatatcntngcatatncnnganncgnatggnancgntntanccctnaccntnatcccnagtgcgancttactatcncatnntnnaannagtttgnnttcncttctggnanancacacccatggacnactgcatccncagatgccttnattcactgntanccttggcctgcactnnngngctttccctccttanc

SEQ ID NO: 4180 - DNA, 706 bp, Homo sapiens
  misc_feature 1, 2, 3, 34, 39, 705: n = A,T,C or G
nnncaatgctggctgctcgttctttccgcaggancccancgattcgaattcggcacgaggaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtattacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgtttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacattttng

SEQ ID NO: 4181 - DNA, 703 bp, Homo sapiens
  misc_feature 12, 16: n = A,T,C or G
caatggctggtngctngttctttttgcaggatcccatcgattcgtgtggagaaccttctttttctatgggaaatcacttctggagttggcaagaatggagaatggtgtgttgggaaacgccttggaaggtgtgcatgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctgg

SEQ ID NO: 4182 - DNA, 761 bp, Homo sapiens
  misc_feature 12, 132, 141, 145, 146, 149, 152, 153, 155, 158, 160, 161,163, 165, 181, 189, 192, 198, 206, 224, 228, 230, 233, 236,238, 240, 242, 244, 254, 260, 286, 292, 296, 308, 315, 323,327, 334, 340, 345, 352, 357, 365, 373, 374, 376, 379: n = A,T,C or G
  misc_feature 385, 389, 391, 416, 417, 418, 420, 421, 423, 437, 438, 442,446, 456, 465, 482, 490, 494, 506, 509, 513, 532, 533, 535,536, 539, 542, 549, 563, 569, 576, 581, 591, 593, 602, 603,604, 609, 610, 612, 614, 616, 618, 624, 625, 627, 629: n = A,T,C or G
  misc_feature 644, 646, 647, 658, 659, 663, 666, 669, 676, 677, 682, 683,685, 690, 691, 692, 695, 696, 697, 698, 702, 705, 708, 710,712, 715, 718, 722, 728, 730, 731, 739, 743, 746, 747, 748,754, 755, 759, 760: n = A,T,C or G
ctaatgctggcngcttgttctttttgcaggatcccatcgattcggaatgagagctgctatttgtgtttaaaaagaccatacagggccagccacagtggctcacacctgtaatcccagcactttgggaggtcnatgtgtttncacnnctnttnntnagnannantntgtcatggaggcttantttgtggngtntgatgncatactgntaggccaacatgtgtccnaggnanagnggnangntnangccattagcntggtgnaaacttgccggatgttgatgctctantaaganccgnatgtgccatttntgaactntttagtantganggagtcntggtgntcaanatggatntacanatgcctanttacccgnncntgnctaacnagantntgcccaaccttcatgtcatgaaggnnntnnantcttttattcccanngttncctnaaacgaacantttgcctgnacacattttctactggnaccttacnaatnaggttatcccgnatnttcntgattacttttcttctgcnncnnganatngtgcctntcaccctactcctntatccntccattnacctnttaggccatncncctaaacgnnntgcanntntnancntccctnntnangaattttctaaatangnnttaattctctnncctnacnttnctcttcnnttccnngnatttnnnttnnnnttcnctnttngntntcnccnctanttcaancnnctcttaantttngcnnntcctcnnttcnnt

SEQ ID NO: 4183 - DNA, 706 bp, Homo sapiens
  misc_feature 1, 31, 33, 37, 282, 629: n = A,T,C or G
nctaatgctgggctatcgttctttccgcagnancccntcgattcgagtggctgagtggaggcgcccagacctgggcaggcagcaggctcaggcccacaccttgtgatttttgaaaccaaagcccagaagatgatgtttacttctctctccctggctctgcccttcttactgcaaaccatgctgtgccttagggcccttctcatagctgttcctcatggccatgactggaacagggatgcaacctctttctacacaagcacagttagttgggtgaagtctttnttttgtttgttttagacggagtttcactcttgttgcccaggctggagtgaagtggcgtgaccttggctcactgcaacctccaggccagcctcagcctccctagtagctgggactacaggcacccactaccacgcctggctaattctttgtatttttagtagagatggggtttgaccgtgttagccaggatggtctcgatctcctgacctcgtgatccacccacctcggcctcccaaagtgctgggattataggtgtgagccaccgcgccgggccggttgctggcatcttaatgttctgtaggtggaatatttccaataaacacaaggtgccgtaattgaaaaaaaanaaaaaaaaaacttcgagcctctagaactatagtgagtcgtattacgtagatccagacatgataagatacattgatga

SEQ ID NO: 4184 - DNA, 706 bp, Homo sapiens
  misc_feature 12, 16: n = A,T,C or G
ctaatgctggtngctngttctttccgcaggatcccatcgattcgaattcggcacgaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcccaccaacattgacttcttactcaacctgtctggccacccagagtttgaagctgggaacgtgcacactgatttcatccctcaacaccacaaacagttg

SEQ ID NO: 4185 - DNA, 709 bp, Homo sapiens
  misc_feature 1, 2, 19, 21, 22, 27: n = A,T,C or G
nnctaatgctgggctgctngnnctttntcgcaggatcccatcgattcgaattcggcacgaggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggccgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactgc

SEQ ID NO: 4186 - DNA, 715 bp, Homo sapiens
  misc_feature 7, 20, 22, 23, 24, 28, 30, 34, 36, 43, 615, 714: n = A,T,C or G
gtcctanagtgtggtctcgncnnnccgnangagntnggcgggngcgaattcggcacgagcagaacttcacagcagcctgtcctcatcagcaacccaaccaccttcatcagcaacccaaccaccttcatcagcaacccaaccacctcgtcagcaacccaaccacctcgtcagcaacccagccaccttcatcagcaacccaaccacctcatcagcaacccagccaccttcatcagcaacccaaccacctcatcagcaaaccaaccactttcatctgcaacccaaccactttcatcagcaactcaacaccttcatctgcaacccaaccaccttcatcagcaaaccaaccaccttcttcagcaacccaaccacctcatcttggagaaggagaaggaactgcaagccaccaagtcttcatttttcagggtttgtaatcttcccaaagttttcctttgaaaataggataatgggtggaattttcagagtgattacatacctcaacatttttattaacatacaacaatgggaaagttcatcatccatatactgcagtcacttaaacaacagccaattattgcaagattagaattggagatcttgtcctcaaaagtataaatngtcctttgagttatagaaaataatggaattgggatttctacatatcattattatacctattttaaatttaatgggcagccaggcatggttccagctacnt

SEQ ID NO: 4187 - DNA, 708 bp, Homo sapiens
  misc_feature 13, 23, 33: n = A,T,C or G
ctaatgctggctngctcgttctntccgcagtanccctcgagtcgaattcggcacgagactgcctccttccacacgagtgcccctttggccaaagaagattattatcagatattaggagtgcctcgaaatgccagccagaaagagatcaagaaagcctattatcagctgctctgctcagttagtttttattcccggggtaccaagcagctgcacagtcggtgcctgggaggcacgtagaggcccctggctcaggcagagggagatggttagactcttgcagggctaaaactctaatttggaattgaatattgtggatatcttagttaaaggccatgcttacagcttagaaatgaagccttaagctgcatcatcatatcgccctgtgtggtctgcaggggagcaggacaagccaagcagaaaaagcgagtgatgatccctgtgcctgcaggagtcgaggatggccagaccgtgaggatgcctgtgggaaaaagggaaattttcattacgttcagggtgcagaaaagccctgtgttccggagggacggcgcagacatccactccgacctctttatttctatagctcaggctcttcttgggggaacagccagagcccagggcctgtacgagacgatcaacgtgacgatcccccctgggactcagacagaccagaagattcggatgggtgggaaaggcatcccccggattaac

SEQ ID NO: 4188 - DNA, 713 bp, Homo sapiens
  misc_feature 3, 4, 10, 23, 37, 41, 713: n = A,T,C or G
gtnnctaatnctgggctctcgtnctttctcgcagtancccntcgattcgaattcggcacgaggagacagcagcccccagggaatgaagctgatgccagagtcagacccgaggaggaagaggagccactgatggagatgcggctccgggatgcgcctcagcacttctatgcagcactgctgcagctgggcctcaagtacctctttatccttggtattcagattctggcctgtgccttggcagcctccatccttcgcaggcatctcatggtctggaaagtgtttgcccctaagttcatatttgaggctgtgggcttcattgtgagcagcgtgggacttctcctgggcatagctttggtgatgagagtggatggtgctgtgagctcctggttcaggcagctatttctggcccagcagaggtagcctagtctgtgattactggcacttggctacagagagtgctggagaacagtgtagcctggcctgtacaggtactggatgatctgcaagacaggctcagccatactcttactatcatgcagccaggggccgctgacatctaggacttcattattctataattcaggaccacagtggagtatgatccctaactcctgatttggatgcatctgagggacaaggggggcggtctccgaagtggaataaaataggccgggcgtggtgactttgcacctataatcccagcactttgggan

SEQ ID NO: 4189 - DNA, 710 bp, Homo sapiens
ctaatgctgggctgcttgttctttttgcaggatcccatcgattcggaaaagttaaaaaagacattgagtgatgtaatccaccctgggggcaatagccatattgccaatggtgcggccgggtgtgtggcaacattacttcatgatgcagccatgaaccctgcggaagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggtt

SEQ ID NO: 4190 - DNA, 712 bp, Homo sapiens; identical to SEQ ID NO: 4168
  misc_feature 3, 9, 11, 13, 18, 23, 24, 39, 44: n = A,T,C or G

SEQ ID NO: 4191 - DNA, 705 bp, Homo sapiens; identical to SEQ ID NO: 4166
  misc_feature 1, 14, 26: n = A,T,C or G

SEQ ID NO: 4192 - DNA, 761 bp, Homo sapiens; identical to SEQ ID NO: 4182
  misc_feature 12, 132, 141, 145, 146, 149, 152, 153, 155, 158, 160, 161,163, 165, 181, 189, 192, 198, 206, 224, 228, 230, 233, 236,238, 240, 242, 244, 254, 260, 286, 292, 296, 308, 315, 323,327, 334, 340, 345, 352, 357, 365, 373, 374, 376, 379: n = A,T,C or G
  misc_feature 385, 389, 391, 416, 417, 418, 420, 421, 423, 437, 438, 442,446, 456, 465, 482, 490, 494, 506, 509, 513, 532, 533, 535,536, 539, 542, 549, 563, 569, 576, 581, 591, 593, 602, 603,604, 609, 610, 612, 614, 616, 618, 624, 625, 627, 629: n = A,T,C or G
  misc_feature 644, 646, 647, 658, 659, 663, 666, 669, 676, 677, 682, 683,685, 690, 691, 692, 695, 696, 697, 698, 702, 705, 708, 710,712, 715, 718, 722, 728, 730, 731, 739, 743, 746, 747, 748,754, 755, 759, 760: n = A,T,C or G

SEQ ID NO: 4193 - DNA, 779 bp, Homo sapiens
  misc_feature 225, 386, 417, 578, 581, 606, 620, 660, 691, 704, 733, 753,779: n = A,T,C or G
atacagctcttgttctttttgcaggatcccatcgattcgaattcggcacgaggactgttcatcctaagttccactataaacaggctcatgactcgggcacagacacttcttgcgtgactttttcctatgatggtaatgtccttgcctctcgtggaggtgacgattcattaaaattatgggacatccgacaatttaataaaccacttttttcagcctcgggtcttnccaccatgttcccaatgactgactgctgtttcagtccagatgataagctcattcactggtacatctattcaaagaggatgtggcagcggcaaacttgttttctttgagcgtaggactttccaaagggtgtatgaaatagacatcacagatgcgagtgttgntcgctgcctgtggcatccaaagctgaaccanatcatggttggaactggaaatggattggctaaagtctattacgaccccacaagagtcagaggggagcaaaattatgtgtggttaaaacccagcggaaggcaaaacaagctgagactctaactcaggactacatcatcacccctcatgccttgcctatgttncgngagccccgccaacggagtacaaggnaacagctggagaangacagactggatcccctgaagtcgcataaacctgaacctnctgtaccaaggcccaggtcgtggtggccgantttggaacccacnggggcactttttttttctatattgggaanaacattgttttggacaaaancgatgacagtaattcttcgggaagcn

SEQ ID NO: 4194 - DNA, 704 bp, Homo sapiens
  misc_feature 7, 38, 42: n = A,T,C or G
atgcggncaatgctggctactcgttctttccgcaggancccntcgattcgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgctcctccagaggtctgcacactccacttcacatgccgttgactctcacagtctaagacttcagggccgggacctttgtccagcctgcacagtagagtgaggctgcctctc

SEQ ID NO: 4195 - DNA, 924 bp, Homo sapiens
  misc_feature 2, 3, 4, 5, 8, 9, 10, 11, 12, 13, 14, 15, 16, 17, 18, 19,20, 22, 23, 26, 27, 28, 29, 30, 31, 34, 35, 41, 68, 76,80, 82, 97, 122, 126, 127, 128, 141, 142, 148, 151, 157,252, 258, 259, 272, 281, 310, 318, 347, 361, 393, 414, 425: n = A,T,C or G
  misc_feature 426, 428, 433, 444, 447, 448, 451, 457, 467, 477, 481, 483,485, 501, 511, 536, 554, 562, 565, 572, 578, 589, 590, 591,597, 608, 609, 615, 621, 625, 628, 669, 670, 685, 696, 697,699, 701, 730, 735, 739, 743, 747, 758, 760, 769, 770: n = A,T,C or G
  misc_feature 772, 784, 792, 796, 798, 799, 810, 815, 818, 825, 830, 836,837, 844, 848, 853, 867, 887, 889, 894, 903, 907, 911, 916,922, 923: n = A,T,C or G
annnnggnnnnnnnnnnnnnannagnnnnnnagnngttgantttgaaacctttagcccttttgcagancccaccgnttcngnagatgatgtggatanacttggatactcccttgagtggaanatannngtgttcagactgnncaagtntanctccanagactttgaagtctgctacccagaggagcctctcagggactggccggagatctccctgctgaccgagaacgaccgccactaccacattccagtcntttaannccgctgggggccnaacagcagngctcaccagtgacggtggtcacagttgcnataaagtngtctctgaaaccaaagctagcatttcacnatggaaggaattangacctattcttcaggattacaggtacactggntgcaagccatgcatggatggnttttcttaatnntncagtngatttgctctnaanncanctgcanatgaaaacanttggcgagtngggngncnggactttgacccatanagggggcgtnggccacttcacatgatgggcggggnctattgggaccacaaatnaaaggccngcntggacancaaacntgggaaaaaannnaagaangaaaaaccacnntaaagngaaaanacangcntgaccttgggagaggaaaaaaaaaccaagttttaaccggtnnatggttcattcattnaaaaaaacctnnancntcggacttgtattttggaggggatttaantaccnaaanaatngggnccttatttttnanaataaagcnnanaaccttttaccnaaagaaancccnanntttgggaatantggcnatntctaaangggancccatnngggattnaacnttgtnaaaaattaactaanactttcgggggaaaagttgncnaaatngaaggtggntcanaaanaaaanaagaanng

SEQ ID NO: 4196 - DNA, 924 bp, Homo sapiens; identical to SEQ ID NO: 4195
  misc_feature 2, 3, 4, 5, 8, 9, 10, 11, 12, 13, 14, 15, 16, 17, 18, 19,20, 22, 23, 26, 27, 28, 29, 30, 31, 34, 35, 41, 68, 76,80, 82, 97, 122, 126, 127, 128, 141, 142, 148, 151, 157,252, 258, 259, 272, 281, 310, 318, 347, 361, 393, 414, 425: n = A,T,C or G
  misc_feature 426, 428, 433, 444, 447, 448, 451, 457, 467, 477, 481, 483,485, 501, 511, 536, 554, 562, 565, 572, 578, 589, 590, 591,597, 608, 609, 615, 621, 625, 628, 669, 670, 685, 696, 697,699, 701, 730, 735, 739, 743, 747, 758, 760, 769, 770: n = A,T,C or G
  misc_feature 772, 784, 792, 796, 798, 799, 810, 815, 818, 825, 830, 836,837, 844, 848, 853, 867, 887, 889, 894, 903, 907, 911, 916,922, 923: n = A,T,C or G

SEQ ID NO: 4197 - DNA, 785 bp, Homo sapiens
  misc_feature 9, 525, 751, 752, 753, 755, 759, 760, 761, 762, 763, 764,765, 766, 767, 768, 769, 770, 771, 772, 773, 774, 775, 776,777, 778, 779, 780, 781, 782, 783: n = A,T,C or G
ttacatcanctcttgttctttttgcaggatccctcgattcgggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctcccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggangggttatttgtcatttacagtattggggtttttatgaatgtgaagcaaacaaaaaaaatttgtatgtaaactggaaataagaaaatacattagcaagccttaatgggtatccttactttgagtccacatggggttggacagtccccacaccccattaaattcttgtaaatgaaagccccccttttgttaaaaaatttgctctaataaaaacataccaaatcctggnnnanaaannnnnnnnnnnnnnnnnnnnnnnnnct

SEQ ID NO: 4198 - DNA, 785 bp, Homo sapiens; identical to SEQ ID NO: 4197
  misc_feature 9, 525, 751, 752, 753, 755, 759, 760, 761, 762, 763, 764,765, 766, 767, 768, 769, 770, 771, 772, 773, 774, 775, 776,777, 778, 779, 780, 781, 782, 783: n = A,T,C or G

SEQ ID NO: 4199 - DNA, 686 bp, Homo sapiens
  misc_feature 6, 16, 39, 57, 63, 73, 154, 160, 165, 170, 171, 176, 177,181, 183, 203, 214, 243, 276, 277, 278, 294, 315, 336, 338,373, 382, 385, 421, 427, 434, 439, 446, 478, 496, 499, 543,545, 561, 592, 599, 613, 621, 622, 640, 644, 645, 651: n = A,T,C or G
  misc_feature 684: n = A,T,C or G
tgtgcncggaaagatnagccaaatgctttcaaagagctngggacaggaaatagaatngctacngtggctgatntatatgagtgatgtgtctgcaggaggagccctgcttttgctgaattggagctagtgtttggcccaaaaaaggaactgctgntttggnataanctgtnngccanngganancgagattatagtacacggcntgcagcctgtncaggtgctagttggcaacaaatgggtatncaataaatggctccatgaacgtggacaagaatnnncaagaccttgttcttntcagaattggaatgacaaacnggcttccctttttctcctatngntggtactcttatgtgtctgatatacacatttcctngtcttaacnttnagggagttacaattgactaaacacttcatgattggnttcacnccatganccctnatcccanggtttcatttgtggacaattgcttacttttgnggggtcttttaaaaaggnacncgaaatcttcattattgccgtaaaaaccttaaagatctgttggnantcacaagaagacaaanggccgaaattttaaaggggagggaatttttntattttnaaagaacctttttnggttggannaaaaacataatttgagcnttcnncttttnagaattcccctaacatctcaggttgggtggggngg

SEQ ID NO: 4200 - DNA, 790 bp, Homo sapiens
  misc_feature 1, 2, 5, 6, 7, 20, 23, 36, 84, 109, 156, 178, 193, 527, 612,770: n = A,T,C or G
nnttnnnttttaaagacttncanctctttttctttntgcaggatcccatcgattcgaattcggcacggggggagcaaataatangcccttgtgtgtgtttttggcaganaagccatgaagacaagcagatgctaataaaagaatctgcatctttgnttgttattccatgttaaagggntgaaataaaggtaanagaatatttgtactgttgttatccaaatccatctcctgttctactctctattcaaaataatcgtacagtgactaacagagctttcagaccaacagtatttttatttttcattttaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacacgaatggggagaanaaggtttcatggctcatgtagacagggttattgatttctatagtaacccagaaggatgcaatactggcagctgcagacaagtggntaactggtttggcagaatggcatgtcctgctgctggaatgtttttatggattaaagttaaaggcttaatgatgtaaaaagaactgattgaagaaaaggccgttaaaatgggggtattaaagctcctggaaatgtttctcgtcgatagctcacttctancccttacttgagagcttctt

SEQ ID NO: 4201 - DNA, 686 bp, Homo sapiens; identical to SEQ ID NO: 4199
  misc_feature 6, 16, 39, 57, 63, 73, 154, 160, 165, 170, 171, 176, 177,181, 183, 203, 214, 243, 276, 277, 278, 294, 315, 336, 338,373, 382, 385, 421, 427, 434, 439, 446, 478, 496, 499, 543,545, 561, 592, 599, 613, 621, 622, 640, 644, 645, 651: n = A,T,C or G
  misc_feature 684: n = A,T,C or G

SEQ ID NO: 4202 - DNA, 705 bp, Homo sapiens
  misc_feature 4, 539, 549, 623, 679, 680, 694, 698, 703: n = A,T,C or G
tatncatacagctcttgttctttttgcaggatccctcgattcgaattcggcacgagaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaagagacagaggaagaggaagctgctgaggactggggagaagctgagccctgccccttccgagtggccatctatgtacctggagagaagccaccgcctccctgggctcctcctagctgccctccgactgcaaaggcggctcaagcgcccagaaacccctactcatgatccggaccctgagactcccctaaaggccagaaaggtgcgcttctccgagaaggtcactgtccatttcctggctgtctgggcagggccggccangccgccgcanggccctgggagcagcttgtcggatcgcagccgttccacgcgatacccaagcccagagactgaccctgctacctntgccggcaagctgcccctagaccacttaccctctgctaccaactgctctcttgctnnccagcaacaccttngcantggcnac

SEQ ID NO: 4203 - DNA, 835 bp, Homo sapiens
  misc_feature 2, 3, 4, 5, 6, 7, 13, 17, 24, 588, 618, 658, 662, 682, 699,707, 733, 736, 740, 755, 758, 763, 770, 780, 783, 790, 823,826, 831: n = A,T,C or G
tnnnnnntttatntttnatacaanctcttgttctttttgcaggatcccatcgattcgtttggattgattcagggagaaatttgcactgatggctcagaagcttacgtcatggagagtatgacctacctcacagcagggatgctggaccaacctggctttcccgactgctccatcgaggcagccatggtgaaggtgttcagctccgagccgcctggcagtgtgtgagtgaggcgctgcagatcctcgggggcttgggctacacaagggactatccgtacgagcgcatactgcgtacacccgcatcctcctcatcttcgagggaaccaatgagattctccggatgtacatcgccctgacgggtctgcagcatgccggccgcatcctgactaccaggatccatgagcttaaacaggccaaagtgagcacagtcatggataccgttggccggaggcttcgggactccctgggccgaactgtggacctggggctgacaggcaaccatggagttgtgcaccccagtcttgcggacagtgccaacaagtttgaggagaacacctactgcttcggccggacccgtggagacacttnttgttccgctttggcaagaacatcatggangaacaacttggtacttgaaagcgggtgggcaacattcctnattnaaccttgtattggcatgacnggccgtgcttgtccgcngggccaanccgcttccattccgcatttgggcttncgnaaanccaccgaaccacganggnttttntttgggnccaacaaccnttntggggtngggaaaccttaactttgcaagaaaatttttttnaanccttntttt

SEQ ID NO: 4204 - DNA, 780 bp, Homo sapiens; identical to SEQ ID NO: 513
  misc_feature 2, 3, 4, 5, 6, 7, 249, 258, 266, 294, 295, 301, 309, 331,345, 418, 431, 487, 530, 533, 539, 556, 648, 682, 735, 766,770, 778: n = A,T,C or G

SEQ ID NO: 4205 - DNA, 780 bp, Homo sapiens; identical to SEQ ID NO: 513
  misc_feature 2, 3, 4, 5, 6, 7, 249, 258, 266, 294, 295, 301, 309, 331,345, 418, 431, 487, 530, 533, 539, 556, 648, 682, 735, 766,770, 778: n = A,T,C or G

SEQ ID NO: 4206 - DNA, 780 bp, Homo sapiens; identical to SEQ ID NO: 513
  misc_feature 2, 3, 4, 5, 6, 7, 249, 258, 266, 294, 295, 301, 309, 331,345, 418, 431, 487, 530, 533, 539, 556, 648, 682, 735, 766,770, 778: n = A,T,C or G

SEQ ID NO: 4207 - DNA, 917 bp, Homo sapiens; identical to SEQ ID NO: 512
  misc_feature 412, 413, 415, 418, 421, 424, 427, 432, 434, 444, 461, 467,471, 480, 492, 501, 507, 517, 522, 525, 526, 527, 528, 529,537, 541, 551, 555, 560, 564, 566, 569, 572, 576, 578, 583,584, 587, 588, 589, 593, 595, 597, 598, 599, 600, 601: n = A,T,C or G
  misc_feature 602, 606, 608, 611, 617, 621, 622, 623, 627, 630, 632, 633,641, 646, 649, 650, 664, 665, 668, 671, 672, 674, 691, 695,697, 699, 706, 708, 712, 713, 714, 716, 720, 721, 723, 725,732, 733, 735, 737, 745, 746, 748, 756, 761, 764, 765: n = A,T,C or G
  misc_feature 766, 767, 769, 770, 771, 776, 777, 778, 780, 781, 782, 783,791, 795, 796, 797, 805, 806, 807, 808, 809, 811, 812, 814,815, 817, 819, 825, 826, 828, 831, 836, 841, 844, 845, 846,847, 848, 849, 851, 856, 857, 864, 865, 867, 868, 869: n = A,T,C or G
  misc_feature 875, 876, 877, 878, 879, 880, 882, 883, 884, 885, 886, 887,888, 890, 891, 892, 894, 898, 899, 903, 905, 906, 907, 909,912, 913, 914, 916, 917: n = A,T,C or G

SEQ ID NO: 4208 - DNA, 778 bp, Homo sapiens
  misc_feature 15, 575, 659, 700, 750, 778: n = A,T,C or G
ttaatatacatacanctacttgttctttttgcaggatcccatcgattcgaattcggtacgagatcagaggaggcttcttcatccttcaactccatgatgaactcctatatgaagtggcagaagaagatgttgttcaggtagctcagattgtcaagaatgaaatggaaagtgctgtaaaactgtctgtgaaattgaaagtgaaagtgaaaataggcgccagctggggagagctaaaggactttgatgtgtaactgtgctgttgatgaagtcctcccagggaagcctgtgcagatgcagtcacctggaaagaacagagattaccctttcacctacctcagcaaaacaaactttcaagtcttgatagacttagcctagtaattttatagtgagagtttcaaactatatatcagtgtctatagcatcaaaaacttctgggggcgtgggggaagtagaataccaagtataatagttacattcactttcaaagagcatctatgaatttgccttttgtacttactgtggctttaaacatattcagaacagatgcttgaaatatgcacttagcactttggttncacatctgtctgggtaaaccatgaagaaaatgaactgctgcctcaatcgacccagacagcaccataggcagataaagaattggnttcaccctggtggtggtaggcatcgcgtgtgactttttttnctctatatcaattttcagtacgggaatagtattttaaaatagattggctnataaattatgaatctttaagtagtagan

SEQ ID NO: 4209 - DNA, 765 bp, Homo sapiens
  misc_feature 3, 4, 5, 6, 7, 14, 15, 16, 22, 31, 44, 153, 544, 549, 762: n = A,T,C or G
gtnnnnngtttgannnccatcnttttatatncatttttctactngttctttttgcagggatccctcgattcgaattcggcacgaggggcgaaaaagatgaccgaaattcaaactcctgaaaatactcctcgtttatttgatttagtaaaagtnaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacacttagaaaaatttactgcaagcatccagcgtttaatanagcangaagaatatttgaatgtccaagttaaggaacttgaagctaatgtacttgctacagcccctgacaaaaaaagcagaaattgctagaagaaacgttgtgcttcaaacaaatatgatgctgtggctgagaagctgtaaagtaaaactgagttaaccttcccatacatcgtgaatatatctactcaggcacagcacttgtaataatacataatatgnttg

SEQ ID NO: 4210 - DNA, 807 bp, Homo sapiens
  misc_feature 1, 5, 19, 39, 41, 48, 53, 55, 57, 61, 68, 84, 86, 93, 94,100, 101, 102, 104, 108, 118, 132, 133, 134, 135, 137, 139,141, 143, 156, 162, 163, 169, 178, 186, 193, 209, 230, 237,250, 251, 252, 256, 310, 316, 325, 329, 420, 426, 442: n = A,T,C or G
  misc_feature 446, 466, 469, 478, 481, 483, 493, 496, 515, 517, 530, 537,549, 550, 552, 564, 567, 572, 578, 579, 580, 581, 595, 628,629, 642, 650, 652, 661, 662, 664, 666, 669, 671, 672, 710,716, 723, 725, 741, 756, 761, 772, 798, 799, 803, 807: n = A,T,C or G
ncttnaagcccttttaaanccgttcgacccatcgatccnantcagganccaancnanatcnaatctgnacgaaggaaccccccncnttgagcnnaaactnnncncttnctggggcaanagggtggactgggnnnnangngnanagagagaacgcanggccannaagganagaaaaccnttcagcanctcaatnaactgcgggccaaganatctacccgtctcccttctcncacaagnaccattggccttnnnatcngaagcatttgacaaaaacttgcttgtttgggcctgtcacctcctgaaaggctgntttagntgtggatgncctngattaagggagagagcacctaggagctgcctgccccagctggggtgacggctgtagggctgggtctatgttgcaagccctatatcctagcntgcagnggaaagtgcttagctntgtncctgctgacctctgggcagncantcatcaaancananagacgtggcngcntgtgggcagcatgcccaantnccttgcttgactnagcactnatttctggtagnntnaaaaaagaattnaangtttnttgggnnnntttttttggggggngttgaggggtgggccaaaaacatggggggtagnntttgagttgttanaaaatgtntntgaatcaanntntnttntnnaaacacgatttgcctttttacccattataaagatgggncttatnacccacngnactggataaacctttngggttttttttggtntgganttggttctttnaaaaaatttacccaattcatgccctnngggntccn

SEQ ID NO: 4211 - DNA, 785 bp, Homo sapiens
  misc_feature 2, 3, 4, 5, 10, 11, 12, 13, 14, 16, 26, 698, 764, 785: n = A,T,C or G
gnnnnttttnnnnntntaaacccttnagctactcgttctttttgcaggatcccatcgattcgaattcggcacgaggctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttggttaccttggtcttggtttaagtcttaaaaaattaaagataacattataatgtagaatcagatgggacatagtccttgtaagcttnccttggaaatgttttaaatatttaggaagcttttaaaagacctaaattgtactctaaaagacactnaattgtctaatgtacaaaggn

SEQ ID NO: 4212 - DNA, 785 bp, Homo sapiens; identical to SEQ ID NO: 4211
  misc_feature 2, 3, 4, 5, 10, 11, 12, 13, 14, 16, 26, 698, 764, 785: n = A,T,C or G

SEQ ID NO: 4213 - DNA, 1000 bp, Homo sapiens
  misc_feature 10, 11, 12, 15, 26, 77, 105, 118, 139, 146, 224, 242, 256,273, 288, 333, 334, 622, 669, 902, 961, 973: n = A,T,C or G
aatttttttnnnccnaatttttcccnaagggccccttaaccttttgggtttttcccttttttttttttgggcccaanggggaaattcccccccccaattcccggnaatttttcccggnaaaaatttttcccggggcccnacccggnaagggggaaggggggaaaaatttttaacccaggggggtttaagggcccaaaaaaaaatttttaattggggggaagggnttttggggggaagggggnaacccagggtttanttggaaaaccccccccnatttttttgggaccnttttttgcccacccgggggaaaaaagggaatggaaagcccccaannaatgggcctttttccaaaaaagaaagccttggggggggaccaaggggaaaaataagaaattggcttaccatgggcttggttttatatgaatgatgtgtctgcaggaggaccctgtttttctgaagttggactagtgttgcccaaaaaaagaactgtgtttggtataatctgttgcagtggagaaggagatatagtcacggcatcacctgtcagtgctagtggcaacaaatgggtatcaataaatggctcatgaacgtggacaagaatttcgaagaccttgtcgttggncagaattggaatgacaaacaggcttccctttttctcctattggtggnactcttatgtgctgatatacacatttcctagtcttaactttcaggagtttacaattgactaacactccatgattgattcagtcatgaacctcatcccatgtttcatctgtgggacaattgcttactttggtgggttcttttaaaaagtaacacgaaatcatcatattgcataaaaccttaaaagttctgttggtattcacaagaaagacaaaggcagaagtttaaaagtgganggaattttatattttaaagaactttttgggttggataaaaacataatttgagccatccnagttttaagtantttcactacatctcaattgggtgggtg

SEQ ID NO: 4214 - DNA, 1000 bp, Homo sapiens; identical to SEQ ID NO: 4213
  misc_feature 10, 11, 12, 15, 26, 77, 105, 118, 139, 146, 224, 242, 256,273, 288, 333, 334, 622, 669, 902, 961, 973: n = A,T,C or G

SEQ ID NO: 4215 - DNA, 924 bp, Homo sapiens; identical to SEQ ID NO: 4195
  misc_feature 2, 3, 4, 5, 8, 9, 10, 11, 12, 13, 14, 15, 16, 17, 18, 19,20, 22, 23, 26, 27, 28, 29, 30, 31, 34, 35, 41, 68, 76,80, 82, 97, 122, 126, 127, 128, 141, 142, 148, 151, 157,252, 258, 259, 272, 281, 310, 318, 347, 361, 393, 414, 425: n = A,T,C or G
  misc_feature 426, 428, 433, 444, 447, 448, 451, 457, 467, 477, 481, 483,485, 501, 511, 536, 554, 562, 565, 572, 578, 589, 590, 591,597, 608, 609, 615, 621, 625, 628, 669, 670, 685, 696, 697,699, 701, 730, 735, 739, 743, 747, 758, 760, 769, 770: n = A,T,C or G
  misc_feature 772, 784, 792, 796, 798, 799, 810, 815, 818, 825, 830, 836,837, 844, 848, 853, 867, 887, 889, 894, 903, 907, 911, 916,922, 923: n = A,T,C or G

SEQ ID NO: 4216 - DNA, 789 bp, Homo sapiens
  misc_feature 22, 67, 72, 86, 93, 105, 115, 125, 129, 131, 154, 155, 160,165, 176, 190, 202, 204, 207, 208, 232, 268, 271, 273, 275,280, 286, 290, 291, 310, 321, 323, 325, 327, 329, 335, 342,344, 348, 349, 350, 351, 355, 360, 369, 373, 375, 378: n = A,T,C or G
  misc_feature 380, 384, 385, 399, 439, 474, 482, 499, 509, 511, 513, 515,516, 520, 525, 534, 539, 550, 554, 555, 559, 563, 575, 584,598, 601, 603, 609, 628, 634, 644, 648, 656, 666, 667, 682,683, 690, 694, 711, 715, 716, 719, 720, 721, 730, 739: n = A,T,C or G
  misc_feature 744, 745, 773, 774, 778, 789: n = A,T,C or G
ttccatcagctcttgttctttntgcaggatccctcgattcgaattcggcacgagattccaaaggttncaaanaacttggtcataantatgatnatgagaagacancgtctttctnttaaaacagnttantngccttcacttttgtgaaaatagnnttcancacanaaactgacttntttagacaaagttntaaccaatgatngngtnngcttctaggatatacactctaaancaactcactgtcccacgtggtggtcattgctggccntantnanttggncctgcntaannatattgatatctaatttcntttaaccaccntnantngnccttanttaccancngggnnnnactncacgnggcaactgnggcntngcntncttnnccagctcatggtgngtgaatgttatacaaattgccactcagatatatttttggncgtaatggggggtacaaatgatcatgtgatgtgtncactcatntggtgcaaagtgccccnggcaccaacngngncnnggtnctcanccacaaccntgctncctctgagatncacnncccntcancctccgagtaangagttgcgntacaactcatcaanggnanactggntaatattaaaaatcatccnatatgnccatactttncctnttttgtancctgcccaannatcccgtcaaagggnngtgtttntctngctaatttcccaccagntggnntannnttaattccnctcagggancaaanngttcacaatgcctttctttttttcccgnngggnttttggaagcn

SEQ ID NO: 4217 - DNA, 869 bp, Homo sapiens
  misc_feature 21, 27, 32, 33, 36, 46, 48, 58, 107, 119, 180, 185, 187,210, 211, 233, 263, 268, 270, 276, 278, 281, 285, 286, 295,302, 315, 317, 320, 322, 325, 328, 332, 345, 359, 361, 362,363, 385, 401, 412, 426, 427, 434, 463, 493, 507, 511: n = A,T,C or G
  misc_feature 523, 527, 529, 530, 538, 544, 549, 567, 571, 576, 583, 586,623, 625, 626, 630, 635, 658, 659, 672, 681, 691, 693, 712,714, 725, 727, 730, 741, 742, 751, 755, 771, 773, 787, 790,792, 798, 811, 820, 857: n = A,T,C or G
atttcaaaaactcttgccttnttaaanacctnncgntactcgatcntncacgaggaangaggacctaggcacacacatatggtggccacacccaggagggtagtggngagttagatttnagagtccaggccctaggttgggacccactccaaataatctcctcggtgtgggtggtggttntatananggataaatgaataataaacattnntaaaatatacgctattccttgntggaaatgcctgctgcacccccgtttccantgacntnccgaangnggntatnnggtggtcantggaatnacagtcaatccanangtnanccngcngggntgcatcaagctgncctcgcacctgggntnnncaccctctggcccacactggtnatgatgccacaccttnccatgttcacnctgtttggaaaaannccttttnttttcctcttttaaagagaaaacattganaaagatttttttttttaatgggccgacccnaaaagggagatctncccncccttgtatatnatantnntgaccctncctacnaaganggcgtttttggcaaaatnattnttttntttttcncgnggtggtgggggaaaaatttttcctggggggggccttngnngccnaactnttaattttccccattaaggcaanntttctttgggggnctttccccnggggcttaancnttaaactttggaatttttntnggggttggttngnccntaaatttttannaaaatggtngtcnaacccaaaaaaaaatntnacccccgggggccnaanantttttncccccccttggangccttttantttcccccacaaactttttttttttcccttccaaccncttttattcttt

SEQ ID NO: 4218 - DNA, 1128 bp, Homo sapiens
  misc_feature 2, 3, 8, 9, 10, 11, 12, 13, 14, 15, 16, 17, 22, 28, 29, 30,35, 36, 37, 40, 41, 44, 48, 49, 50, 52, 54, 55, 56, 57,58, 59, 60, 61, 62, 64, 65, 66, 73, 74, 75, 100, 108, 111,131, 136, 146, 159, 164, 165, 171, 174, 177, 178, 185, 187: n = A,T,C or G
  misc_feature 195, 202, 213, 216, 219, 224, 238, 249, 254, 255, 256, 258,267, 271, 272, 273, 281, 282, 285, 289, 291, 296, 297, 301,308, 309, 314, 315, 317, 319, 321, 327, 354, 364, 365, 370,373, 375, 378, 380, 387, 411, 415, 416, 419, 424, 440: n = A,T,C or G
  misc_feature 442, 444, 448, 450, 455, 457, 459, 460, 465, 471, 472, 476,481, 484, 493, 494, 501, 509, 510, 512, 514, 518, 521, 527,539, 543, 545, 549, 551, 558, 562, 564, 578, 579, 583, 591,598, 599, 605, 612, 619, 621, 623, 625, 633, 679, 690: n = A,T,C or G
  misc_feature 692, 702, 705, 707, 711, 712, 717, 724, 732, 733, 738, 740,741, 742, 755, 767, 770, 775, 776, 782, 784, 791, 793, 814,815, 818, 822, 825, 832, 836, 839, 843, 855, 861, 866, 869,877, 882, 883, 885, 891, 901, 915, 918, 919, 920, 927: n = A,T,C or G
  misc_feature 928, 933, 938, 941, 944, 946, 950, 952, 954, 955, 968, 970,977, 978, 979, 988, 993, 1000, 1003, 1011, 1014, 1017, 1052,1054, 1056, 1061, 1069, 1073, 1078, 1084, 1087, 1107, 1115,1116, 1117: n = A,T,C or G
gnnggggnnnnnnnnnnggggngggggnnnggcgnnnggnncgncggnnnancnnnnnnnnncnnnggggggnnnccccccgggttttttggccaaaatnttgggccnaanaaacccagggcccttacctnggggncccccttttntttttgggcccanggggnnagcccnccncgnncccgggnangggggccnggggggnagggccccgcngcnaangccgnagggggggggggcncgcggcccccncccannngnccaagaganaaannnaggcggcnnagngaangnggaanncccntggggcnnggggnnanananccaagngggagggggggggggggccggccgggntcgggggagnnacggncantnggncnggggggngggaggggcacagggggaggaggncttnnggnggggngagcgagcgcggggcncnancagngngggancncnngcaangggcannagangccgnggnccacctacnngggggangcaaggcnntngnagtnatngggggnaggagcaaaaangggngncccngngctaggncgancntgggggagggagcnngccngaacagcnggggggnnctgggngagaacnggagcgngncngnacggcccnggagacaaggagcgtctgggggagggcgatggcaaggggtatgggnggctgggacangngggggacccnagngnaaanncgtgnggcaagngggacgtnnggggngnnngctggataagggncgcaaggtaccnagncgggnncagggngncactggnangcagggagagccgaggacggnnagngcgnggntgagggnacgncgnggangacgtgccaggnaacccnggggncgngggcgggnaaacnngncgagcncgccggggcngcgtcgcagagcgnggnnnaggcganngggtnaaggnggnggngngggnangnngggggcgaggggncnaaggatnnngaggggggnacacntgggccnganggcatggncgngcncggggccgaaacacgggaacgcggggggagggcangngnggggnctgggggnccgnccggnaggggnacngggggcgggggcgcagtggncagtgtgnnngcggcgagccg

SEQ ID NO: 4219 - DNA, 1128 bp, Homo sapiens; identical to SEQ ID NO: 4218
  misc_feature 2, 3, 8, 9, 10, 11, 12, 13, 14, 15, 16, 17, 22, 28, 29, 30,35, 36, 37, 40, 41, 44, 48, 49, 50, 52, 54, 55, 56, 57,58, 59, 60, 61, 62, 64, 65, 66, 73, 74, 75, 100, 108, 111,131, 136, 146, 159, 164, 165, 171, 174, 177, 178, 185, 187: n = A,T,C or G
  misc_feature 195, 202, 213, 216, 219, 224, 238, 249, 254, 255, 256, 258,267, 271, 272, 273, 281, 282, 285, 289, 291, 296, 297, 301,308, 309, 314, 315, 317, 319, 321, 327, 354, 364, 365, 370,373, 375, 378, 380, 387, 411, 415, 416, 419, 424, 440: n = A,T,C or G
  misc_feature 442, 444, 448, 450, 455, 457, 459, 460, 465, 471, 472, 476,481, 484, 493, 494, 501, 509, 510, 512, 514, 518, 521, 527,539, 543, 545, 549, 551, 558, 562, 564, 578, 579, 583, 591,598, 599, 605, 612, 619, 621, 623, 625, 633, 679, 690: n = A,T,C or G
  misc_feature 692, 702, 705, 707, 711, 712, 717, 724, 732, 733, 738, 740,741, 742, 755, 767, 770, 775, 776, 782, 784, 791, 793, 814,815, 818, 822, 825, 832, 836, 839, 843, 855, 861, 866, 869,877, 882, 883, 885, 891, 901, 915, 918, 919, 920, 927: n = A,T,C or G
  misc_feature 928, 933, 938, 941, 944, 946, 950, 952, 954, 955, 968, 970,977, 978, 979, 988, 993, 1000, 1003, 1011, 1014, 1017, 1052,1054, 1056, 1061, 1069, 1073, 1078, 1084, 1087, 1107, 1115,1116, 1117: n = A,T,C or G

SEQ ID NO: 4220 - DNA, 793 bp, Homo sapiens
  misc_feature 3, 14, 17, 636, 639, 649, 708, 747: n = A,T,C or G
aantacatcagctnttntctttttgcaggatcccatcgattcgagaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtggtgaattttttcagtgtaacaacattatctgaccaatagtacacacacagacacaaagtttaactggtacttgaaacatacagatatgttaacgaaataaccaagactcgaaatgagattattttggtacacctttctttttagtgtcttatcagtgggctgattcattttctacattaatcagtgttttctgaccaagaatattgcttggatttttttgaaagtacaaaaagccacatagtttttccagaaaggtttcaaaactcccaaagattaacttccaacttataagtttgtttttattttcaatctatgacttgactggtattaaagctgctatttgatagtaattaaatatgttgtcattgatataaacctgtttggttcagcaaacaaactaaaatgattgtcataagacaggggttttatttttcctggtgggngtngctgatttgnggagcatgcctttaagaatgaaaaaagcctggaatggataaccttcccttaaaaaaggngccggcattccaattcaaaatattttcgtcctggatttnaaagctggttggggtaatgctaattaaaaattccttcagttaattt

SEQ ID NO: 4221 - DNA, 828 bp, Homo sapiens
  misc_feature 9, 35, 47, 56, 59, 60, 62, 68, 71, 72, 73, 80, 85, 87, 89,90, 93, 95, 96, 101, 107, 108, 116, 119, 127, 131, 137,138, 141, 142, 151, 156, 160, 161, 174, 178, 193, 194, 196,199, 213, 225, 232, 252, 260, 278, 279, 282, 285, 287, 297: n = A,T,C or G
  misc_feature 306, 311, 323, 327, 328, 333, 342, 345, 349, 352, 354, 355,356, 359, 362, 363, 364, 375, 376, 380, 425, 430, 434, 436,437, 438, 442, 451, 456, 460, 470, 474, 484, 492, 496, 500,526, 527, 532, 533, 550, 553, 588, 610, 612, 625, 628: n = A,T,C or G
  misc_feature 629, 632, 641, 654, 656, 671, 675, 676, 679, 693, 694, 704,706, 710, 732, 733, 737, 739, 745, 749, 754, 771, 774, 775,784, 785, 789, 796, 816, 827: n = A,T,C or G
tcccttttngaaagctttaaaccttttttaaaccnttcagctcgggncccattgcnganncnatctantcnnngccggcnccgcncngnngtntnncattnataaanngcttgaanatnatgatgtngccntctagnnacnnagatttgantccgnttanngaatgtggaaatntgcnctggaagaaatgttnncnttnatgatagctcgtgnatggaaaaaagngcactgnatttattacacaaacttacnaatgcttnacttctttacacaacatnngtnaantnatatttgggntattgcatnctatnaacaatttgtgnatgnnttaanatggtgttnatnactntgntnnncgncannntgtttttaacnnatantggccctaaaatatgggtgtgcttatataatcgcttacttctggnactgnaacngnnntacngaggacagntgggntttnaaccctcttnttgnacgtttgccngacctacntggnctantatggattctaaaagtacttcaatgnncttannaagaaacatatccttgnggngtatttagatgctttttgattatacccacacaatncctgaggggacattttggggcntngaatataaaacanttnnatntccacttancatctgccccccngnggtaagttactattngttnngcnggtacaactaaatnncttttcccantntttnaattgggaaataggggcgaatnnctangnctttantggntggtnctgggcctcaatggacnatnnaacaattgnnaaanacaaatntgtaaatcccggaattcctnataaaaaaaant

SEQ ID NO: 4222 - DNA, 793 bp, Homo sapiens
  misc_feature 1, 2, 3, 4, 5, 6, 7, 8, 11, 12, 17, 26, 296, 608, 704, 711,712: n = A,T,C or G
nnnnnnnnttnnttttnatatacatncagctcttgttctttttgcaggatcccatcgattcgctgacaacttgattgggttctccttcaggtttgaagcgccctcgagaagtgtctaaaggagacagttgatagccaaacaacagttttggattcactgactgattatgaaagaagcagtagactggtatcaagaatcagtcagcaaggaggccctcaccagacgccagtgccatgttcttggacttctcagcctccatattcatgaactaagtttttggaatccttaggcttccngtgtggaaagcctgagctaacctactggaggatgagccatcacctggagcagattcaggccatcctagttgaagcctccctaggccaagcaaccgtccaactaccagacattgaccattcagccttgaacattcagcacaaagacaaaacagaccagaccagaagagtcccacagaataggggaaactattcagagaaaacttaagccactaagttttatggtgttttgttctgtagcagaagcataggcatactgacaatacaaaccgaaatccttctaacgtagtggaccttttcaggccacattttttncttgaaaacctggagcatgtatcatcttatagcagagatcactttcacaatgtttgggctcttgatttgaattgatgatgtaatgagccctctatncagatgnnactaattactctgcgaattgactgggattcacacccttctaatattttacttttcctcttttatcaactctcattctcgct

SEQ ID NO: 4223 - DNA, 686 bp, Homo sapiens; identical to SEQ ID NO: 4199
  misc_feature 6, 16, 39, 57, 63, 73, 154, 160, 165, 170, 171, 176, 177,181, 183, 203, 214, 243, 276, 277, 278, 294, 315, 336, 338,373, 382, 385, 421, 427, 434, 439, 446, 478, 496, 499, 543,545, 561, 592, 599, 613, 621, 622, 640, 644, 645, 651: n = A,T,C or G
  misc_feature 684: n = A,T,C or G

SEQ ID NO: 4224 - DNA, 789 bp, Homo sapiens; identical to SEQ ID NO: 4216
  misc_feature 22, 67, 72, 86, 93, 105, 115, 125, 129, 131, 154, 155, 160,165, 176, 190, 202, 204, 207, 208, 232, 268, 271, 273, 275,280, 286, 290, 291, 310, 321, 323, 325, 327, 329, 335, 342,344, 348, 349, 350, 351, 355, 360, 369, 373, 375, 378: n = A,T,C or G
  misc_feature 380, 384, 385, 399, 439, 474, 482, 499, 509, 511, 513, 515,516, 520, 525, 534, 539, 550, 554, 555, 559, 563, 575, 584,598, 601, 603, 609, 628, 634, 644, 648, 656, 666, 667, 682,683, 690, 694, 711, 715, 716, 719, 720, 721, 730, 739: n = A,T,C or G
  misc_feature 744, 745, 773, 774, 778, 789: n = A,T,C or G

SEQ ID NO: 4225 - DNA, 784 bp, Homo sapiens; identical to SEQ ID NO: 521
  misc_feature 1, 9, 15, 16, 670, 716, 728, 749, 753: n = A,T,C or G

SEQ ID NO: 4226 - DNA, 775 bp, Homo sapiens
  misc_feature 670, 701, 759: n = A,T,C or G
aaccaccagctacttgttctttttgcaggatcccatcgattcgaattcggcacgagtgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgnatctcatctcaaaatattaataatttttttnccaaaaagatggtatataccaagttaaagacagggtattataaatttagagtgattgntggatattaccggaaa

SEQ ID NO: 4227 - DNA, 1044 bp, Homo sapiens
  misc_feature 1, 7, 8, 210, 212, 213, 216, 218, 221, 222, 224, 225, 226,229, 231, 233, 234, 235, 237, 239, 242, 244, 247, 251, 253,260, 265, 267, 268, 269, 275, 277, 278, 280, 282, 283, 284,285, 286, 289, 292, 298, 301, 310, 321, 323, 324, 325: n = A,T,C or G
  misc_feature 328, 329, 330, 334, 335, 337, 338, 341, 343, 344, 345, 346,348, 350, 352, 355, 356, 358, 361, 369, 370, 371, 372, 373,374, 376, 377, 378, 381, 382, 383, 384, 385, 386, 387, 388,391, 392, 393, 398, 399, 401, 402, 403, 404, 406, 407: n = A,T,C or G
  misc_feature 414, 415, 418, 419, 421, 422, 423, 424, 426, 431, 432, 433,437, 438, 440, 442, 445, 446, 449, 450, 452, 456, 458, 461,463, 464, 466, 468, 469, 470, 471, 474, 475, 477, 478, 479,482, 483, 484, 485, 487, 488, 489, 490, 491, 492, 493: n = A,T,C or G
  misc_feature 494, 495, 496, 497, 499, 500, 501, 505, 506, 508, 512, 513,514, 515, 517, 521, 522, 523, 524, 525, 526, 527, 528, 531,532, 533, 534, 537, 538, 539, 542, 544, 545, 546, 547, 548,549, 551, 553, 554, 557, 558, 560, 562, 563, 566, 567: n = A,T,C or G
  misc_feature 568, 569, 571, 572, 575, 576, 578, 579, 580, 581, 582, 583,584, 586, 588, 589, 591, 592, 593, 595, 596, 597, 598, 599,601, 602, 603, 604, 605, 606, 607, 608, 609, 610, 611, 613,615, 617, 618, 619, 620, 621, 622, 623, 625, 626, 627: n = A,T,C or G
  misc_feature 628, 630, 631, 632, 633, 634, 635, 636, 637, 638, 639, 640,642, 643, 644, 645, 646, 647, 648, 649, 650, 651, 652, 654,655, 656, 657, 658, 660, 661, 662, 663, 665, 667, 668, 670,671, 672, 673, 674, 675, 676, 677, 678, 679, 680, 681: n = A,T,C or G
naacgcnngctacttgttctttttgcaggatcccatcgattcgaattcggcacgagccccggtcgtgtagcggtggtatactacggtcaatgctctgaaatctgtggagcaaaccacagtttcatgcccatcgtcctagaattaattcccctaaaaatctttgaaatagggcccgtatttaccctatagcaccccctctagagccaatanannaantnatnntnnnaancncnnnancntananaanctcnancctttanaactntnnngagtcntnntnannnnnatncanacatgntcncatacatcncttattttggncnnnccnnncctnnanngcncnnnnananangcnntnttntcaaattnnnnnncnnncgnnnnnnnntcnnnccatnncnnnncnnttctacnnatnncnnnntnctacnnntccnntncnttnnaanntntccncnccntnncngnnnnctnncnnnttnnnntnnnnnnnnnnncnnntctnncncccnnnncntccnnnnnnnnccnnnntcnnnctncnnnnnncncnnctnntntnnccnnnncnnttnntnnnnnnntncnncnnntnnnnntnnnnnnnnnnncntncnnnnnnntnnnncnnnnnnnnnnntnnnnnnnnnnntnnnnncnnnncncnncnnnnnnnnnnnnntnnnnncnnnntnnccnntnnnnnnnncnncntnnnnnnnctnannncnnnnnnctntnnnnnncnnnnnnnctnnnncnntcnctctcnncccnntntatcncnnnannnnnttncnnnnnnnannnnnnnctnnnnntcnnncnnncnnnncnnnnnntnnncnnncnntncncnntnncnnnnnnnnnccnnnnnnntctnnnncnnncncncctnnnnntnctnnnncnnncnnnnnnnnnntntctcnctnnncncntnnnnncntncnctacncnctnnccncnanccnnnntncatnnctnnnntcnctnttacctttacnnccncncncccttnccnatnacncaatnccncct

SEQ ID NO: 4228 - DNA, 783 bp, Homo sapiens
  misc_feature 23, 25, 594, 700, 715, 740: n = A,T,C or G
tcaacagctggctactcgttctntntgcaggatcccatcgattcgaattcggcacgagcagccttggtgacagagcgagaccctgtctctaaaaaataaataaataaaatattgtgagtctctgatggggagcagtattgcatggtggttgagaactgaggctctgatgttagaactggattctgacttaacccactgtttgcccacatcttgagccttggtttccctatctgtaaaatggcagtattctcgggctggctgaggaaaggaaatgaggccaggcgcggtggctcaggcctgtaatcccagcactttggcaggctgaggcaggtggatgatttgaggccaggagtttgagatcagcctgaccaacatggcaaacccccgcgtccactaaaaatagaaaaaaatagctgggcatggtggtgcacccctgtagtctcagctacttgggagacagaagcaggagaattggttgaacttggaaggtggaggttgcagtgagctgagatcgcaccactgcactccatcctgggcgacagagcaagactgtctcaaaataaataaataaataaataaataaagttaaaaaanaaaaaaaaaaactcgagcctctagaactatagtgagtcgtattacgtagatccagacatgataagatacattgatgagttcggacaaacccacaactagaatgcantgaaaaaaaatgctntatttgtgaaatttgtgatgctatngcttttatttgtaaccattataagctgcaattaaccagttaaa

SEQ ID NO: 4229 - DNA, 783 bp, Homo sapiens; identical to SEQ ID NO: 4228
  misc_feature 23, 25, 594, 700, 715, 740: n = A,T,C or G

SEQ ID NO: 4230 - DNA, 778 bp, Homo sapiens
  misc_feature 8, 14, 15, 778: n = A,T,C or G
caacgctngctacnngttctttttgcaggatcccatcgattcgaattcggcacgagcaaagaggtacagagtgaagacagtgtcctcctgtttgttattgcatggacgatcacggaaatcatccgttactccttttatacattcagtctattaaaccatctgccttacctcatcaaatgggccaggtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctcctacattccaatttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaaataagtaagaactatttttaaaatattcaaacaaaactaaaacaaaaatccagtgtcacatgggcctgagattttattttagaaaaaggttgttacataaaacaccctggccagttcatttcagcatgctctttcaaccagaagttcttaatatttatgatggcactagaaagggatttggcattttatgtccttctgtgtccttcatgtatctgatcaatgaagacctgtaccactaan

SEQ ID NO: 4231 - DNA, 776 bp, Homo sapiens; identical to SEQ ID NO: 511
  misc_feature 5, 8, 22, 28, 346, 372, 423, 509, 548, 571, 607, 618, 637,640, 673, 674, 679, 680, 681, 685, 686, 688, 689, 691, 692,696, 697, 698, 701, 705, 707, 709, 710, 714, 716, 718, 719,725, 726, 732, 735, 737, 738, 740, 741, 744, 745, 746: n = A,T,C or G
  misc_feature 747, 748, 749, 750, 751, 752, 758: n = A,T,C or G

SEQ ID NO: 4232 - DNA, 780 bp, Homo sapiens
  misc_feature 634, 641, 668, 735, 765, 780: n = A,T,C or G
tatacatacagctacttgttctttttgcaggatcccatcgattcgaattcggcacgaggtgccatcttgctatgtttcccaggctggttttgaactcccagcctcaagcaatcctccctttccgcctcagcctcccaagtggctggggttatgggcctgagccactacacagctaagagtgtcttgtatgtgctaatgagatggctggtgtctgagagcccctagagagcttcaagatgggggctagtctttagaaagtccaagcaatggctaggtatggtggccactgcctgtaatcccaggagtttgggaggccaaggtggacagatcacctaggagtttgagaccagcctggccaacatggcgaaacactgtctctactaaaaagacaaaaattagcaagacaaaaattagctgggcttggtggtgagttcctgtagtcccagctacttgggaggctgaggcaggagaatcacttgaacctgggaggcagaggtttcagtgagctgagatcatgccactgcacaccagccgcctgggtgacagagcaagactccatctaaaaaacaaaaaaagtcatgattagagggttggaactttcagcctttcggcctctgcttcttgtccccacctntgggcanaagggaagggctagagattgaattatnccaatggccaatgatttatttaatcaatatgaaaccttcataaaatcccctaagtgataaagttcanagagctttcaagttggtaaagcttttctangtgcttgggaagggn

SEQ ID NO: 4233 - DNA, 815 bp, Homo sapiens
  misc_feature 2, 3, 5, 6, 9, 630, 666, 670, 688, 699, 708, 712, 713, 716,737, 792, 799: n = A,T,C or G
gnncnnttntatacatcagctcttgtctttgcggtccctcgttcgattcggcacgagtaagaatccccacccccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaacgggcccgttccatggacatagatgacttcatcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggttcaatactactactggtgtcaccatttatgattctgaatttaaagttgggaaaggtctaagtatcaaagtttttaatatataatgctggtccaatctattcataataatcttcaaggtcagggagcccgcagagacccaccaacttttncacttatcatttctaacaggttattggataaagaangtanctcttctatttaccgggnatatacctggnaaggccttntttnnggncctttagctctggttcctccnggtaattaaaaaaggttaaaaatatggaaaaaaaaaaaaaaaaaaaaaactccgngggcctntagaactttttggggg

SEQ ID NO: 4234 - DNA, 857 bp, Homo sapiens
  misc_feature 6, 16, 53, 58, 59, 60, 67, 113, 133, 146, 152, 162, 163,247, 253, 283, 289, 292, 301, 316, 318, 332, 334, 339, 341,344, 346, 354, 357, 360, 365, 369, 373, 375, 395, 404, 407,409, 411, 416, 425, 427, 440, 445, 446, 452, 460, 461: n = A,T,C or G
  misc_feature 464, 469, 475, 479, 490, 491, 494, 500, 501, 503, 506, 514,516, 527, 530, 532, 534, 556, 562, 565, 573, 588, 594, 597,599, 600, 604, 608, 610, 616, 625, 626, 640, 642, 646, 647,650, 657, 658, 662, 669, 670, 673, 674, 686, 699, 700: n = A,T,C or G
  misc_feature 713, 716, 723, 735, 744, 745, 748, 762, 778, 779, 780, 784,788, 790, 794, 795, 796, 798, 799, 802, 803, 807, 810, 818,824, 830, 832, 838, 839, 841, 842, 847, 850, 851, 854: n = A,T,C or G
tcaacngcttggctancgttctctttgcaggatcccatcgattcgcgtctcanacaannnaagtatnctacccatccacaggcagcagacaaggaagtaccttctgtgactgnctggcaaggtcagaggcatnagggaaggtaaantactgnaactatattnntaaaaataaaagtattccctttatgagtgtgaattacgaatcaatgccccttctcactactttttgtgaaaaaaattaccactnctgcancaagtctatgcctgggtaaccaccaacccnccaaanccnagaagaagncccccttttccggcntntggaaggctggagnancattngnatntnggccaacnggnccntaaantggngaantnacccactttccttttacaancggttggcntcntnanaccancacaaattntntggcacccgggtnctctnnacaggnaaccctgnnaancaaanaaaccntggngtctgcactcnnggngcccanntnctncggcttgntntaaaatgactntgncntnccttttttaaaattcacaaatnttttanccnctacatanacatatgaagtgagnaacccncananngaanattnanaaaacntcccagccnncttttaactactantngagnnctntttaatnntctnatccccnnaannttgttgatggangcccattcgtttnncacctttttgganganaatcccncccaccttcctnaataatctnntcngaataaaaaaaacncccctcatattattcnnncaanaaantntttnnnannacnnccanggngggctccntttttngccccncncttttnnanncaccntcnntanaaa

SEQ ID NO: 4235 - DNA, 857 bp, Homo sapiens; identical to SEQ ID NO: 4234
  misc_feature 6, 16, 53, 58, 59, 60, 67, 113, 133, 146, 152, 162, 163,247, 253, 283, 289, 292, 301, 316, 318, 332, 334, 339, 341,344, 346, 354, 357, 360, 365, 369, 373, 375, 395, 404, 407,409, 411, 416, 425, 427, 440, 445, 446, 452, 460, 461: n = A,T,C or G
  misc_feature 464, 469, 475, 479, 490, 491, 494, 500, 501, 503, 506, 514,516, 527, 530, 532, 534, 556, 562, 565, 573, 588, 594, 597,599, 600, 604, 608, 610, 616, 625, 626, 640, 642, 646, 647,650, 657, 658, 662, 669, 670, 673, 674, 686, 699, 700: n = A,T,C or G
  misc_feature 713, 716, 723, 735, 744, 745, 748, 762, 778, 779, 780, 784,788, 790, 794, 795, 796, 798, 799, 802, 803, 807, 810, 818,824, 830, 832, 838, 839, 841, 842, 847, 850, 851, 854: n = A,T,C or G

SEQ ID NO: 4236 - DNA, 956 bp, Homo sapiens
  misc_feature 7, 10, 11, 13, 14, 19, 20, 21, 25, 26, 28, 29, 33, 34, 41,47, 48, 49, 53, 55, 58, 61, 65, 67, 68, 69, 70, 72, 79,80, 83, 84, 89, 91, 95, 102, 107, 108, 109, 113, 114, 118,119, 122, 125, 127, 128, 131, 133, 134, 135, 139, 142, 146: n = A,T,C or G
  misc_feature 148, 158, 171, 175, 176, 178, 183, 186, 191, 209, 210, 436,437, 510, 515, 520, 528, 548, 550, 567, 596, 614, 622, 634,638, 645, 707, 714, 723, 727, 737, 743, 773, 776, 778, 781,786, 792, 803, 805, 808, 815, 817, 821, 827, 837, 838: n = A,T,C or G
  misc_feature 847, 849, 857, 862, 864, 871, 874, 881, 886, 888, 891, 894,896, 904, 908, 916, 917, 922, 923, 924, 925, 933, 934, 937,944, 947, 948, 949, 952, 953, 954, 955: n = A,T,C or G
ccctcancgnncnnaacannnctcnnannctcnnatcttanctttcnnnatcnantantcncganannnntncctcccnnatnntaccnanttancttaccncctcnnnaacnnctannttnaantnnttngnnncccngtnttantnttttctaacnctggggaatcgcntctnngnagganccntcgantcgaaaatgccttcattnncctttttactttatcatgagacataagatttattggcttcatatcaacccttaagtattgttaactttatgtaatagcatttgggttggggattggtgtgttttcggttgtacatagcatagttgaattatgttaggcataattatgaccttattattgtctttatttgaaaattatatatgatctcaggaaatgtgtatgagttcaagttgacaaggagtggatnngggatggttgatactgagtgtcaacttgattggattgaagcatgcagagtaataatcctgggttgtgtcctgngagcnatgtntcccaaangagaataacatttgagtcangngggctggggaaaggcanacccacccttaaactgggtgaacaccctntaatcaaactgtctgctntggccagnatataaaagcangccngaaaacntgaaaaggctagacaggcctttagccctctcagccctacatctttctcccgtgcttggatgnttcctgncctcaaacnccanacttcaagtncttcancttttgggacttgaacctggctctccttgntcntnaantttgnatcacnggcttatctgngnggnaccttancngttnagttcnaatacctccnnaattaaacncncttttctntacananactcccnctnaattcgnacccntntanaantnatagtgancccncaaacctnnatccnnnncttgatannganccattgnacnnnttnnnnc

SEQ ID NO: 4237 - DNA, 703 bp, Homo sapiens
  misc_feature 10, 25: n = A,T,C or G
caatgctggnctaatgctggctctngttctttcgcaggatccctcgattcgaattcggcacgaggagcaaaataggattatattaaagaagcaaaagaatgtcctaaaaattctccctgggattaagtaacacagtgattgatattagtggagtagagggaaagatccatgttagagatagcttaagatagggattagatgaattgagggcaatgactaaagatactgcttgcaagaaaactggctgagaatgagaggaaaatcttagttgcttggcgggagggggtttgtggttgtgaaagatagttttgtttaatcttagtcttaaatttaaaaccaagcagcaaggatctagctgagagaataattgaatacattaatataggaggacagacaaagatcctgaaaaggctgggagaagagcatccaaagcacaggtggagagacaaaaaggttagggctgctggcagctgtggagagaactgtacgtggtaagggggagatataagatgtcctgcataagtattttccctgtagattgcaaagtcatctatggagaggaaaggtccaaaatagtcactggggagagcaggtgaattagatggccaagcagggtggatggatcatttgaggtttggggtgacagatcaactgagatccacttacacttctgaaaaccaagacactttagaaattaacaccg

SEQ ID NO: 4238 - DNA, 706 bp, Homo sapiens
  misc_feature 4, 8, 25, 34: n = A,T,C or G
atgntggnctaatgcttggctactngttcttttngcaggatcccatcgattcgcagcggatggccgaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggttgaagccatccttgtcaatatatttggtggtatcgtcaactgtgccatcattgccaatgggatcaccaaagcctgccgggagctagaactcaaggtgcccctggtggtccggcttgaaggaaccaacgtccaagaggcccagaagatactcaacaacagcggactccccattacttcagccattgacctggaggatgcacg

SEQ ID NO: 4239 - DNA, 699 bp, Homo sapiens
  misc_feature 2, 3, 4: n = A,T,C or G
gnnnctaatgctggctattgttctttttgcaggatcccatcgattcgaattcggcacgaggcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcagtgggaagctgaggggtatgatttgggtgtggagacctctcaggttgggacttcttgtcagcttggacccctgaccagtgggctttggcttctccagccgccttcagtgctgcgtgatttgattctg

SEQ ID NO: 4240 - DNA, 1104 bp, Homo sapiens
  misc_feature 18, 337, 339, 340, 341, 344, 350, 352, 355, 357, 359, 360,361, 362, 364, 367, 370, 371, 373, 375, 385, 389, 391, 392,394, 395, 399, 401, 408, 409, 412, 417, 418, 419, 436, 441,443, 444, 447, 449, 462, 464, 472, 476, 478, 480, 481: n = A,T,C or G
  misc_feature 484, 490, 491, 494, 498, 500, 501, 509, 511, 513, 516, 518,523, 528, 529, 541, 547, 548, 550, 553, 554, 557, 559, 562,572, 576, 578, 581, 582, 594, 595, 601, 603, 604, 607, 611,612, 614, 616, 619, 622, 623, 626, 630, 635, 636, 638: n = A,T,C or G
  misc_feature 643, 644, 660, 662, 666, 670, 684, 685, 688, 689, 692, 695,698, 701, 703, 707, 713, 715, 719, 720, 725, 737, 739, 741,742, 744, 745, 746, 748, 749, 762, 763, 766, 773, 775, 776,777, 778, 779, 781, 782, 783, 784, 786, 787, 789, 790: n = A,T,C or G
  misc_feature 796, 799, 800, 801, 802, 804, 805, 806, 807, 809, 811, 813,814, 815, 816, 821, 822, 824, 826, 829, 830, 831, 832, 833,835, 836, 839, 840, 841, 842, 844, 845, 846, 848, 852, 853,854, 856, 857, 859, 860, 861, 863, 866, 867, 869, 870: n = A,T,C or G
  misc_feature 871, 872, 873, 877, 878, 879, 881, 882, 887, 890, 891, 892,893, 894, 895, 896, 897, 898, 900, 901, 902, 904, 906, 907,909, 911, 912, 914, 915, 916, 919, 921, 923, 924, 928, 930,936, 940, 941, 942, 948, 949, 950, 951, 953, 955, 956: n = A,T,C or G
  misc_feature 957, 959, 961, 968, 969, 970, 971, 972, 975, 976, 980, 984,1000, 1001, 1002, 1003, 1005, 1009, 1014, 1016, 1019, 1022,1023, 1026, 1028, 1031, 1032, 1033, 1034, 1035, 1036, 1039,1042, 1046, 1047, 1048, 1049, 1052, 1054, 1055, 1062: n = A,T,C or G
tttcaacgctggctactngttctttttgcaggatcccatcgattcgaattcggcacgaggttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttaaaaaaaaaaaaaaaaaaaaaaaaaaaaaaaaaaaaaaaaaaaaaaaaaaaaaaaaaaaaaaaaaaaaaaaaaaaaaanannnaanaataancntantncnnnnanttnatnncnancttctccatntacnannannttantnactacanntcncatcnnncttatcttctaataccnacccncnnatntnaccatctaccctntnctcaaccntccncntnnatnctcttnntcncccncnncaccctcncncntcnantcctntatanntttctcccctcncctcgnncnctnngtncnttntctactgttnctcntntannctctcttctctnnctctcntnnctntctnnancnttnttnnccnctcngctcnncnctctnncttctctatcttcccntnctcncacnctctcatgcaattnnacnntcnctnctncancnattngactcncntctnnatctntctgcatcactnancnncnnntnncttctctctaccnncantctcttntnnnnntnnnncnncnncttatnacnnnncnnnntntntnnnnactcnntntntannnnntnncannnntnnncntctnnncnntnnntnctnntnnnnncttnnntnntaccnaannnnnnnnncnnncncnntnanntnnnatnantnncatncnctcacntatnnnctctcnnnnanannncncnctccctnnnnnatnnctcncttnacatactctctatctnnnncnaccnctacnancanctnnttntnctnnnnnntanacncttnnnnatntnngctctcnnncnncacnctnttctnnnantnatctcttccccngncnaac

SEQ ID NO: 4241 - DNA, 811 bp, Homo sapiens
  misc_feature 4, 5, 6, 7, 8, 10, 12, 21, 28, 31, 38, 47, 125, 126, 144,148, 150, 213, 259, 298, 299, 406, 415, 420, 433, 505, 507,510, 517, 602, 608, 639, 642, 656, 657, 674, 758, 796: n = A,T,C or G
tttnnnnntntnaatcccttngctaccnccntttgatngacatacanctacttgttctttttgcagggatcccatcgattcgaattcggcacgaggaatcaccctcggctgggaagtcagttcgnnctctcctctcctctcttnttgntngaacatggtgcggactaaagcagacagtgttccaggcacttacagaaaagtggtggctgctcnagcccccagaaaggtgcttggttcttccacctctgccactaattcnacatcagtttcatcgaggaaagctgaaaataaatatgcnngaggaaccccgtttgcgtgcgcccaactcccaagtggcaaaaaggaattggagaattctttaggttgtcccctaaagattctgaaaaagagaatcatattcctgaanaggcacgangcagnggcttaagaaaancaaagagaaaagcatgtcctttgcaacctgatcacacaaatgatgaaaaagaatacaactttctcattcatntntgnataacgnctccttgtttaccctggtattctagaatgtaaatttacataaatgtgtttgttccaattagctttgttgaacaagcatttaattnaaaaanttacgtttaaatttagatgttcaaaaggagntgngaaatttgagaatnngtaagactaattatggnaacttagcttagtattcaatataatgcattggtggggtttcttttacccaaattaaggggtctagttctttgttaaaatcaagncatttgcatttgtggttctaaatacaagtattgttgcntttgagaattgctta

SEQ ID NO: 4242 - DNA, 749 bp, Homo sapiens
  misc_feature 1, 2, 4, 5, 6, 7, 8, 10, 16, 21, 507, 571, 623, 659, 663,664, 665, 666, 667, 668, 669, 670, 671, 672, 673, 674, 675,676, 677, 678, 679, 680, 681, 682, 683, 684, 685, 686, 687,688, 689, 690, 691, 692, 693, 694, 695, 696, 697, 698: n = A,T,C or G
  misc_feature 699, 700, 729, 730, 732, 733, 738, 739, 748, 749: n = A,T,C or G
nntnnnnntntgaaanccttnggctacttgttctttttgcaggatcccatcgattcgaattcggcacgagattctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaacccagtataaatcagttctggacaaacttgaaatcatggtggaagaaacagacagtgttagctcatgatttgatttggttctacctttggccttgagttcttattatttacattataaatattaactggttttatattgntaagacaaaacactggtaaaagtttcaacacctcccttttgcttgtataccataaatgggcagnttctgaaattttggataaagcatcaagaactcctttttctgaaacgttcctncttttttagtgcctaattaatatacttacttacccnggannnnnnnnnnnnnnnnnnnnnnnnnnnnnnnnnnnnnnaaaaactcggcctttaaaatatagggggnngnnttacnnaaatccaann

SEQ ID NO: 4243 - DNA, 810 bp, Homo sapiens
  misc_feature 3, 481, 484, 554, 600, 602, 637, 668, 671, 699, 702, 731,754: n = A,T,C or G
canctcttgtctttttgcggaccctcgttcgaattcggccgagtaagaatcccccccccatcaattttcaggaatgggatggtctagtaaggataacctttgttaggaaaaacaagacactctctgctgcatttaaatcaagtgcagtgcaacaactcttggaaaaaaactacagaattcactgttcagtccataatattataataccagaagatttcagcatagcagataaaatacagcaaatcctaaccagcacaggttttagtgacaacgggcccgttccatggacatagatgacttcatcagattgctacatggattcaacgcagaaggtattcatttttcctaggtatttggaaaacagaaattttcaaggtcaagaaaagaaatgaattttgtattttttgtatttgagaagataatgcttttgctttactgagacattatttacttgactatttttggtcaatactactactgntgncaccatttatgattctgaatttaaaggtggaaaggtctaagtatcaaaggttttaatatataatgctggnccaatctattcataataatcttcaaggtcaggagcccgcagagacncncaactttccacttatcatttctaacagtttattgnataaaggatggtacctctttctattttaccnggnaatatacctggaaagggccttcttttanggnccttttaacctctgggttccctcccggtnaattaaaaaaaggtttaaaattnttgaaaaaaaaaaaaaaaaaaaaaaacctcggggggccttttaaaaactttttggg

SEQ ID NO: 4244 - DNA, 780 bp, Homo sapiens
  misc_feature 2, 3, 6, 8, 9, 12, 17, 20, 22, 24, 26, 42, 63, 90, 107, 108,156, 163, 199, 223, 242, 244, 274, 286, 287, 292, 297, 305,372, 392, 397, 412, 439, 450, 463, 465, 471, 487, 492, 508,521, 550, 552, 580, 611, 637, 650, 664, 680, 689: n = A,T,C or G
  misc_feature 701, 705, 729, 746: n = A,T,C or G
gnnttnannccnttttnatncncntncagctcttgttctttntgcaggatccctcgattcganttcggcacgaggtgaggctctcttaanaaatttaaaaatactgnngaacaaagggaggagtttgtcttaatctggagtggaggaaacttctgngtcaccnaacacagaaaccatcaaagaaaatctttcactttcnaaattagtctatacaaaaaaaaangaaaatcttaccccaaatnanagactgaggcatgagcttcaatcaatcgangtttactggccnnagttngagcntgcccagnaaagcaacacaagtcaaagaaacgtctgtggcctgtgctctcccaaaaagttttcaggaggctcaanatttgtacatttctttaaanggganaagacagtgaggcanatggttatgtttttgtgagactcttanttagtgtcccntgaatctaaactntntggaanatagggtgaacactgnaagancagggagtgacataanaaccaattatgcnacacgtctcatgttacgtggaggaatgangntctcatcttatccttgttctgcccctgngcagataaacttgttattgacattgtcagtntgaaatttaacagacttttgttttangagttaagtttanggtgcacacctaanatgcacttggcatgtnctttgtttnttggaggatatncatnctgaaggtttaggggctgccaaanaatttactgctgaccanttgggattgcagtccctggagattcatgaggctt

SEQ ID NO: 4245 - DNA, 780 bp, Homo sapiens; identical to SEQ ID NO: 4244
  misc_feature 2, 3, 6, 8, 9, 12, 17, 20, 22, 24, 26, 42, 63, 90, 107, 108,156, 163, 199, 223, 242, 244, 274, 286, 287, 292, 297, 305,372, 392, 397, 412, 439, 450, 463, 465, 471, 487, 492, 508,521, 550, 552, 580, 611, 637, 650, 664, 680, 689: n = A,T,C or G
  misc_feature 701, 705, 729, 746: n = A,T,C or G

SEQ ID NO: 4246 - DNA, 789 bp, Homo sapiens; identical to SEQ ID NO: 510
  misc_feature 2, 6, 7, 8, 9, 11, 12, 20, 29, 369, 420, 704: n = A,T,C or G

SEQ ID NO: 4247 - DNA, 778 bp, Homo sapiens
  misc_feature 2, 8, 9, 11, 12, 22, 26, 29, 778: n = A,T,C or G
gntttaanncnnttttaatatncatncanctacttgttctttttgcaggacccatcgattcgaattcggcacgagggaacccccaccattaagctaaagtaaaacccttttgagggaagagggagactggggagaagggaaaagagagaaggcagggagagtagggagagaaaaccttccagcagcccagtaaactgcgggcgaagagatctacccgtctccctccctcccacagttaccattggccttgtcatcgcaagcatttgacaaagacttgcttgcttgggcctgtcacctcctgaaaggctgctttagctgtggatgcccttgattaagggagagagcgcctaggagctgcctgccccagctggggtgacggctgtagggctgggtctatgttgcaagccctatatcctagcatgcagtggaaagtgcttagctctctccctcctgacctctgggcagccagtcatcaaagcagagagacgtggcggcatgtgggcagcatgcccaggttccttgctgactcagcacttatttctgtagttttaaaaaagaatttaatgtttttggttgtatttttttgggggggtgagggtgggcaaaaacatgggggtagttctgagtttgttagaaatgtttctgaatcaagtttgtttgaaacacgtgtgcctttgtacccattataagatggtcataagacccaagactgataagctttggttttttttgtttggtttggttttgcttcatttacccattcatgcctagggttccn

SEQ ID NO: 4248 - DNA, 779 bp, Homo sapiens
  misc_feature 628, 652, 739, 741, 772, 778, 779: n = A,T,C or G
caacgctggctacttgttctttttgcaggatcccatcgattcgaattcggcacgaggctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaaccttcttcgggacacaaaanaaaaaaaaaaaaaactcgagcctntagaactatagtgagtccgtattacgtagatccagacattgataaagatacattgatgagtttggacaaaccacaacttgaatgcantngaaaaaaatgctttaatttgggaaatttggngaagcnn

SEQ ID NO: 4249 - DNA, 803 bp, Homo sapiens
  misc_feature 1, 2, 3, 4, 5, 6, 7, 8, 16, 22, 23, 29, 30, 31, 32, 33, 38,41, 44, 50, 314, 403, 413, 486, 505, 512, 537, 544, 553,566, 574, 637, 658, 667, 691, 703, 713, 714, 716, 722, 728,733, 738, 744, 753, 756, 785, 788, 802: n = A,T,C or G
nnnnnnnntttaaatnccattnntttctnnnnnttttnatntanatacanctacttgttctttttgcaggatcccatcgattcgaattcggcagaagattaaaccggtttctgtgggcacctctgtccttgctgctggtggggaagggaagccagatccagcaccccctggggggccatcgggagtgtggctgggggtgaagggggctctgtggcaatatggggttgggtagtgtgggtggcaggccatcccctctaatcttggaacctctgaatatgggacctcccacagcaaagggtgactttgtcattaanaaagactggggtgggtgtggtggctcacgcctgtaaccccagcactttgggaggccaaggtgggcagatcacgaggtcaagagatcganaccatcctgncgaacatggtgaaaccccatctctactaaaaatacaaaaaattagccgggtgtggtggtgggcacctgtcgtnccactctaaggaggctgangcacganaatggtgtgaacccatgaggcacancttgcantgagcgaanatcgcaccactgnacgcactncaacctgggtgacagagcgagactccgtctcaaaaaaaaaaaaatttcaagactggagaggtnatcctgaattgtccagctacnccccatgtnatcacagggccttcatgacagggncagagccaccanctttgaaganncngtcctncccccnaacangcagnctgganaaacttggncangacaagtaggacattcctggagcctccanaanggactgggcttttnc

SEQ ID NO: 4250 - DNA, 773 bp, Homo sapiens
  misc_feature 4, 615, 627, 771: n = A,T,C or G
caangctggctatcgttctctttgcaggatcccatcgattcgaattcggcacgagcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagacatctgtcccgtctttgagtgacaagcccgggacaacagccagtgggcatcacggctctccagcactccttagccggaggatacagagtgatgggtgcatcctgaccaatgcgacaaccaacacgtgctctcacaaacccctgactcccgcactttccagtgccaaagtcaaacgctgcttggataaggagagcaaagcttctggaactttatttactctntctttttaattntcttttaagagactgggtcttgctatgttgcccaggctggtcttgaactcctggcctcaagtgatcctccagtttccatctccctaagactgggattacaggtgtgagcccgctgtacccgaactttttttggtttttgcttcncg

SEQ ID NO: 4251 - DNA, 808 bp, Homo sapiens
  misc_feature 2, 3, 4, 5, 6, 7, 8, 9, 25, 29, 31, 32, 33, 39, 41, 50, 692,724, 774: n = A,T,C or G
gnnnnnnnntttatttacattcagntatngnnnttttgntntaaatacanctcttgttctttttgcagggacccatcgattcgaattcggcacgagggctctccctgagtgtcgaggaggacatgagtgaaatgaccagcgaactcattttttataggactcggtgaagccggattctgcatttccctacttgtagactcattttgtggaatagagttgatcgctgtctcctccgcaaagcattttaactcgaataagcaaatgccgcctctgtttgaacgttttggtatttacaagagagaatcattttacctaagagaactaattgaattggcagcatccttgaaatacctccggacaaggatctgggggtgggggtggaaaagcaactgcgaaatagcagacggagaaattcctttggaagttattccgtagcataagagctgaaacttcagagcaagttttcattgggcaaaatgggggaacaacctatcttcagcactcgagctcatgtcttccaaattgacccaaacacaaagaagaactgggtacccaccagcaagcatgcagttactgtgtcttatttctatgacagcacaagaaatgtgtataggataatcagtttagatggctcaaaggcaataataaatagtaccatcaccccaaacatgacatttactaaaacatctcanaagttttggccagtgggctgatagcccgggcnaacacccgtttatggattgggattcttctctgagcatcatctttcgaaanttgcagaaaagtttcagggaatttaaagaagctg

SEQ ID NO: 4252 - DNA, 803 bp, Homo sapiens; identical to SEQ ID NO: 509
  misc_feature 2, 3, 4, 5, 6, 15, 24, 26, 582, 634, 680, 695, 702, 746,757, 762, 771, 774, 780: n = A,T,C or G

SEQ ID NO: 4253 - DNA, 823 bp, Homo sapiens
  misc_feature 23, 29, 31, 37, 46, 71, 77, 78, 90, 195, 371, 383, 502, 526,579, 648, 671, 692, 703, 741, 745, 751, 783, 785, 810, 814,823: n = A,T,C or G
tttatatacatcagttcttgccnttttgntngactanagctcttgnctttatgcaggaccctcgattcganttctgnncgagtctctctntctctctctgtgtctctcggaactggttccctgggctgaccggagccgggagaacaacctggcctcagggagagagacgctaccgggcttacgccaccccctctnctcaacacaagcccaaactgctacccgcgaggtgcaagtaagcggcacctcagaagtgtctgcgggccctgaccgggcgcaggtggtggtgcagtgagcagcaccaaggaggcggcagccgagccaaaaagagcgtttgtcgccgtctagattacatcacgcagagcctccagcancagggcgtgcangcagaaaatataactgtgacaaaggattttaggagagtggaaaatgcttatcacatggaagcagaggtctgcattacatttacttgaatttggaaaaatgcaaaatatttgtaactttntttgttgaaaagctaagatagctnttgttgtcatcagcccaccccagttcttatcatactccagggttctggttganaatcttcgacggcaagcctgtcttgttgctgttgagaatgcgttggcgcaaactcaaagaagtcttgtnaaccttgttgggccaaaccttangaaaaccttttacttaattcnaaggaagaagnaaacacaaggaattggggaagggccaaatagatgattnaccnagttcnttccagacttcttcaagttcaattaacttgtncnaccaaaaaaatcaaaagtggcaacnaatncattgcttn

SEQ ID NO: 4254 - DNA, 795 bp, Homo sapiens
  misc_feature 4, 6, 12, 17, 24, 579, 679, 759, 767, 769, 771, 791: n = A,T,C or G
catncngtttcnagccnttttganatacattcagctacttgttctttttgcaggatcccatcgattcgatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacattaaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccactacttgggaggccgaggcaggagaattgcttgaacccgggaggcanaggttgcagtgaggtgagatagcgccattgcactccaacctgggcaacaagagcaaaactctgtctcaaaaaaaaaaaaaaaaaaaaaaactcgagcctntaaaactatagtgaggcgtattaccgtagaatccagacatgataagatacattgatgaagtttggacaaacccccacctnggaatgcngngnaaaaaatgctttatttgtgnaaat

SEQ ID NO: 4255 - DNA, 778 bp, Homo sapiens
  misc_feature 2, 3, 4, 5, 6, 7, 8, 15, 32, 35, 45, 60, 360, 509, 535, 557,603, 646, 657, 663, 690, 695, 706, 719, 733, 754, 758, 766,770: n = A,T,C or G
gnnnnnnntttaaantccatacagtttcaagnccnttttgaaatncattcagctacttgntctttttgcaggatcccatcgattcgaattcggcacgagagtccacattaaaaagaaaacaaaacaaaccctaactaacttccaaatgggtctcctggtgcgggggcgtgagtggccgtgccctgggtgtgctgcctgtctgagcaagcttccctagctgtggaaccccgggccccctgctgcgggctctgccttggtgtcatgcctgctgcacccccgtttccactgacgtgccgtctgtggctatggggtggtcactggaatgacggtcactccagacgtcagccggcagggatgcancaggctggccgcgcaccggggctcgggcaccctctggccccacactggcaatgatgccacaccttgccatgtccacgctgttggtcaaacccctctgtcatgcctctttaaagagaaaagaagagaaagatttttttttttaatggcanaccgaaatggagatcttgtagcctanataggatagtctgaccttctancatagtctttttggcaaatgatttgtgttttcagtgtgtggggaanctgtcctgggggctggggcgacagatagcacataagctgtttntggggctgcangggctncctgactggatgttgtgggtgttgccngcttnagaatgtggcnacaaaaagcgtanaccggggccaggtntgccgcctgagctggctcccnaagntgggttgntcancgttattt

SEQ ID NO: 4256 - DNA, 869 bp, Homo sapiens; identical to SEQ ID NO: 4217
  misc_feature 21, 27, 32, 33, 36, 46, 48, 58, 107, 119, 180, 185, 187,210, 211, 233, 263, 268, 270, 276, 278, 281, 285, 286, 295,302, 315, 317, 320, 322, 325, 328, 332, 345, 359, 361, 362,363, 385, 401, 412, 426, 427, 434, 463, 493, 507, 511: n = A,T,C or G
  misc_feature 523, 527, 529, 530, 538, 544, 549, 567, 571, 576, 583, 586,623, 625, 626, 630, 635, 658, 659, 672, 681, 691, 693, 712,714, 725, 727, 730, 741, 742, 751, 755, 771, 773, 787, 790,792, 798, 811, 820, 857: n = A,T,C or G

SEQ ID NO: 4257 - DNA, 807 bp, Homo sapiens
  misc_feature 1, 15, 18, 31, 32, 34, 37, 43, 57, 65, 96, 98, 119, 120,123, 124, 146, 173, 175, 176, 179, 185, 191, 210, 218, 221,231, 239, 248, 257, 259, 264, 265, 267, 269, 271, 274, 279,286, 287, 293, 302, 311, 321, 322, 324, 334, 338, 340: n = A,T,C or G
  misc_feature 351, 352, 388, 391, 397, 398, 404, 411, 415, 421, 424, 426,427, 428, 431, 434, 436, 441, 460, 461, 463, 465, 467, 485,486, 490, 493, 500, 504, 508, 512, 525, 528, 530, 536, 546,551, 556, 558, 561, 565, 571, 579, 588, 590, 592, 599: n = A,T,C or G
  misc_feature 601, 606, 608, 610, 611, 614, 623, 626, 632, 638, 668, 671,674, 676, 689, 703, 712, 716, 725, 742, 754, 761, 766, 778,794, 800, 801: n = A,T,C or G
nttttatttacatanagntcttgcctttttnnanganatacanctacttgttctttntgcaggancccatcgattcgaattcggcacgaggccacnancaggtgggggccaggacgccnnggnnctgaccgcctccactagagggnggtggccgcgggccgacctggaccttnannccntgtccngacctnccggtgggtgggtgcgccngggagccngcnacattccttnttcttgancagccaaanattggagtncnattcnncnangnacnttttnttttttnngatcangagtgtgtncaacgtacncccctgcctnngnaagccctgantccntnatggagcctcnnagagtggggagcatattggggtggggtaatgcactncanccaagnngaatgnacacaangggntcgtcnaangnnntgnggncnccctnaccccttaccaccatgtgnngntngnctctgtggttgaacatcnnactngtncgcaaangganactnactntaaaaccctttgnacnanggtgcnaaaccacagntgtgncctgncncanctanccatcnaaagaatnacaaaaccncntnaggggcngngggcnancnntcncccttgtcncgncctgtnttggantggcctttcggcttaaacagtgaggctcanaanggncncaacctggggtgntaataaaaagaacnaattaaganactnttccctccnacccccctttccttgtngccagggggcancaaactngattnttgaagcccaanataaaaaaaaggcttnatatcnnggaaaa

SEQ ID NO: 4258 - DNA, 716 bp, Homo sapiens
  misc_feature 2, 5, 13, 478, 559, 589, 654, 687, 693, 716: n = A,T,C or G
tntcnttcaaatngcttggctctcgttctttctgcaggatccctcgattcggaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtacttcaaaaagatttttaaataggtccggcacggnggctcatgcctgtaatcccagcactttgggaggctgaggcgggctgaatcacctgaggtcaggagttcgagatcagcctgnccaacatggtgaaaccctgtctcaactaanaatataaaaattagcccgggccgtggtggcaggcgcctgtaatcccagctactcgggaggctgangcaggagaatcacttgaacccaaggggcagaanctgcanttaagccaagatcgcatcattgn

SEQ ID NO: 4259 - DNA, 774 bp, Homo sapiens
  misc_feature 9, 13, 18, 27, 34, 36, 37, 38, 41, 398, 688, 689, 690, 692,693, 694, 695, 696, 697, 698, 699, 700, 701, 702, 703, 704,705, 706, 707, 708, 709, 710, 711, 712, 713, 714, 715, 716,717, 718, 719, 720, 721, 722, 723, 724, 725, 734, 735: n = A,T,C or G
  misc_feature 753, 773, 774: n = A,T,C or G
tttttaaanaaancaggnttcctaatncttgttntnnnganacaggctacttgttctttttgcaggatcccatcgattcgaattcggcacgagattctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaaccacagtntaaatcagttactggacaaacttgaaatcatggtggaagaaacagacagtgttagctcatgatttgatttggttctacctttggccttgagttcttattatttacattataaatattaactggttttatattgttaagacaaaacactggtaaaagtttcaacacctcccttttgcttgtataccataaatgggcagtttctgaaattttggataaagcatcaagaactcctttttctgaaacgttcctccttttttagtgcctaattaatatacttacttacacggaannnannnnnnnnnnnnnnnnnnnnnnnnnnnnnnnnnnaaaactcgnncctttaaaactatagggngtcgtttacctaaatccaann

SEQ ID NO: 4260 - DNA, 717 bp, Homo sapiens
  misc_feature 2, 13, 18, 246, 383, 438, 520, 532, 534, 626, 635, 661, 703,705, 710: n = A,T,C or G
tntcattcaagtnctaangctggtctttttgcaggatccctcgattcgaattcggcacgagactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaanggtggaaagaagttgtacgaaggtcaaagaaattgtctgttccagcctcagtggtgtcgaggataatgggaagaggaggatgcaacatcactgcaatacaggatgttactggtgcccatattgatgtggataaacanaaagataagaatggcgagagaatgatcacaataaggggtggcacagaatcaacangatatgcagctcaactaatcaatgcactcattcaagatcctgctaaggaactggaagacttgattcctaaaaatcatatcanaacacctgccancnccaaatcaattcatgctaacttctcatctggagtaggtaccacagcagcttccagtaaaaatgcatttcctttgggtgctccaactcttgtnacttcacangcaacaaccgttatctacgttcccancccgctaataaacttaataagaatgttcttagaaaaaaaatntnaaaanctcgact

SEQ ID NO: 4261 - DNA, 704 bp, Homo sapiens
  misc_feature 4, 12, 16, 21, 34, 97, 116, 152, 154, 163, 188, 192, 206,207, 210, 212, 224, 231, 233, 235, 272, 281, 282, 288, 298,300, 304, 306, 307, 310, 316, 318, 319, 326, 327, 329, 330,334, 336, 337, 343, 345, 353, 355, 378, 379, 390, 396: n = A,T,C or G
  misc_feature 400, 411, 416, 421, 426, 428, 429, 441, 443, 444, 451, 457,464, 474, 482, 483, 488, 491, 503, 519, 521, 523, 531, 535,537, 542, 544, 545, 546, 549, 563, 564, 565, 567, 571, 577,580, 582, 587, 589, 592, 597, 598, 599, 603, 607, 609: n = A,T,C or G
  misc_feature 610, 612, 615, 617, 618, 622, 625, 629, 631, 633, 653, 659,662, 669, 670, 678, 680, 683, 692, 699, 700, 703: n = A,T,C or G
tgtncttttcanttgntagcncttggctacttgntctttttgcaggatcccatcgattcgaattcggcacgagcctgtttccaggagatatgtgtgnccatcagcagtgataaaantcttgggcaggagttattgcactgtttgtatgatcnanacccacctnctctgctggaaacaagcagcgtganttgntcacttgcctttcnnagncnctattggccagntgcttgnangngaacggatccacagaacctcacagctatttatgatancatctgctnnattatntcaagttcancntgtntnnacntgctgntnnaggtaanngnngttntnntcaagntntttgcaangngatgacaaactaatgtttgaatnngtcatgataanggggcntctnatactctggancatcnccaanctgantnngaagagctgccngnntatctgntagtgncctgctncttgaaattnccaaacanntgccntgntggaaattcatnatggctggatgtttangngnacattttncaantncttantnnncangatgatggaattcnnncnatcnaacatnctntncgctngntanacttnnnattnactnanngnctntnntgcnatnattngncnctctgtgatcatccatcatnatctangcntcaagtnnctaacctngnttngaagttgtngcaccannttnt

SEQ ID NO: 4262 - DNA, 708 bp, Homo sapiens
  misc_feature 2, 4, 8, 16, 292, 605, 633, 643, 654, 658, 659, 665, 666,671, 675, 678, 684, 687, 689, 690, 704, 706: n = A,T,C or G
tntncttnaaatcatngctcttgttcttttgcaggatccctcgattcgaattcggcacgagagagggtggggtctggccacataggtacctctgtggctctggtctggggttagacactgttagggactagcatttattggacttgtaaagacagcacctcagaattagtaactacttgcattttagggtctgttttatgaagccaacaagtgaatgtaaaataggctctgcatcttttctgagagccctgtcactgggcagtgagcatttccaaaattgcagctctgtcanaatgaaccatgaatacttaagaaagggaaagtaggaacagggagcagagcaaagcataacttgctgtgttccagggatttaaaaataaattactgtcaagagcaatataagggtcatgggtttgatcaggaactttttgtaaatgaaaaagttcacaatttggaaaaaacagtgctagatgtgttatggaaattgttatcacaaattattccactgaaactcaagtatataagacaacaatatattgctgtgaaatcttaattttgacatatggaagggtaccaaaaataagaaccatcctttttgcttgaantgcacggtggtaccaatttctaaaatangaaacattangcaaaaaaaanattnncttttnngcttnaaantanaaaaanctngnnccttttaaactttngngg

SEQ ID NO: 4263 - DNA, 708 bp, Homo sapiens; identical to SEQ ID NO: 4262
  misc_feature 2, 4, 8, 16, 292, 605, 633, 643, 654, 658, 659, 665, 666,671, 675, 678, 684, 687, 689, 690, 704, 706: n = A,T,C or G

SEQ ID NO: 4264 - DNA, 717 bp, Homo sapiens; identical to SEQ ID NO: 4260
  misc_feature 2, 13, 18, 246, 383, 438, 520, 532, 534, 626, 635, 661, 703,705, 710: n = A,T,C or G

SEQ ID NO: 4265 - DNA, 743 bp, Homo sapiens
  misc_feature 11, 99, 194, 210, 289, 339, 350, 373, 397, 528, 532, 556,577, 580, 584, 607, 615, 624, 636, 641, 650, 652, 653, 655,662, 663, 664, 665, 674, 679, 682, 699, 703, 714, 722, 723,725, 733: n = A,T,C or G
tcttccatttnaagccctttgctacttgttctttttgcaggatcccatcgattcgaattcggcacgagagagggtggggtctggccacataggtacctntgtggctctggtctggggttagacactgttagggactagcatttattggacttgtaaagacagcacctcagaattagtaactacttgcattttanggtctgttttatgaanccaacaagtgaatgtaaaataggctctgcatcttttctgagagccctgtcactgggcagtgagcatttccaaaattgcngctctgtcacaatgaaccatgaatacttaagaaagggaaagtaggaacanggagcatagcnaagcataacttgctgtgttccanggatttaaaaataaattactgtcnagagcaatataagggtcatgggtttgatcaggaactttttgtaaatgaaaaagttcacaacttggaaaaaacagtgctagatgtgttatggaaattgttatcacaaattattccactgaaactcaagtatntaanacaacaatatatcgctgtgaaatnttaattttgacatatggaaangtnaccnaaaaattttgaacccataccttnttggcttnaaattgcanggtgggtacccnatttnttaaaaatnannanacctttnnnnccaaaaatnacttnatnctacaaaaaattttccncggnccatggttaanaaccttgnncncctttttnaaacttttac

SEQ ID NO: 4266 - DNA, 738 bp, Homo sapiens
  misc_feature 3, 10, 11, 14, 27, 29, 32, 44, 46, 59, 522, 526, 529, 572,607, 608, 616, 621, 623, 624, 625, 632, 634, 636, 641, 648,650, 653, 673, 677, 695, 700, 701, 708, 709, 724, 737: n = A,T,C or G
tcntcgtttnnatncttggaaatttgnanatngctaggctactngntctttttgcaggnatcccatcgattcgaattcggcacgagccttccacggttatttcacagatatggagagctggaagcagggagtgagtctctgagtgttggaattgtaagggatcagaagcagggatcagaagcagtggtgaagttcatccaccataaaacacacaggtgactttgccttgaatctgcaggactgaagccaactcttgggcacagacccttagtcccttccttggccactctaagtcagatagtccagagccaggccctttgggatgtgacaccgagataaatcatagaaaagctgtgaagcttggggaacagagggacttttggtgaagtaggtggtctgcagtttctatcttcttgggaaaagcaagctggaaaagtgaacagtggttggtaggccatagtgctcccagctgggtgacataatgaccacacagcacagtgatgttattagcaactgtgtggnggantanttgtgggctggacaaatcaatcgtgtggaaattgttaggagtnttattacattaaacttgttaacctaaaataccatnnaaaaatanaatcngnnntaaaacnancntatanggatgtnanaanaactcgagcttctaaaactntagnggagcctttgttacgtanatccnngacatgnntaagatacattggtnagttttggacaant

SEQ ID NO: 4267 - DNA, 774 bp, Homo sapiens; identical to SEQ ID NO: 507
  misc_feature 3, 4, 8, 13, 17, 22, 605, 621, 711, 714, 720, 730, 737, 738,772, 773, 774: n = A,T,C or G

SEQ ID NO: 4268 - DNA, 796 bp, Homo sapiens; identical to SEQ ID NO: 506
  misc_feature 4, 9, 10, 14, 16, 40, 41, 43, 45, 48, 49, 52, 61, 87, 435,479, 495, 552, 556, 564, 617, 628, 638, 642, 643, 654, 663,664, 666, 679, 681, 685, 691, 697, 700, 704, 708, 713, 718,720, 724, 732, 739, 740, 744, 750, 753, 761, 766, 767: n = A,T,C or G
  misc_feature 771, 773, 774, 776, 778, 780, 781, 788, 791, 794, 795, 796: n = A,T,C or G

SEQ ID NO: 4269 - DNA, 736 bp, Homo sapiens
  misc_feature 12, 14, 47, 380, 414, 460, 510, 557, 559, 564, 622, 623,624, 630, 689, 690, 695, 713, 714, 717, 720, 726, 727, 734: n = A,T,C or G
ctacttgttctntntgcaggatcccatcgattcgaattcggcacgangtcactctgtcacccaggctggagtgcagtggtgtgatcatagctcactgcagcctctacctcctgacacaagctgtcatcccgctttggcttctcaaagtgctaggattataggcgtgagccaccatgcccgaccagtttctgcttttattaaaattgttcacagttttatacattcatgttcattaaaaatgctatttagaaaagagtttgataaaataaatattatacaaaattcgaagaaaaaagaaaagagtttctgtttcagtcacaaattagggttattgtgatgtgtatttatgatgaccattgaacaaatgtgaagaatactgngaattctatgactttatcaaaatcagccacatcncaggagcttgcagttgttgaccaaatgaatgatgacatagagtagntcagatctatcatgtgctcttctatctaatcagtccaatatttccttggncctcaagccaacattcattttttatgtataacccttcttcatgattntnaaatnttgatagggtaaactgctaatgagtttcacaaatgtagcacttttaaaaggaaaaatnnnatgganagtgaaaacaacttgcctacctataattgtgggtctctaatctttctggttttaaaaannaaaantggcattgctaggtttcnnaancanaaaaannaaaaacnct

SEQ ID NO: 4270 - DNA, 736 bp, Homo sapiens; identical to SEQ ID NO: 4269
  misc_feature 12, 14, 47, 380, 414, 460, 510, 557, 559, 564, 622, 623,624, 630, 689, 690, 695, 713, 714, 717, 720, 726, 727, 734: n = A,T,C or G

SEQ ID NO: 4271 - DNA, 774 bp, Homo sapiens; identical to SEQ ID NO: 505
  misc_feature 2, 3, 5, 7, 8, 11, 13, 15, 25, 101, 513, 586, 600, 609, 662,682, 689, 706, 724, 732, 753, 755, 757, 760, 773: n = A,T,C or G

SEQ ID NO: 4272 - DNA, 740 bp, Homo sapiens
  misc_feature 6, 527, 739, 740: n = A,T,C or G
aaacantttgctcttgttctttttgcaaggatcccatcgattcggccaacttcaattcccttttagtcatctacttcctactaacagctgtaactaggatgagtcaaaatcaattgcctatgctcaccagatccctgataaattcccatgaagccacctgaaaggtggtaaaagcaaggtaaaacgtggtgaaagcaaggtaaagaaggtagatttcacaattttgttttttaaaaaggggaatcttccctgaattctttgaggtactaagtacgtggtttaatgcatattttcattcttgttagcagtttaaaaataatgtttcagagactgtattcacgattgctaaaaagcattttttctactaatcattgttcatgggacttaacaatggaagataactgggaaagcagtaaatataggaaaccactaatagtgtctccttcttcctaccctgaccctctctttggcttcagaaagtgacgaggaaaatgtatctttcacaaagaaaagttataccacagaangtactaaaaagcaacaactgcctttggggacaggaaacttacagaggggattattatagagggataacataccgagtttctatttcaataagagggaaattggtttatattctgttcacacttgtttcaaaaccctctcctctaaaagcatgtgttttttggaattcaaggaatgtaccgttctttccccaacccttaaactggggggtcann

SEQ ID NO: 4273 - DNA, 743 bp, Homo sapiens; identical to SEQ ID NO: 4265
  misc_feature 11, 99, 194, 210, 289, 339, 350, 373, 397, 528, 532, 556,577, 580, 584, 607, 615, 624, 636, 641, 650, 652, 653, 655,662, 663, 664, 665, 674, 679, 682, 699, 703, 714, 722, 723,725, 733: n = A,T,C or G

SEQ ID NO: 4274 - DNA, 776 bp, Homo sapiens
  misc_feature 9, 32, 36, 43, 53, 60, 62, 86, 122, 131, 153, 156, 168, 171,178, 182, 185, 195, 199, 206, 207, 209, 210, 213, 220, 237,240, 241, 245, 251, 297, 303, 333, 343, 345, 363, 366, 369,370, 371, 377, 378, 380, 381, 385, 393, 394, 398: n = A,T,C or G
  misc_feature 409, 413, 415, 418, 419, 427, 430, 436, 440, 442, 450, 451,452, 462, 473, 476, 490, 496, 498, 507, 509, 510, 512, 517,522, 524, 525, 529, 540, 550, 554, 592, 602, 622, 624, 625,641, 643, 651, 652, 653, 657, 660, 662, 665, 668, 672: n = A,T,C or G
  misc_feature 675, 679, 682, 696, 699, 705, 717, 720, 721, 729, 733, 738,741, 747, 753, 757, 766, 772: n = A,T,C or G
tgtcctttnaattctaatgcttggctactcgntctntttgcangatcccatcnattcgantncggcacgagggcaggggcccttanagtcttggttgccaaacagatttgcagatcaagganaacccaggngtttcaaagaagcgctagtaangtntctgagatcctngcnctagctncatnctnagggtaggangaanatggctnncnnaancatgcgngtgctcctattgctganctnnctgnccaaancatgagtcctgggtgatatcatcatgagacccacatgtgctcctgnatgganttaccactacttcaaatgctatgagtactntcagaaactntngaactggtctgatgcccntgntannnaacttnntnnctgnttggcctnncctntctagatcaanggancngcnntaatcccnaanttcatntgantnaagatcannngttcctgctnggcacctttcnagnataatccccttttngcttgntnaaacggaantnnanaaggngtgtntnnttcnaatcttattanaattcttgtnattncatttgctataatccctggagcctggatttcctggaanccgtaaaacngggcttctaagcaccttacncnnttccatccttgaaagnancccccgtnnncatncantnagnctnctanttntaantcntattggagaccctnaanattccntttacatcaaanggnnggtataanaatntttcnggnattttncagganctgngtaaaattnttattntacc

SEQ ID NO: 4275 - DNA, 731 bp, Homo sapiens
  misc_feature 2, 16, 19, 48, 55, 457, 612, 638, 645, 683, 693, 716, 727: n = A,T,C or G
tnagtttgaatgcttnganttgctaatagcttggctactcgttctttntgcaggnatcccatcgattcgaattcggcacgagcagtggctggataaaaggatgtgtgggaaagaactgagttgaaattaggagttagaattttattctttggtactaaggaatcattgaagattttaaaattagggctgacataatcagatttgagtttgggaacctatagtttgggactggaggaagacaggtgccagacaccagttaaaaagctgttattttctaagcagtagacaaaggtttacactgacaatagctgtggagatagagaaaagctgcgagatttcagagttttccaaggtgtaaacaactaaattttgtgatcaaaatgataagggccatctaataagctggggaatgtgggatctgtcttggttgagttggtggattaactgagattaacanagctggaggaaatgtaaaaagaaaggcaggattgttcattttgtcttttgtttgttttggggaacagggtcaaaattttcattctgcataaggtaggtttagtctttttcaaaacattctagtaggcaagtctgtagctgaatcttggaagaaangcaaccatagtaatatttttgagttnctactgnttattttttcaataaaaaactcaggttctcaagtttancagattcatnggtcttaggaaaggtagctgttnaaccaaaatantaat

SEQ ID NO: 4276 - DNA, 731 bp, Homo sapiens; identical to SEQ ID NO: 4275
  misc_feature 2, 16, 19, 48, 55, 457, 612, 638, 645, 683, 693, 716, 727: n = A,T,C or G

SEQ ID NO: 4277 - DNA, 731 bp, Homo sapiens; identical to SEQ ID NO: 4275
  misc_feature 2, 16, 19, 48, 55, 457, 612, 638, 645, 683, 693, 716, 727: n = A,T,C or G

SEQ ID NO: 4278 - DNA, 712 bp, Homo sapiens
  misc_feature 20, 275, 422, 504, 613, 627, 634, 656, 664, 672, 697, 699: n = A,T,C or G
tctccttgaaattgcttatngctaggctacttgttctttttgcaggatcccatcgattcgaattcggcacgagagtggctggataaaaggatgtgtgggaaagaactgagttgaaattaggagttagaattttattctttggtactaaggaatcattgaagattttaaaattagggctgacataatcagatttgagtttgggaacctatagtttgggactggaggaagacaggtgccagacaccagttaaaaagctgttattttctaagcagtanacaaaggtttacactgacaatagctgtggagatagagaaaagctgcgagatttcagagttttccaaggtgtaaacaactaaattttgtgatcaaaatgataagggccatctaataagctggggaatgtgggatctgtcttggttganttggtggattaactgagattaacagagctggaggaaatgtaaaaagaaaggcaggattgttcattttgtcttttgtttgttntggggaacagggtcaaaattttcattctgcataaggtaggtttagtctttttcaaaacattctagtaggcaagtctgtagctgaatcttggaagaaaggctccatagtnatatttttgagttnctactgnttatttttcaataaaaactcangttctcangttagcanatcatggtcttaggaaggtagctgnanaaccaaaatatat

SEQ ID NO: 4279 - DNA, 712 bp, Homo sapiens; identical to SEQ ID NO: 4278
  misc_feature 20, 275, 422, 504, 613, 627, 634, 656, 664, 672, 697, 699: n = A,T,C or G

SEQ ID NO: 4280 - DNA, 717 bp, Homo sapiens; identical to SEQ ID NO: 4260
  misc_feature 2, 13, 18, 246, 383, 438, 520, 532, 534, 626, 635, 661, 703,705, 710: n = A,T,C or G

SEQ ID NO: 4281 - DNA, 722 bp, Homo sapiens
  misc_feature 2, 8, 13, 16, 25, 29, 634, 687, 711: n = A,T,C or G
gngtcatnctttnaantttctaatngctnggctacttgttctttttgcaggatcccatcgattcgctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaagtgtgtgcccagaccggaanagacggtccagcctctgatggctcggagatgatggaccgtggaaagggaaccntctgtggggagtgaaccgcttaanatggccagcat

SEQ ID NO: 4282 - DNA, 789 bp, Homo sapiens
  misc_feature 2, 3, 6, 26, 27, 32, 41, 108, 121, 166, 190, 237, 276, 323,326, 337, 386, 411, 418, 419, 423, 436, 476, 491, 514, 516,525, 527, 536, 545, 546, 561, 567, 586, 600, 607, 609, 618,633, 641, 642, 644, 645, 646, 663, 668, 671, 677, 687: n = A,T,C or G
  misc_feature 688, 701, 707, 717, 718, 719, 724, 737, 738, 740, 741, 742,745, 746, 765, 766, 768, 773, 779, 787: n = A,T,C or G
tnnttntccacttggaaccccttttnngaaancccgcaggnatcccatcgattcgctctgggagtagctgggattacaggcatgcaccaccatgcctggctaattttntatactctagtantagacagggtttcgcccatgttggtcaggctggtctcaaactctngacctcaggtgattcacccacctnagcttcccaaagtgctgggattataggcgcgagccaccatggctcancctcatgttcgtttttaaaacttaggatggtggctcttntacattgattggcaggaactcttcatattacgaggcacttagctagntgnctgtgaaatanaatactaatgattgaactttctaggaagtgcctattctgctaatagtgnaaatatacacttatccagggtcagnaatactnnagtntacccacttaaangatctagacatacatgaacttgggcttacttgcccgttanaattgcatatcttanaatagtccatcaccttacttaangnagatatgcntngattatccngattactcnntaacatagcctctcnccttancgttctcacctgaatgtantacctggacctctncaagtcnancagaggccnataataaaagttcanaagtttanncnnnacacccctctccccccncccantancccaancccctcccannaccccctctcccncccacncctcacctcnnnatccncccaccccactcnncnnncannccttcccccccaccccccnncnctacncctccntcccatcncg

SEQ ID NO: 4283 - DNA, 713 bp, Homo sapiens
  misc_feature 2, 8, 16, 18, 22, 489, 499, 553, 565, 573, 593, 646: n = A,T,C or G
ancctttnaaattccntngccntaggctacttgttctttttgcaggatcccatcgattcggctgcacagtgggaagggcactgggctggaagccctacccatgtcagggaatgtctgggcctcagatttttattttctagaatgaagatacttaccccccaattgctgagatatttgaataaaagtatatgtgaaggattttgtaattatagaatgtcctacaaatatgagtagttcgtttgctacttttttggcgaagaaaaatattgggatgcatgaataatatctacctaaggtacctaaggttgtattcatcccatttattgaatgccaaggatataccagctactgctccagatgttgtattcagggaacagaagaagagtccctgtgcccatggagctaacagcattctaggggaggaaagatgggtcagctgactttcacgatctcaggtactgatgaagattgtgaagattattacatcangtgaatgtangggtgatttagagaaagctggtagctaggctgttcaaggaagggcctctgtganaaaggggatggntggctggntgtggtggttcacgcctatnatcccagcactttgggaggttgggagtttgagaccagcctgaccagcatgganaaaccccgtctctactaaaaatacaaaattagcccggcatggtggcacatgcctgtaatccagctcc

SEQ ID NO: 4284 - DNA, 713 bp, Homo sapiens; identical to SEQ ID NO: 4283
  misc_feature 2, 8, 16, 18, 22, 489, 499, 553, 565, 573, 593, 646: n = A,T,C or G

SEQ ID NO: 4285 - DNA, 724 bp, Homo sapiens; identical to SEQ ID NO: 508
  misc_feature 15, 27, 460, 461, 462, 483, 486, 488, 505, 510, 517, 521,524, 526, 531, 537, 538, 540, 543, 549, 561, 563, 569, 570,579, 581, 586, 587, 599, 604, 606, 607, 610, 611, 612, 615,616, 619, 622, 623, 624, 628, 630, 632, 638, 639, 640: n = A,T,C or G
  misc_feature 641, 642, 645, 653, 656, 657, 659, 663, 664, 667, 669, 672,674, 675, 677, 678, 682, 684, 697, 698, 701, 703, 709, 710,714, 717, 719, 721: n = A,T,C or G

SEQ ID NO: 4286 - DNA, 740 bp, Homo sapiens
  misc_feature 8, 9, 19, 21, 22, 36, 416, 605, 610, 611, 614, 618, 621,622, 625, 629, 633, 636, 637, 640, 651, 674, 675, 677, 690,700, 706, 707, 716, 737: n = A,T,C or G
gttcaatnnttgaaatttnanntcgctaggctactngttctttttgcaggatcccatcgattcgaattcggcacgagccttccacggttatttcacagatatggagagctggaagcagggagtgagtctctgagtgttggaattgtaagggatcagaagcagggatcagaagcagtggtgaagttcatccaccataaaacacacaggtgactttgccttgaatctgcaggactgaagccaactcttgggcacagacccttagtcccttccttggccactctaagtcagatagtccagagccaggccctttgggatgtgacaccgagataaatcagagaaaagctgtgaagcttggggaacagagggacttttggtgaagtaggtggtctgcagtttctatcttcttgggaaaagcnagctggaaaagtgaacagtggttggtaggccatagtgctcccagctgggtgacataatgaccacacagcacagtgatgttattagcaactgtgtggtggagtagttgtgggctggacaaatcaatcgtgtggaaattgttaggagttttattacattaaacttgttaacctaaaataccatcaaaaaanaaaannttnatgnttnnacntacntgtnatnntanaaaaaaaaacnttgagccctttaaaacctattanngngtcctttttaccntaaaatccanaccttnnttaagaatncatttggattgaatttttggncct

SEQ ID NO: 4287 - DNA, 740 bp, Homo sapiens; identical to SEQ ID NO: 4286
  misc_feature 8, 9, 19, 21, 22, 36, 416, 605, 610, 611, 614, 618, 621,622, 625, 629, 633, 636, 637, 640, 651, 674, 675, 677, 690,700, 706, 707, 716, 737: n = A,T,C or G

SEQ ID NO: 4288 - DNA, 738 bp, Homo sapiens; identical to SEQ ID NO: 4266
  misc_feature 3, 10, 11, 14, 27, 29, 32, 44, 46, 59, 522, 526, 529, 572,607, 608, 616, 621, 623, 624, 625, 632, 634, 636, 641, 648,650, 653, 673, 677, 695, 700, 701, 708, 709, 724, 737: n = A,T,C or G

SEQ ID NO: 4289 - DNA, 712 bp, Homo sapiens; identical to SEQ ID NO: 4278
  misc_feature 20, 275, 422, 504, 613, 627, 634, 656, 664, 672, 697, 699: n = A,T,C or G

SEQ ID NO: 4290 - DNA, 836 bp, Homo sapiens
  misc_feature 67, 204, 220, 235, 241, 270, 302, 372, 384, 408, 411, 417,431, 439, 443, 444, 447, 458, 461, 463, 478, 483, 484, 487,488, 491, 496, 499, 501, 502, 506, 513, 514, 517, 525, 528,534, 537, 542, 546, 549, 550, 576, 578, 583, 586, 596: n = A,T,C or G
  misc_feature 597, 602, 603, 620, 625, 645, 652, 654, 658, 661, 662, 674,682, 685, 686, 687, 693, 694, 696, 700, 703, 704, 713, 714,715, 719, 732, 738, 746, 748, 757, 763, 764, 767, 771, 774,776, 781, 782, 786, 790, 794, 801, 803, 807, 809, 811: n = A,T,C or G
  misc_feature 813, 822, 825, 829, 834, 835: n = A,T,C or G
ggagggatgaaaatgagccctgggagggaggaagggacgaggaggggtggctgcatgttaccgtccnctacctctcccacgtggagggtggagcagttatgagggaggaagtcaactgctgttcagcctcagaataaaggtgccgttcactggctcagttacctcctgtgtaccggcatcttgtgttgggaatgttcccccctncctagggaccaaggancacccctacaaaaanagtaantggttgggtgatactcccttaagccaaanaggagctacccaacctgttcttagggacccangttacctacaagggtgggagagaattcaatgggcccagatgttggtggaagccccatctctggggctcangtttcttggaanacttatactatccctaccctcctnaangcctgnatcagactaaaatntgtataantcanngcntgggaccctantcnanggtcttgggaagctnccctnnccnnttngggtnccnannagcnaacattnntcncaagggcnccncttatnggnaaaantgtnggnncacattccccccttctccaaaggaangnggccncgnattaacaatnngctanncttttcgccattggctnaaaancccctccccacatttccatnatttcangnttgngcnncattatctattnctttatantgnnntggtanncncttnttnnactcaaagnnnatcncttacctttcacnatcccncaattttncntggctccanctgtgnnccntttnganancctcnncctncttncttncagggantnttanangntnatctaaatntgnggcncatannt

SEQ ID NO: 4291 - DNA, 747 bp, Homo sapiens
  misc_feature 6, 9, 30, 476, 527, 643, 646, 647, 668, 697, 703, 713: n = A,T,C or G
cttacnttngctctcgttctttttgcaggntccctcgattcgaattcggcacgagttcagggttggtgggtctgtggaccttgagctagtttttaatcaacatggaaactccagtgatctatttaaaaacttgcattgggtcatgccaggtttattggaggttataccctccaatgtatttccaactcagggttaaagccaaggtccttatggtggaagatggggcatataaactggcattctggcgctcacacactccaatatctactactctcccctcttgctcgctcagctgtggcttgcttattcagctttttgctcttcctggaatacatcaaacatatgtaggcccagggttttaaccattttaacaactgaacttgtaactgcactagttctccaggtaagcagaagtattagggttatggacagtttatccgaagtaataaccaggaatgcctaataaaaacatgcangtattgtggtaaaaaatagagttggtgaacaaggagttaccttctgactgnttctcttttagtgaagtaggaggcaaggttattagctaagagtgagatggttaggagatggtgtaaatttaaaggaaaagaattaaggtatgagatagttggctaggataatgaanttnntgaatggttttgagctaagtngtattaaaatcccctttaggtaatagacnatgaanttccaaagcnccacttagccaaccctgggttctttcttttcttt

SEQ ID NO: 4292 - DNA, 759 bp, Homo sapiens
  misc_feature 3, 4, 5, 6, 12, 17, 18, 39, 47, 102, 106, 480, 630: n = A,T,C or G
ttnnnntcaacnggacnncttttacccttcccgttcttnttgcaggntcccatcgattcgaattcggcacgagatgttgcccaggctggtctcaaactcttntttntcaagcaatactcctgccttggcctcccaaagtgctgggataataggcatgagccatcatgcctggccgaacttatttttaaattctttgggaatctaaaaggactatgtgctttcttttttactggattatgtgagaagataatagtttgcagagaaattcagtgaagcagctgataaaatgctttaaaaatatatttcagagaattgagcaataacagtgatgtcaaaatagtagccccaccttctccagcccacctaaaccaacactgagcatggacacatgcatttcttgtcatcagccagacgaaatggagtagcaaaaatccatcctatatgtcattgagtcttataatacagttctcttttctctgnctattaataaaagaccccactgaatgaagccggaattcttttaggcaatttaaactttctgaaatagaggaaagttggaaaggggcggtagtcaaggaatatagaagtaaaaaatatttttgaggtcaaatgcttatctgaacagattgnctagtctgattatttttaaaagtattatgttgatccagtggtttaaatttgaatcaaaagtaatgatttaaccaaaggttgtgcttccattattaacctcagaaacactaagaaaccgaaatcactttt

SEQ ID NO: 4293 - DNA, 736 bp, Homo sapiens
  misc_feature 3, 6, 8, 9, 12, 13, 511, 535, 631, 632, 727: n = A,T,C or G
ttnttncnnctnntggaaccctttttgcaggatcccatcgattcgaattcggcacgagcaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagttngtgatgttttctgacagtagcctncaagaacccgttgtgcgaagacagagtcctgcagagtccttccagcctagcctgcagcgccattttatttatattttttaataaaaagtaaaacannaaaaacagacccacattggaacagtgaatcattccatagagaggcccgtggaccatcgttgtcatgagtgatgcctggccttttgaaaccagccnacctaattc

SEQ ID NO: 4294 - DNA, 738 bp, Homo sapiens
  misc_feature 10, 12, 13, 50, 453, 474, 485, 505, 543, 590, 603, 614, 626,632, 634, 641, 687, 705, 719: n = A,T,C or G
cttcttttcntnncacgttctttttgcaggatcccatcggattcgggagnaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattangtgttaagagttttccttcangctttacttangagaatggactaagctgaangtgtactttaccagcaagagtcaactctagaatttcangatgttccttctattgcctcttagccatctgtcaggaaatgtaactntggttttattttnggctattccanggggtaagccanaaaatngnaatgatnattctgattaatagcagaaactttttcatcccaaattataaggggnctgctcttttaaaaagcntctaagctaagtcnagagcttaggaactgtgac

SEQ ID NO: 4295 - DNA, 746 bp, Homo sapiens
  misc_feature 3, 4, 5, 8, 31, 46, 376, 667, 668, 669, 680, 687, 691, 699,702, 711, 714, 718, 726, 730, 732, 733, 735, 742, 743, 744: n = A,T,C or G
ttnnnttnttgaactttttaccctgttcttntgcaggacccatcgnttcgaattcggcacgagggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctnctcagtcagctggaggcgctgcagcccccagctcctggccaacatactacccaaatctgaaaaagcagcatgttgagaagatggccccttgtgccttggaaagaggttcccatccctcattggaatcaccacccattccatccaggacttctcttacacttgggggtagccggggtcaggacaatcatctcagtcctgcatcttttcttctgctttcttccctccaagagcaaaacctgggcaaggggacttactgagtgggggtgggtgggggttgggaaaagggaaacnnntgggatatggnacatggntctnagcaggantgntgagctacntancgtnttgactcnaaantnngngagcagnnnat

SEQ ID NO: 4296 - DNA, 764 bp, Homo sapiens; identical to SEQ ID NO: 503
  misc_feature 3, 4, 6, 16, 29, 30, 32, 47, 101, 660, 665, 677, 708, 711,712, 720, 746, 752, 753, 757, 763: n = A,T,C or G

SEQ ID NO: 4297 - DNA, 758 bp, Homo sapiens
  misc_feature 3, 8, 16, 19, 494, 624, 672, 702, 727, 743, 746: n = A,T,C or G
ttnttccncctttttnaancctttttgcaggatcccatcgattcggactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaatttttttttttttaaattatgcaacgtaagatgtcctccttgatagaagtcttagctcctgtgttacaagggagaactcatttgagatcagtctgttggcattgcaatgaagtgctttgtatcangaaagtgtacactattgaccttttttcctgttcacaagctgagccatatgtacataatctagattttgttttcatagttttgcactttttatagcctatttttgaagattaacacatttgcaagatgatntgactcaatctttgcctaatccaaatgagtgttaccagagagcttgcntgtgactagaacccataaaattcttaaaanggggtatgttgataatagaagggcngggaatttaaaacccnggnttttaaaaaaat

SEQ ID NO: 4298 - DNA, 748 bp, Homo sapiens
  misc_feature 2, 15, 21, 23, 430, 530, 604, 607, 740, 748: n = A,T,C or G
tntcccttgaacccnttttgntntcctgcagggatcccatcgattcgaattcggcacgagcacctttcctccagtttccaataacacattcctcttttccacctgagacctcaccagaatcacctttaatgtctatattcctaccaatagtctttttaaggcaatataggctttctctaacatgcacttcaaacttcaagatggaggggatgccatacaacaggactatgtgatggtttttggctgtgtccataggaagtcacaacaggcaagggaaagaaaccagaacccagtcatggagttaagaagtgagtcagagagtagatgggtagggacagtgaggtaaggcctctttctaaggaagtttggctgaaggatagactagctggacacatgctggctgtgtggggtagagggaggaatgatgganggtaggagagccttgagcctgcgagaagagtctctagaatagagaagctgaggttaaagttgtggaagacagtggggataactgagtgacagataatcangagaagaaaaggagatccagaatcatgaccagagagatgacctttgccaagagcacagccatctttcactgtcncanagaggtaggacaaaacgattggtgttcaagaattgggtttgtagcacaatattttaactatgtcctttaaaaaagtttctcccccagacactacccaaagccagtcctttcactacagggggccgacagaccntgaaaatn

SEQ ID NO: 4299 - DNA, 716 bp, Homo sapiens
  misc_feature 6, 8, 312, 507, 508, 571, 590, 591, 600, 602, 603, 641, 649,651, 678, 682, 695, 696, 699, 709, 712, 714, 715: n = A,T,C or G
tctcantnctaggctcttgttctttttgcaggatccctcgattcgaattcggcacgaggtattcagcttggctggagcagaggcaggagtggggaactggggacaggtgagactagaggttggcagaaaccagccatagtagtttttgcctcatttggacaacaaggagccatccaagagagagcggtgaagctgatggtgacacagccatggcgcattgaaatacccccagtggctgtgttgtagggtatattgggttggggagggacaaggtcaggaggcatagactcgacatcatctgatgtgattcangacagaatggcgagcctgaagtgaagtgtctgtaggataagttggaaaggaaggaaccaatatgagatattaaagaagtgaaagctataggtcccagtgccttaataaaggtaaggagtaagagaagattcgagattgactcccagactctccagtctgctggacatgggagatggaatagaagttgatctcggnntggtcataggagagcagttactgtgttgagcatggatagcctgtcgttccccaggagaaggantacagcttggctggaaatnngcaatgccnannttggagagatccaccttggggtcactcctagggggccnacccttgnancccttgagtagcaatccccccagaaangatncaaagggcttgannctnaactttaaanaancnnt

SEQ ID NO: 4300 - DNA, 712 bp, Homo sapiens
  misc_feature 7, 523, 618, 652, 693: n = A,T,C or G
tttacantagtagctctcgttctttttgcaggatccatcgattcgaattcggcacgagatttgcttcgagggtagtgtcttactaaaagttaggaacagagacctagtggtgtgtccaaggccgtgtcactttccccttcagcacaccccagcttctgacctcagagcccaggagctgcgtggacagtgtggggtgccaggaggaggggcggtggctggtcctcaggcacgctgcactcccagccagacatggtctttccgtttcttaagtagcaagtgtaggtttcagctggcagttccacctgcatgttctctgcttcgctgccttggaaggggccacattccccattcctcttctccttacagcgcctgcctcctttttcaagcaggcggaaagctgctgtttctcacgtttcagggagaggggtgagcggagggagacctgtgtccgtgccgtccggctccctgggtgggaacaggcaagggatcagatgcccctgacaccacgcctctggcacaccanatgcctctgcagtcctcgacagcctcttcagtgtccctcctgcggtgatgtccttactgtccccagccaaggccggggaccggtgtttcactgangacctgcattagaaacattttttaaattgttgtncaggaagagatgtgtcttaaaacagcatctttaaagctgantgtatttctttgcacaaag

SEQ ID NO: 4301 - DNA, 664 bp, Homo sapiens
  misc_feature 280, 301, 305, 373, 416, 448, 489, 496, 512, 538, 585, 589,612, 613, 643, 664: n = A,T,C or G
cacgagattttgccatgtggcaagttggtttgtggagttgggcaggtgtgaaagggtaaaactccacttctgaatgctgcttctgccccctgggacccagcacattgttagaccatcttcttgactgaaaattctctcctgatgctgagccctgcaccaccaccttccttttcctaactatgaatagatggcaaagtccactcaaaacaaccagttaagtgctcacgagagagtagtcaagcacctccagaaagaaaccgggtttttgttcacatagcangaagtgactccctgggtggtnattnatcttggaaacacaggtagattggcagaaaaacgggaacatgtaggtaccgcgatgttggtgcatgtncattactttgggataggctttctcagtctttcctcaaatgatngttgagccagttttccagggggcaattctgantgacttgcgcttgtcttatggtgtggtcaagggactttcanaactacngaaaacttttactganacagctgaaacaagagtataccggcntgagagggaagatgaacactcacctatgtaccactcttttgacaatnaatntagtatttctcaaatcaagtctnnagactgatcctgtctcaaaaaaaaagcctntagactattattgagtccgtn

SEQ ID NO: 4302 - DNA, 822 bp, Homo sapiens
  misc_feature 48, 52, 62, 90, 100, 124, 125, 141, 155, 175, 177, 181, 187,189, 195, 196, 201, 219, 221, 246, 248, 251, 253, 254, 260,271, 275, 279, 284, 292, 296, 310, 341, 353, 358, 373, 375,382, 386, 387, 395, 397, 398, 400, 401, 402, 424: n = A,T,C or G
  misc_feature 427, 431, 435, 443, 447, 463, 470, 478, 497, 506, 509, 524,529, 533, 534, 535, 539, 554, 556, 576, 578, 589, 608, 610,618, 623, 624, 647, 656, 661, 672, 675, 685, 686, 692, 693,702, 704, 720, 723, 739, 750, 754, 758, 766, 769, 770: n = A,T,C or G
  misc_feature 771, 774, 789, 793, 802, 807, 810, 821: n = A,T,C or G
atcccatcgattcgaattcggcacgagccatgggcggctgcactcccnacanatgggagtgnccagggaggacttgctcagccatggatncacaccgacngctgagggggcgcctggctacctnntgtaccatccctgtgnctacatgcttgcangaggacggatggcttactgnangaanaagccngnatgcanntctgnatgagaacacaggcagancnccctctatagaaagcctgctttggnanacntnntcatanagccgagactncacntacntcacngccttggngaanatccaactcgaggngatctatgtcttacgttcctgcaagcgcccntggagctgcccntggancagtgtgccagccancnagagtgntggnnaagccccncnnannnaccttcaatcatggacagcacnaancggntggntctgcgcnagangtgctgggtaatgagnttacgtncaaggttngtatccactagagcccgangtatcatanccnccaaccacgtaactntgggnaatnnnaatnaatccaaagatttantngaaactttaattgcgaccantngtaagacaccntggtaaattttagcccaancnaatgaacncctcnngtctttgcaattaaaataaaatnactggcggntttanctgccccccanttngccatttctnnttttannaaaacaggncngttttccaaccatttncgnccctttttcttaaatngttgccttggnccgnattnttaaaaantcnnnatnctaaaatagcccganaagncttttggancaacnttntaaccttgggng

SEQ ID NO: 4303 - DNA, 715 bp, Homo sapiens
  misc_feature 3, 9, 16, 21, 23, 384, 640, 680, 681, 690, 691, 707, 708: n = A,T,C or G
ggntcttcnaatgctnggctntngttctttttgcaggatccctcgattcgaattcggcacgaggtcacctccactagagggggataaaaaggataataggaaatcagaatattttgatttgtagttcaactgttgatcaattatctttgagacttttaacattcatgactaaggaggattaataattaacatgagctgtagaattaaggtttgtatggcatgataagtataaaccagttttgggaccgctataattctaaaaaagcaggtagactagatgattagttgtacacttattactgctaattcttgattgtagaacaaattttcctatgaaaaccatgttgtgtattttatatctctattagttcgttaaaagtttancagttttagatgtcgaaccagtaaaaaacaagttgcccattctatcattttttttattgtggtaaaatatatttaagataaaatttacgattttaaccatcttaagtgtacattggtacagtggcattggttacgttcacaatgttgtacaactgtcatccctatctatttccaaagctttttcatcacccaaacagctctatacccactaacaacaactccacatcacccactccccagccctggttatctctgntctactttctgcctctatgaattcggatattccagttggnncatataagnnggactcatataatatnngcccttt

SEQ ID NO: 4304 - DNA, 749 bp, Homo sapiens
  misc_feature 638, 744, 748, 749: n = A,T,C or G
tcttttctaatgcttggctctcgttctttctgcaggatcccatcgattcgtcaccatgttgcccaggctagtcttgaactcctgggctcgaatgatcctcccaccttggcctcccaaagtgctgggattataggcgtaagccactgtgtctggcctagtgtatgattatgcatgagtcacgcaatgttctggtcctggattccaggagtagaggacctagctttaaatcaattagtttcagctaaactgactagaaccaggtcaaagtgtaattctccctccagctcccccaaaactagagttggggggaactggagggagcaaaacactgatttgatactagtcagtttgcttgaaactagttcacctaaagctagatctcttaaaaccaatttactgaaaacttgtttgcttaaagttaatgacttaatgactaatttgccaaaagctcaattcctattttggtgtgtttatatccatttaggtgtcctattcttttttgtcatgctttggatatttcaaggatttatatctattcatccaagagtacttctgagctattatcagcaacataaatttatcaaatttgcagcactttgtaaaatgatgagaatgcttcctacctttatggatgtctntttctatggtatctaccattcaaaaacttttttaaaaagtttaaaagttctagcaataaaatccaattggtacagacattttgggtatcattttttggttcttaanccann

SEQ ID NO: 4305 - DNA, 935 bp, Homo sapiens
  misc_feature 3, 19, 24, 29, 34, 39, 40, 41, 44, 48, 54, 56, 58, 61, 62,183, 195, 242, 273, 374, 379, 395, 398, 399, 403, 414, 426,434, 446, 448, 449, 455, 459, 465, 473, 479, 497, 498, 504,512, 513, 520, 522, 523, 527, 534, 535, 544, 557, 560: n = A,T,C or G
  misc_feature 563, 565, 573, 578, 580, 584, 586, 593, 598, 599, 619, 625,627, 630, 636, 639, 640, 659, 660, 664, 666, 671, 676, 680,682, 687, 690, 697, 707, 708, 714, 718, 725, 735, 739, 745,746, 747, 749, 751, 758, 767, 769, 773, 780, 791, 799: n = A,T,C or G
  misc_feature 804, 813, 818, 823, 831, 836, 839, 843, 867, 869, 887, 895,896, 899, 901, 925, 926, 929, 930, 934: n = A,T,C or G
ccntcatcctttttacagnttttnaactntttcngcagnnnccncgantccgcnantncanntggggaacatcttcttgtctgctggacacctgatttgggcccggttctctgccattcctttctgcaattacatgggtttcccagctgttttgcgcggccttggagcacccacagaggcggnccctgctggcangctatgccctgggtgtgggactcttcctgcttctgctccagcccctnacggaccccaagctctacggcagccttcccntttgtgtgcttttggagcgggcaggggactcagaggctcccctgtgctcctgacctatgctcctggatacgctatgaactctcaccggctccccagccctncccancaaggggtactgccanggnnaagnggcttggcctngggtccccccanaatctcanggaatttattgnanngggganttgnaagccngaagctantctacnttccccaggggacccaannagcaanagtaagcnncattttncnnaaangggtgcnnccccccttntattgaaaagggngtngtntntatccaangccancnttgntnatcttgnacggnngaccaacggcgccctatgtntcccangnaancctcancannaccttctactttttactcnnactntnttccnacctncttntncttcnatnctttaantttccctctnnccattnctcnaaaatanaccttctttncagnggcttnnntntnacatcanttaaataancncttntttcctnaaatacatccnaaacatcnaaccnaaccttatnccctncgggnctttttcnacacntanttgncacttctctatatgcgaactacananttaaccatttttggacanatctcggnngananttatttctataatccacactaatnncanntacnt

SEQ ID NO: 4306 - DNA, 750 bp, Homo sapiens
  misc_feature 1, 15, 21, 91, 93, 100, 638, 700, 722, 729, 735, 750: n = A,T,C or G
nttttgtatactttncccttntctcaggcctttttgcaggatccctcgattcgccacgactcatttgtttcattcacattcctcacgtgcntnaacatanttatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacataggtgagtctcttaacctttctgtgcctcagtttttctacctctaaaggggtgggatggttcttcaaattgtttctaaaacaccggcactttcagcagtgttctggtggcctgagatgagagcaccgtgttcagaagtgcctgggagtggcacagtggaaactccgcttgcacggaccatggagtctgctcaggaccatgctgtaggacacacagcctcatgcgctgagaaagcaaaggaagtgctgggtgtaaaagttgcatgattccatgaagctttagttttcctttttttggttttaaaagaaagggttttatatgttctattgnaaaatatggaaattaaacagggacttcaagaaagccgcacagaaagatcaccttctgatggngtgatggtgctcctgacattcnggccgangtctgnattctgaaaaaagan

SEQ ID NO: 4307 - DNA, 734 bp, Homo sapiens
  misc_feature 6, 9, 12, 24, 28, 36, 44, 443, 509, 544, 670, 687, 712, 733: n = A,T,C or G
gcttgnctnctnccttttcaaatngctnggctactngttctttntgcaggatcccatcgattcgaattcggcacgagagtggctggataaaaggatgtgtgggaaagaactgagttgaaattaggagttagaattttattctttggtactaaggaatcattgaagattttaaaattagggctgacataatcagatttgagtttgggaacctatagtttgggactggaggaagacaggtgccagacaccagttaaaaagctgttattttctaagcagtagacaaaggtttacactgacaatagctgtggagatagagaaaagctgcgagatttcagagttttccaaggtgtaaacaactaaattttgtgatcaaaatgataagggccatctaataagctggggaatgtgggatctgtcttggttgagttggtggattaactganattaacagagctggaggaaatgtaaaaagaaaggcaggattgttcattttgtcttttgtttgtttntggggaacagggtcaaaattttcattctgcctaangtaggttttagtctttttcaaaacattctagtaggcaagtctgtagctgaatctttggaagaaaggcaaccattagtaatattttttgaagttccctacctggttaattttttcaataaaaaactnaggttctcaggttagcnagaatcatggtcttaggaagggtancttgtaagacccaaaattatnt

SEQ ID NO: 4308 - DNA, 789 bp, Homo sapiens; identical to SEQ ID NO: 4282
  misc_feature 2, 3, 6, 26, 27, 32, 41, 108, 121, 166, 190, 237, 276, 323,326, 337, 386, 411, 418, 419, 423, 436, 476, 491, 514, 516,525, 527, 536, 545, 546, 561, 567, 586, 600, 607, 609, 618,633, 641, 642, 644, 645, 646, 663, 668, 671, 677, 687: n = A,T,C or G
  misc_feature 688, 701, 707, 717, 718, 719, 724, 737, 738, 740, 741, 742,745, 746, 765, 766, 768, 773, 779, 787: n = A,T,C or G

SEQ ID NO: 4309 - DNA, 757 bp, Homo sapiens
  misc_feature 3, 9, 25, 32, 33, 103, 138, 509, 523, 548, 622, 625, 648,652, 674, 675, 679, 687, 688, 692, 694, 701, 703, 709, 713,714, 715, 718, 722, 727, 736, 737, 739, 743, 752, 754, 755: n = A,T,C or G
ttncctccncttaatccattccttnagccttnntgcagatcccatcgattcgcttttctggagggagacacccatctcctgcccttggacatcaggacttttngttcttcggcctttggactcaggcttgccacagangcctcccagggctctcggccagtcagcctcagaatgagagttacaccactggcttccttggttcaaccaccttcttacctggactgagcctcacttacagcttctctaggtctccagcttgcagacagcctatgggaggacttctcagcctccataagtgtgtgggccagttcgcctaataaatcccctctcctggccgggcgcggtagctctcccctgtaatctcagcattttgggaggcagaggtaggtggatcacctgaggtcaggagttcaagaccagcctggccaacatggtgagacccccgtctctactaaaagtacaaaaagtaactgggtgtggtgctgggtgcctgtaatcccagctactcnggaggctgaagcangagaatacttcgacctgggaggtanaggttgcagtgagcccgagatcgagccactgcactccagcctgggtgacagggcaagactctgtctcaaacaanatnaaaatccctctccaaaaaaaaanaccnctcccaagtttaacccattcanntccnttaccaanngaancntctattnancaaaanatcnnnccncctnccccnccacccccnngngtcnttaatcccnanncc

SEQ ID NO: 4310 - DNA, 780 bp, Homo sapiens
  misc_feature 1, 10, 17, 24, 42, 48, 433, 451, 454, 457, 485, 524, 529,545, 561, 562, 572, 574, 583, 615, 632, 634, 667, 681, 699,702, 709, 726, 737, 739, 745, 746, 761, 771, 776, 779: n = A,T,C or G
ntttcttttnttttccnaacaccnagcctacttggttctttntgccangatccccattcgattcgtgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttanaagaatggggccacatancancanaggactgttgtaagggagggaggggtanggacagaagctagacccaatctcctttgggatgtgggcnggganggaaacacgcttgganggttaatttacccacnnaatgtgatantnatagggganggaagctgctgtgggtttaactcctgggttgncttgttgggtagacagntnggggaaaaaggccccttgaattcattgtaagcncaagtcccaacttngcccctgactccctgccnggnggtattnggggaaactttttgacncaaaaccatcngnttgctnnctggaccttttgcangcccctttanccccnttnt

SEQ ID NO: 4311 - DNA, 741 bp, Homo sapiens
  misc_feature 5, 12, 513, 581, 712, 718, 731, 741: n = A,T,C or G
caacngctctgntctttttgcaggatccctcgattcgaattcggcacgagaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctnccaaacctcaagacaagaagagcatgggactcccaccaaggatcggttcccttgcttctggaaatgtncggtctttaccatcacagcagatggtgaatcgactctcaataccaaaagcctaacttaaattctacaggagtcaacatggatgtcccagtgttctgtataaaatgcaaaataaatggtttttattaaccanacaaanaaaaaaaaaaacntcgagccctn

SEQ ID NO: 4312 - DNA, 741 bp, Homo sapiens; identical to SEQ ID NO: 4311
  misc_feature 5, 12, 513, 581, 712, 718, 731, 741: n = A,T,C or G

SEQ ID NO: 4313 - DNA, 860 bp, Homo sapiens
  misc_feature 309, 350, 462, 465, 473, 476, 493, 495, 502, 511, 513, 532,533, 534, 544, 551, 563, 564, 565, 568, 571, 574, 576, 577,584, 587, 590, 600, 605, 608, 609, 612, 614, 621, 622, 631,632, 646, 648, 655, 656, 660, 661, 666, 673, 675, 680: n = A,T,C or G
  misc_feature 684, 688, 701, 710, 713, 724, 732, 740, 746, 752, 755, 774,778, 783, 786, 787, 799, 802, 805, 807, 809, 812, 813, 815,821, 823, 828, 835, 836, 842, 845, 850, 854, 856, 857: n = A,T,C or G
ggaactggctcaggctggattactcttgctgctgtcttgctgtactgtatgccactgggatctgaacactaaacattgctaagaaacccacccaccaccaggatatttggaagtaacttcacatatggaaaagttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatganagagaaaaaaatctggatgacaaagcatatcgtaatatcanggaactggaaaattatgctgaaaacacacagagctctcttctttacttaacactagaaatattgggtataaaggatctttcatgccacatcatgcttgcacgtcattattgnaanaagccccnaangcatttgtccacctgcntngaagcgncaacacccntnttccttggggaagcctttnnncaaaaaggcngttcccntttctccatggnnnttnttntcncnntggcctnccnttnggccgatttncactnacnnaangnaccttcnnctttctcgnnatggatatcccaangngcttttnnaccnnctcgnacccacnanctggntaantctnacatctgcacccnttctggccnccntcttcctcggntcacctanctccgganccaccnatctcnctncccattggtctctcgaggnttcnctctnttnnctctctcacatnatntantntngcnncncccttntncgttntaaatanntccatntcntctcncccngnntat

SEQ ID NO: 4314 - DNA, 1191 bp, Homo sapiens
  misc_feature 26, 28, 58, 108, 132, 196, 257, 259, 278, 285, 289, 292,295, 300, 303, 308, 316, 319, 320, 323, 324, 325, 341, 346,347, 349, 350, 353, 363, 367, 370, 372, 373, 376, 377, 379,386, 388, 389, 390, 394, 395, 396, 397, 400, 401, 404: n = A,T,C or G
  misc_feature 405, 406, 407, 408, 409, 411, 414, 417, 418, 434, 436, 437,439, 441, 445, 446, 448, 452, 453, 455, 459, 461, 465, 467,471, 480, 487, 489, 497, 510, 511, 512, 513, 514, 516, 519,527, 528, 539, 547, 548, 550, 551, 553, 554, 555, 559: n = A,T,C or G
  misc_feature 561, 563, 576, 577, 580, 587, 589, 597, 605, 607, 615, 631,634, 637, 638, 640, 643, 658, 662, 664, 665, 666, 674, 678,689, 695, 700, 713, 718, 724, 733, 735, 743, 751, 753, 758,761, 767, 768, 775, 779, 784, 785, 786, 787, 793, 794: n = A,T,C or G
  misc_feature 797, 802, 803, 808, 815, 816, 819, 829, 833, 836, 842, 844,846, 848, 851, 859, 861, 865, 867, 871, 886, 891, 893, 895,900, 904, 905, 909, 915, 918, 920, 925, 930, 932, 938, 943,944, 950, 956, 959, 960, 967, 980, 982, 995, 998, 1008: n = A,T,C or G
  misc_feature 1033, 1055, 1058, 1071, 1073, 1075, 1080, 1088, 1094, 1113,1124, 1127, 1155, 1172, 1182, 1184, 1185, 1188, 1189: n = A,T,C or G
tgttttgtttttgaaccctttttggnantcccgcaggatccccatcgattcgaattcngcacggagaagactttgggaaacacacattaaaatattctcatgcttttnaacgccagcgcaccaagtagcagnctcagcactttcaaagataaaaacaaaaatgatggccttaaacctaagcaggctgacagtgtanagcaagctgtttattactgtaagaagtgcacttaccgagatcctctttatgaaatagttangnagcacatttacagggaacnttttcancatntgncantactnttncatantacaggcnggnnaannnatcactcaatggggcntgttnncnntangctctctatnttcntcncnntanncnctgccancnnncttnnnnatnnctnnnnnntntcnctnncccccttaattcccgntnnantngcanntnctcnnanctancnatcnanatgnactcatatntttcacncnccctgccntattcatcaacannnnngntancgcatttnnctcactctatntctctctnntnncnnntttntntntcgatatctcttnnacncactacntncctctctnactctcanantactcttntctctctactcttcanacngtnntnaancctctctatctatcncacntnnnatatacancacnctctctactancacacntctcncatcagactctcntctantcacanacgatcctncnctctactnttaccgangnagtcnccntctccnnttacttnaatnccacnnnntcactnnccnatccnnctatntcgcatnnatncactcactcnttcnatncttatntntncnccntctctctntntccnantgangatacatatgtccanactcnancnttccnatcnnctcnctgctnttntncactntctcntntcaccntctannacatcntctctntcnnacgttanatacaatacgctntntacctctctattnttntctgacacanatctcctcctcaccactcactctgntcacgtatctgcgaacactacncantccgtctcacctntnanatcgnctctacantctctnactactactctctcactcntctctctacanctntcacatctctctctacctctccacgctntatacatatacctcctncactcctctnanngtnntt

SEQ ID NO: 4315 - DNA, 736 bp, Homo sapiens
  misc_feature 17, 496, 574, 660, 676, 730, 736: n = A,T,C or G
ttacctttagctcccgntctttttgcaggacccatcgattcgaattcggcacgagggctaacttgccttgttttactattgatgtttgtgtcctgtgtccttaacactttaagcagctgttctcacctaaaggctaatagttttaagtaagtttctttttctttttttaatttaaaaattaaaaaatttttaattaactttttttaaattaaaaaaaattattaattatttttaatagacaggatcttgctatgctgtccaggctggtcttgaactcctggtctcaagtgatcctcctgccttggcctcccaaagtgctggtattacaggtgtgagtcactgcacctggccaagtttattttttctgtatacatttcttcagccacttcaatcaaacatttaattaacatgctataatgaatgacttttcttactaggctaacaaatgaggcacttggaaacttactttagttacagcctcactttctttttttgngaggaaattctgtgttgacatactctttaatttctttttaccttttctgactgattttctgtaatttgggaatattgngatgactgcttattctaataatattaacatatagcattcttttagcacataaatagtttcatttgcatagtaagcgccaggctttnccatcgaattttgatnaaaataatccatgcttcatggtaccttagagatgggatattttaaggcctctanaactan

SEQ ID NO: 4316 - DNA, 750 bp, Homo sapiens; identical to SEQ ID NO: 4306
  misc_feature 1, 15, 21, 91, 93, 100, 638, 700, 722, 729, 735, 750: n = A,T,C or G

SEQ ID NO: 4317 - DNA, 847 bp, Homo sapiens
  misc_feature 8, 10, 12, 16, 17, 30, 302, 324, 360, 369, 372, 404, 474,479, 493, 504, 515, 519, 528, 536, 543, 551, 563, 577, 580,588, 591, 592, 599, 611, 612, 623, 634, 636, 643, 647, 651,652, 653, 660, 667, 669, 685, 691, 699, 704, 731, 732: n = A,T,C or G
  misc_feature 736, 738, 752, 755, 758, 767, 779, 785, 790, 798, 811, 814,815, 819, 820, 821, 822, 827, 833, 839, 846, 847: n = A,T,C or G
tcttttcnananctcnngccttctgcaggnatcccatcgattcgccacgactcatttgtttcattcacattcctcacgtgcaacaacataattatattttaagaaaatgtaactttgttacatcaaaatatgttgtctagtaaaaagttgatattcagtagaacaaggatcatgtaaataaacatctatttcacatgtacccaaaagcatttaaaaagcagaatccagggcccagagcatgagccagggaggaggatgtttttcttcttttctctatttttccctaaattgtgcaaacatangtgagtctcttaacctttctgngcctcagtttttctacctctaaaggggtgggatggntcttcaaantgnttctaaaacaccggcactttcagcagtgttcnggtggcctgagatgagagcccgtgttcagaagtgcctgggagtggcccactgggaaactccgcttgcacngaccntggagtctgctcangacctgctgtnggaccacacancctnatgcgctgngaaagcanaaggaantgctgggngtaaaagtttgncattgatttccttngangccttttnaanncctcccncttcttttttgnntttaaaaaaanaaaaaggggtntnttatcantggntccnnntttcggnaaaaaantnttgggcaaaacttttnaaaccnaggggggnccttntccacgcaaaaagccccgcacccaggnnaacngnaatttccccctttnccnggnatgggctcngtcggaaatgcngccttncctcnggaaccanttctcgggccccnaannggtnnnnggccnatttcncctggnaaaaaann

SEQ ID NO: 4318 - DNA, 847 bp, Homo sapiens; identical to SEQ ID NO: 4317
  misc_feature 8, 10, 12, 16, 17, 30, 302, 324, 360, 369, 372, 404, 474,479, 493, 504, 515, 519, 528, 536, 543, 551, 563, 577, 580,588, 591, 592, 599, 611, 612, 623, 634, 636, 643, 647, 651,652, 653, 660, 667, 669, 685, 691, 699, 704, 731, 732: n = A,T,C or G
  misc_feature 736, 738, 752, 755, 758, 767, 779, 785, 790, 798, 811, 814,815, 819, 820, 821, 822, 827, 833, 839, 846, 847: n = A,T,C or G

SEQ ID NO: 4319 - DNA, 694 bp, Homo sapiens
  misc_feature 126, 146, 344, 410, 415, 439, 456, 472, 474, 476, 477, 484,488, 494, 508, 509, 510, 528, 531, 541, 552, 555, 565, 570,575, 577, 583, 588, 594, 595, 596, 609, 617, 622, 623, 642,646, 654, 657, 666, 668, 670, 680, 684, 692, 694: n = A,T,C or G
gttacgctactggtgttcaattattagtttgtaccatttttaatttatgtcagttgatgcatctgaaaataagtgcttggagtgttcgtacccttattttttttaagattcctagaaggaatcttnggttaattcagattgagcanttaaagtttttgctatttacctttgtgcaggctggcatatgctaatttgggggtggtaaccaaccgattttatctcatgtaagcattacattttgaagactgaatatacttcacagcagatcaaacacatttatggcatgcactgacctcttcttggagcccagaactttatagagttgcctaccagggtttactgtnatggaatttatgatcttaagaaattactagttgcattatttatccctatgattcattcattcaatnaagcntttactgcataaactttacatccngcactgtagcttaagtnccccaaaaattgaatngnanntaattgngctnttcganaattgcccaacgcnnngcccaggccaccggtggnttnaccgcctgtnggtccccagcnttnctcggggaangcccnagccntnccgganccccnagttcnnnaaaatccagaccntccctggntaacnnccgtcaaaaccccggtctnttantaaaaatncanaagatttancntnggccttggtnggcncccccccncn

SEQ ID NO: 4320 - DNA, 760 bp, Homo sapiens
  misc_feature 7, 10, 19, 22, 482, 541, 598, 606, 634, 661, 691, 714, 725,726, 728, 731, 732, 733, 738, 740, 741, 746, 748, 753, 754,755: n = A,T,C or G
tcttttnttnccttttcgntcntgttctttttgcaggatcccatcgattcgttcaccatctatgtcctctggacgctggtctccttccgctaccactgccagctgtactccgagtggagaaagaccaaccagaaagttcgcctgaagatccgggaggcggacagccccgagggcccccagcattctccactggcagctggactcctgaagaaggtggcagaggagacaccagtatgaatgctgggctctccggaccctgcagcagagaggccagaggtagctggtgataccctgtcctgtggaaggacttccacttcaacacttccacttcaacagttcccgcacggcctgaacgcttcttaggccaagagacaccatgcggagcctagtctgtgatcctgtgtgaagatattttcagggtttttttttttttttgcatatggaggacaggtggacatggtcctgagctctggacggagcangcaccctgatctcattctgaggtccacatggcaccttctgggccagcagctgtggcccngtgtatcaaagggcgccccttaaagctggaacattccacaagcttcttgcgcttttntgcacccngcaggcccactttcctggcaccctcgantttatataaaaagttgccctgcgtttnaaaaaacccaccccctgaatgaattaaaanggagcccctggcttggaaaaaanaaaaacatctnncnctnnntatcncnnaaaananaaccnnnggcct

SEQ ID NO: 4321 - DNA, 762 bp, Homo sapiens
  misc_feature 2, 10, 18, 35, 421, 441, 461, 588, 591, 664, 666, 673, 677,688, 696, 702, 705, 707, 718, 723, 727, 733, 738, 762: n = A,T,C or G
tnctattttntttccaancctttgctacttgtctntttgcaggacccatcgattcgctggaaacctttaccagaaagtgacgggcaaggactgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggangggagcctccattccacggncaccgagacttatgcttcantagggactttgaaatgggggaggcagtgtggaatactgtggatgtctgtgcagagcctttgccggcactgaaggcatgcagcctgtcggcagagtgtcttaacacccagatgcctactttttactgnatngtagtttattgcccggagatgttggggcttttttttttaaataaaataatcataattaaatgttcatgaaaananaaacatnttcnaaaaaacttcnagcctctngaactntantngagtccttatnacctncatnccagancttgntaaggattccattgatgaagtttn

SEQ ID NO: 4322 - DNA, 1191 bp, Homo sapiens; identical to SEQ ID NO: 4314
  misc_feature 26, 28, 58, 108, 132, 196, 257, 259, 278, 285, 289, 292,295, 300, 303, 308, 316, 319, 320, 323, 324, 325, 341, 346,347, 349, 350, 353, 363, 367, 370, 372, 373, 376, 377, 379,386, 388, 389, 390, 394, 395, 396, 397, 400, 401, 404: n = A,T,C or G
  misc_feature 405, 406, 407, 408, 409, 411, 414, 417, 418, 434, 436, 437,439, 441, 445, 446, 448, 452, 453, 455, 459, 461, 465, 467,471, 480, 487, 489, 497, 510, 511, 512, 513, 514, 516, 519,527, 528, 539, 547, 548, 550, 551, 553, 554, 555, 559: n = A,T,C or G
  misc_feature 561, 563, 576, 577, 580, 587, 589, 597, 605, 607, 615, 631,634, 637, 638, 640, 643, 658, 662, 664, 665, 666, 674, 678,689, 695, 700, 713, 718, 724, 733, 735, 743, 751, 753, 758,761, 767, 768, 775, 779, 784, 785, 786, 787, 793, 794: n = A,T,C or G
  misc_feature 797, 802, 803, 808, 815, 816, 819, 829, 833, 836, 842, 844,846, 848, 851, 859, 861, 865, 867, 871, 886, 891, 893, 895,900, 904, 905, 909, 915, 918, 920, 925, 930, 932, 938, 943,944, 950, 956, 959, 960, 967, 980, 982, 995, 998, 1008: n = A,T,C or G
  misc_feature 1033, 1055, 1058, 1071, 1073, 1075, 1080, 1088, 1094, 1113,1124, 1127, 1155, 1172, 1182, 1184, 1185, 1188, 1189: n = A,T,C or G

SEQ ID NO: 4323 - DNA, 756 bp, Homo sapiens
  misc_feature 2, 3, 8, 9, 11, 12, 19, 22, 25, 183, 204, 216, 219, 221,238, 290, 329, 378, 403, 443, 445, 530, 543, 552, 648, 683,734, 744: n = A,T,C or G
gnntttanncnnttgaaanccnctngctacttgttctttttgcaggatcccatcgattcgaattcggcacgaggcctgccagaatggaagcatacagatctgggaccgaaatttgactgttcatcctaagttccactataaacaggctcatgactcgggcacagacactttttgcgtgacttntttcctatgatggtaaatgtnccttgcctctcntgnangtgacgattcattaaanttatgggacatccgacaatttaataaaccacttttttcagcctcgggtcttnccaccatgttcccaatgactgactgctgtttcagtccanatgataagctcatagtcactggtcatctattcaaagaggatgtggcacngcaaacttgttttctttgagcgtangactttccaaagggtgtatgaaatagacatcacagatgcnantgttgttcgctgcctgtggcatccaaagctgaccagatcatggttggaactggaaatggattggctaaagtctattacgtccccnacaagagtcagangggagcaanattatgtgtgggtaaaacccaacggaaggcaaacaagctgagactctactcaggactacatcatacccctcatgccttgcctatgttcgtgagccngccacggagtacaaggaacagctggagaaaggcanactggatccctgaatcgcataaacctgaacttctgtaccaggcccagggcntggtggccanttggaacccacg

SEQ ID NO: 4324 - DNA, 737 bp, Homo sapiens
  misc_feature 133, 139, 160, 169, 615, 665, 672, 675, 682, 690, 699, 724,731, 736: n = A,T,C or G
tacagctcttgttctttttgcaggatcccatcgattcgaattcggcacgaggaaaacatctaactaagatggtttcactggtgaattcaatcaaatatttaaggaacacataataccaaaaccataacacatncaaatntatggcccttcagattttgtncttcttttngggtcagtgttaataatacgtatctttcaaagaatatccccctttttttttggtagagataggggttttgccatgttgttggtagcaagccctaaccctgtcataaacaggccttaaataaactggccataaacaggatttctgcagcaatgggacatgctcatgatggctgtcatgcacactgcgaaaagttgttggtttactggagcagggcaaggaacacctggccccgcccggagcaaaaaactgtcaaaccacaaacgatagcaggaaaggcctgtgccttggcagcatgtttttgctgcagataatcagccagagcctgtttctctgctcctcgctgagattgctttgtttcccataaagattgcttttagctaatctacaatctatagaacaatgcttatcactgctttctgtcaataaatgtgtgggtcaagctctgnttgtggctctcagctctgaaaaaaaaaaaaaaaaaaaaaactcgagcctntaaactntgngagtcgnttacctanatccagacntgataggatccatgatgagtttggncaacccncactng

SEQ ID NO: 4325 - DNA, 760 bp, Homo sapiens
  misc_feature 8, 133, 138, 145, 153, 170, 174, 224, 252, 274, 300, 476,518, 573, 607, 623, 643, 668, 691, 694, 699, 736, 753, 756,759: n = A,T,C or G
tttgaaancccttagctcttgttctttttgcaggatcccatcgattcgaattcggcacgagattcgaacatatgcagttattccactaaatgatgaatgtgggattattgaatgggtgaacaacactgctggnttganaccctantctggccnaactattttaagaaaangggngtggtttttgaacaggaaaagaaccttcgcccggtggtatgcctccaaangcagcaactttatctggaaaactcaaangtattccgagaatttcttctgnccaggcatcctcctatttttcatgantggtttctgagaacattccctgatcctacatcatggtcagtagtagatcagcttactgccgttccactgcagtaatgtcaatggttggttatattctggggcttggagaccgtcatggtgaaaatattctctttgattctttgactggtgaatgcgtacatgtagatttcaattgncttttcaataagggagaaacctttgaaagttccagaaattgngccatttcgcctgactcataatatgggtaatggaatgggtcctatgggaacaganggtctttttcgaaaacatgtgaaagtacaatgangctgatgcctgatcancgagagcctttaatgagtgncttaaagacttttctcatgaacccnttggggaatggggtaaaccatgnaangggcnttccaaacgccccttgaatgaaacctggaaaaattgncaatgaaaaggccaaanccnttnt

SEQ ID NO: 4326 - DNA, 752 bp, Homo sapiens
  misc_feature 4, 5, 142, 161, 172, 173, 359, 371, 434, 533, 631, 640, 646,648, 655, 680, 704, 744, 752: n = A,T,C or G
tatnnatacaagctacttgttctttttgcaggatcccatcgattcgcacagttctgcatggctggggaggcctcacaatcatggtggaaggcaaggaggtgcaaaaccatgtcttcacatatgggcaaggcaggaaaaaccntgtccaggggaacctccanttattaaaccnntcaaacttcattgaagaattaatcacttaccacgagaaccagattgggggaaccattcccatgaatcaattattctgcacctggccccaaccttgacacgtgggaattattcaatgccagggtgagattgggtggggacccatccaactatgtcaagtatgttttgacttctggcttgattgctangtttgcatagangacaaacatggaaattaatgaagtaccttaatatctggcttcagatcttagacaggatcaganggccagctcaaatttgcaaggaggggaggtagatcccaccattttatgggctatggcaaaatcaaacagaaattatgtgggatgggagatctgatgcangcatctttggaaacatctacttagctaattttatgctaggctttaggtcaagaaggagagaaaaagctgcatgctgtggtacacacttattgtcccancgacttggnaaactnangcaggangattgcttgatcccaagaatttgangtaatgtgccaagaaccgtcttgngaatagccctacccctgaactcaacttgggcaacattganaaaccctn

SEQ ID NO: 4327 - DNA, 783 bp, Homo sapiens
  misc_feature 2, 3, 4, 5, 6, 9, 10, 11, 12, 13, 20, 155, 361, 413, 498,609, 651, 655, 672, 683, 738, 742, 744, 753: n = A,T,C or G
gnnnnnttnnnnnttttaancctttagctacttgttctttttgcaggatcccatcgattcgaattcggcacgagaggcgtccttgcggaaagggcattttagctgaggctttggagtacgaataggagctcagcaggcagacgaaatgaaggaantaaaggtcagaagaaaggtcagaagcttgagtgacgttttggaaatccaccccgttttatttggtagaacttgggggttcaaaagggccaggtgcctcagaatttgaggcccacacagtgaggtctggtggggttgaaagggacccaggaaccgaggcgttcaggaaagcaggttgtcagagctatgtggagtctgtgggtggcangggcaaccgctccagcctttgaagactttgaaagccagagattcctgcgcangcttggacttcctgggagctcctccaagtacccaagggcatcagagctgcctgggtgttacatggcccaaggaacccaggttcanggtaggacaggcaagaccagatcccaatgtgcaaagtgaaaacactgggctcctgttaaacgatgaagaattcaagacagtgacagcattacgtcacccctggggacaaangtcaacctaaggtgacacacggggactactgtgctttcggangctncctgtgtcctggagganaaaagctttanagggggcaactggacaacttccacttgcaaaattccaaccttgcttgggcaaggncccngnctgggactnaacatttttgatatgccttaaaaattattt

SEQ ID NO: 4328 - DNA, 733 bp, Homo sapiens
  misc_feature 5, 598, 632, 659, 665: n = A,T,C or G
tacangctcttgttctttttgcaggatcccatcgattcgaattcggcacgagggaaccatgagaaccgaagctagaattgctattgaattactttattttctcttccttattgggtagagatacatcattactggcctcaggggtttacccaaagaaagggtatttttgagcaaataatgtgatttcctggctattttgttgggggcttaagatttttttttttcaaatgcatttttagtcactaaaaattaactgtcgtaccatctagaactatactgtccagtaccatagcctctagccgtatgtagctatttgtattaagattaattgaaattttaaatccagttcctcagtcacactagccactttctaagtgctcagtagctctgtgtgaccagcggctactgtattggatattatagaaggttctttcattcaagatcatcattcttgacagacccataaatatttcctataaagactgtagaagtgtgttctggagggtttgctctccaaaaagaattgtaatatagagtagaattgggatagagtattgaagacactgggtttagacattggatattttaatgattgggnggtctaatcatgtgctgcaactgagttatctagngatatgacctcctgcttgccaaagccngaattnaagcaggattcctgaatctatcttaaaattgcaatgaaaaccttttccctaaaatatcccttttgtaa

SEQ ID NO: 4329 - DNA, 806 bp, Homo sapiens
  misc_feature 2, 3, 4, 5, 6, 7, 8, 9, 13, 14, 16, 17, 19, 52, 62, 68, 572,589, 648, 737, 758, 806: n = A,T,C or G
gnnnnnnnntttnngnntnatgaaaacccctttaatgaaaccctttttgaanccttatgaancccttngctgcaggatcccatcgattcggcagcgcaccaggtggttttaggagaaaacttgatagccacagccctttgtctttctggcagtgggtctcagtctgatttgaaggatgtgggccagcacagcaggagaggagggggacacaagccttcgggaagagcctccatccagtcactcggctctttaaggcagggtgccatactaagcagcttgcctccaggaattgctctgaagagaaatccccacaaacctccatcctaaaggaaggtaacaggggacacaagcttggatttccgacctgtagtgtctccagcaaatggggttgaaggagtcccgagtggatcaggatgatgatcaagatagctcttcctgaagctttctcagaacattgctgtcagactgactttaagacagctgattcagaggtaaacacagatcaagatattgaaaagaatttggataaaatgatgacagagagaaccctgttgaaagagcgttaccaggangtcctggacaaacagangcaagtgggagaatcagcttccaagtgcaattaaagcacttcagcaaaggagagaagangaaatgaagaatcccaggagatattaaaggctatcaggatgtgacaattaaaccgggaagaaacaaagaagaagattgagaaagagaanaaggagtttttgcaaaaggancaggactgaaagctgaaatgaaaaactttttgaaaaggccaaaggtan

SEQ ID NO: 4330 - DNA, 792 bp, Homo sapiens
  misc_feature 2, 3, 7, 9, 10, 11, 12, 13, 14, 21, 22, 168, 325, 507, 550,580, 582, 608, 622, 666, 685, 700, 730, 759, 785, 792: n = A,T,C or G
gnntttnannnnnnttttatnnatacaagctacttgttctttttgcaggatcccatcgattcgaattcggcacgaggcataacgaacctaaccctcagaggtttaccaagattcaaaacacgaaactgaccatgaaaccgggacgggcatttgggtcaagtgcgggtnccagtctttgggaaggtggtcttcgggcaacccacttctttcaaccaattttcacaagtgggaacaattggggcgggccttccgtcgtgggcccccttcgggggcttgacactaatgggacagaagctctcggtgcccgaaagattgcctgccaganggacttgaccacagcctggctggcaactgctctgtggaggacctccaggactgagactgggctctggtttccaagggtcttcactaggccccctactacacctggaagtttcagaacccactttggggggcctcctgcctgggcaggctcttcaagtgtggccctctttggagtcaaccctnctttccgacccccttcccctagcccagccccagtcactgtcanggtcgggccaacccctgcactgccttgcanantggcctgggctaggtcacttcacctntctggcctaatttncccccttgagtccctaaggcctggaaggtgggaagtatgtctanggggcaatgtctttttcanggggaattctaactnttgggaacccccttgttccaagggaagggnaacctttttcattcaacattgtaggggcnaagctttgtgcgccccctgttaggancaaaccn

SEQ ID NO: 4331 - DNA, 760 bp, Homo sapiens
  misc_feature 9, 10, 11, 12, 13, 14, 15, 16, 17, 18, 19, 20, 24, 26, 27,31, 649, 679, 680, 681, 682, 683, 684, 685, 686, 687, 688,699, 711, 719, 727, 745: n = A,T,C or G
tcccttggnnnnnnnnnnnntttnannatanagctcttgttctttttgcaggacccatcgattcgaattcggcacgaggaaaacatctaactaagatggtttcactggtgaattcaatcaaatatttaaggaacacataataccaaaaccataacacatacaaatatatggcccttcagattttgtacttctttttgtgtcagtgttaataatacgtatctttcaaagaatatccccctttttttttggtagagatagggttttgccatgttgttggtagcaagccctaaccctgtcataaacaggccttaaataaactggccataaacaggatttctgcagcaatgggacatgctcatgatggctgtcatgcacactgcgaaaagttgttggtttactggagcagggcaaggaacacctggccccgcccggagcaaaaaactgctcaaaccacaaacgatagcaggaaaggcctgtgccttggcagcatgtttttgctgcagataatcagccagagcctgtttctctgctcctcgctgagattgctttgtttcccataaagattgcttttagctaatctacaatctatagaagcaatgcttatcactggctttctgtcaataaatgtgtgggtcaagctctgtttgtnggctctcagctctgaaaaaaaaaaaaaaannnnnnnnnncctcgagcctntaaaactatagngagtcgtnttacgtanatccagacatgataaganccattggtgagtttg

SEQ ID NO: 4332 - DNA, 752 bp, Homo sapiens
  misc_feature 2, 3, 4, 6, 8, 9, 10, 11, 12, 13, 15, 17, 20, 25, 584, 634,635, 636, 657, 682, 701, 733, 747, 751, 752: n = A,T,C or G
gnnntntnnnnnntntnatngcctnaagctacttgttctttttgcagggatcccatcgattcgaattcggcacgaggtccaggcttccttctgatggccaacccacctttaatgctggccagtctatctcacacaaagttctaagttttccaggtgtcatagtaactccatagtctccttaaatccctttttgaaatttttcaacatagttcctagtgggatgggcttactttgtgcctgacccatgttttctcaagacaaaacaccatggcaggaacagccacttgcatctggtcccggtgccacactgcggtgcttggtgtggttgtggagcctgtccctgcgcgccttgctcccgttgagccacgctgtctggtgggtgattctctgcctgagccaccaccctggactggccagtctccagagctggcacaccctgctgttttctctttttagacacaacagccgcagtttggcagccactaagtcccaccagctgaggtccgaggaaagcggggtgactcatttcccttgtcagggcccgaggagagtgaggtgtccagcctgcaaagctattccagctncttggtgttggttgcaataaattggtatttaacaaacaaaaaaaaaaaannnaaaaaaaaaaaactcgacctntaaactatagtgagtcgattactanatccagacatgataagatncatgatgatttggacaacccacttgaatgccntgaaaaaatgtttntttnn

SEQ ID NO: 4333 - DNA, 761 bp, Homo sapiens; identical to SEQ ID NO: 532
  misc_feature 4, 9, 10, 11, 12, 15, 17, 18, 38, 106, 224, 670, 701, 739,755: n = A,T,C or G

SEQ ID NO: 4334 - DNA, 805 bp, Homo sapiens
  misc_feature 2, 3, 4, 5, 6, 7, 8, 9, 10, 11, 12, 13, 14, 15, 16, 25, 26,32, 35, 36, 37, 38, 39, 40, 41, 43, 44, 49, 50, 52, 53,59, 62, 64, 189, 200, 209, 212, 218, 240, 269, 619, 629,638, 750, 805: n = A,T,C or G
gnnnnnnnnnnnnnnnttttgaaanncctttnttnnnnnnngnntttanncnnttgaanacnanagctacttgttctttttgcagatcccatcgattcgaattcggcacgaggcaaggcgccgggggacacgttggctgcgttttcggcgggcttccgggtcaaaaatggctggggcttgcgaattctnctgggctactncgtaggcanaanggccantttgggccccgaagttctgggngtcgaaattcggccggacgggaagcttangatatccaccaccacaaattccaaaaatgatgtgatgatcagaaaaagaagcttatgtgcccaagaatgtaatgggaaagaactgaagagaattattgatgacagtgaaattacaaaagaagatgatgctttgtggcctcccctgataggggttggcccgacaggagcttgaaattgtaattggagatgagcacatatcttttaccacatcaaaaataggttctcttattgatgtaaatcagtcaaaggatcctgaagccttcgagtattttactatttggtcaagacttgaaatgtttagttttcaatcttattggattacacttcaagattaaaccaatttaaattgnatgttttcangctggttgnatatttaattaagggatgggaagggttatttggcatttacagtattggggtttttatgaatgtgaagcaaacaaaaaaaatttgtatgtaaactggaaattaggaaaatccnttaccaagcttaatgggtatccttacttgagtccacatgggttggcagtccccan

SEQ ID NO: 4335 - DNA, 805 bp, Homo sapiens
  misc_feature 2, 3, 10, 13, 19, 21, 22, 23, 25, 185, 207, 225, 229, 331,335, 510, 590, 642, 676, 687, 716, 790, 791, 792, 799: n = A,T,C or G
gnntttaaanccntttttntnnnanacaggctacttgttctttttgcaggatcccatcgattcgaattcggcacgaggcctgggaaagcgtggcgcccatgaatatccgcaggagcacgcatgacctggtgggccatggacgggatgggttgtaccccgtggggggtaaacgaacgggtagcttncaaccttcaacttccattcgangaaagtacaaaccccganggancaacaaagtggggtgggccgcattcctggcattgtttcaacccgggcgcaagcaagtgtggggttgtgggcgggtgcttggaagctgcttcaatttccccgnccgncatccttccccgacgcttgtcccgtggccctccaccaagcctcttgacccacctaccaccagaagccttgcagccttccacatgccttaagggggaccgtggcccccaccaggggacgtcctgcgccatccgttcacgtctcttgcatcattccttcatgtctttatttagttgnttatttatttaagttatttatcttattgagaggtgaggagtgccacggctgcccgtttacacctttagcgtctggtcctnctgcgtgtcctcccttcactggctgcatggggggcccggggagtgacaagcnggggccttaccggcccaaggcccgttgcctgctnaaaccttgcangctgtggagcaagaggcctgggtctttcnaacactgcagacccacttgaatttgcacatgcggggtcccgggaaggtggggaacaagtgtccttctgtcgtcnnnttgccgngtgcca

SEQ ID NO: 4336 - DNA, 795 bp, Homo sapiens
  misc_feature 8, 10, 11, 12, 15, 20, 22, 25, 26, 31, 33, 89, 182, 189,199, 201, 220, 225, 230, 232, 248, 280, 579, 586, 639, 644,650, 655, 684, 701, 738, 739, 768, 779, 789: n = A,T,C or G
ggctactngnnngtntttgnangcnnttttnantatacagctacttgttctttttgcaggatcccatcgattcgaattcggcacgaggnaatgacattcatgccagttcttccctgaatggcagaagcactgaagaagtaaagcccattggtgaaaacctggggccaaactgggaaatctgntggttgncttcccccangntttaaaggagatcaatgtngaaanggtancnggattcaacatttggncaagccgattcaagaacagtgaaagttattgnggatcttatgggaccaatttgggccaagaagaagtcttttagacagctttacgtccaacaatgggacccatttcaagtattacttgggtgggcattccagtcaacccatggaaaattctggatttcgtgaagatattcaagtacctcctggaaatggcaacattgggaatatgcaggtggttgcagttgaaggaaaaggtgaagtcaagcatggaggagaagatggcaggaataacagcggagcaccacaccgggagaaccaggcggagaaactgacgaattctctaatgttagaagangaaagangacataggatgcaacactttgagcgaaggaaccaaggcccggcaggtgggaantggangtgatngggancccttgggcttcgaccagaaggtcccgangcagcctcaatgaccanatcgcctcgtgctgatgaaactgcaggaggacatgcnnaatgtcctttaaagactgcagaaactggnaaccctactgnttttcaggcnaaaaaa

SEQ ID NO: 4337 - DNA, 734 bp, Homo sapiens; identical to SEQ ID NO: 4307
  misc_feature 6, 9, 12, 24, 28, 36, 44, 443, 509, 544, 670, 687, 712, 733: n = A,T,C or G

SEQ ID NO: 4338 - DNA, 766 bp, Homo sapiens
  misc_feature 2, 3, 4, 7, 9, 10, 11, 12, 13, 14, 20, 21, 22, 23, 655, 666,682, 715, 759, 766: n = A,T,C or G
gnnnttnannnnnnttttannnnatacaggctacttgttctttttgcaggatcccatcgattcgaattcggcacgagcaccatcgaatatttttatttattttgagagacagactctgtcacccaggctagtcttaaactgttgggtgaatcttaagtgattctcccacctcagcctcccaaagtgctggggattacagggcatgagccactacccttggctgtgatcaagtattttagtctgttggttaaatgtttactaaatagtctgaagtagagaaaatagcacccaatctaaaataaggtgaggtctagtcacttatttaaatctacattttaagctatagtttactattagtttaaactttaagacaggtaatgttcatgctgcagacaatctaagggcattattaaaatgtttgttcttccttatctcagaattgaagtatgtcagaagcaagacttttctttccattttgttatagtagaaatgcatacattaacaggtacgttttagacattacacgtgctcatctgcccaaaagctctaatgagctgccttaccctggaatgtttttcttagcttggatttgcttttttggagggattaagaaaagacttggctgggcgttgggactcatgcctgtaatccacantttgggaaccnagcggtggatcatgangtcaggagatggagaccatccggctaatacggngaacccccgtttttactgaaaatccaaaaattactgggcgtggnggcggcn

SEQ ID NO: 4339 - DNA, 872 bp, Homo sapiens
  misc_feature 1, 5, 7, 11, 21, 25, 27, 35, 41, 69, 73, 82, 87, 109, 148,153, 161, 178, 182, 225, 228, 235, 237, 247, 311, 316, 326,342, 352, 368, 808, 816, 833: n = A,T,C or G
nttanantttnaaaaaccccncttntnttggcctnaccttncggttttctttttttttgggccaggggnaatnccccccatnccggnatttcccggaaaatttccgggnccaccggaagccctgggggaaaaaatgggaaaaaatttnatttnattttttncaaccccccatttaggnttangcccaaatttaaaaaaaaaggaaaattaccttccaagttaaantanccgttantnggggaaatancttacctttaagttccaataaaaaaaagggggaaatggaaaaataaatggggcatttttggcangcaanccctggggantgggaaaactggggangaaccattanttcttaaaagtggaangtaaccttcaagggaaaatgggaaaaaccaaaccggtcggtggtggttcttcactctttaaagtggggaagctaaagcttgtggagggacccaaagggcctaagaaatgatacaatgggactttggagactcaggggaaagggtggggagggcggtgagggataaaacagtgccactgggtcagtgtcactgcttggtgatggctgtccaaaatctcagaaatcaccctaaagacttattcatgtgccaacctcctgtcccaaacctttaaaaaaaatgcgccatccccccatggaaataaagtcaacagcctgcagagcaaaaagactggttagtaacttaaaatattccaaaagagactcctcatgcctactagttcactctgaatctatcaaacacgtaaaggaatttggttcacaccaccaccacccccaatcttnacaatctntgagaaacagagaaganggaattccaactccttgtgaggcagcttccctgtccatg

SEQ ID NO: 4340 - DNA, 710 bp, Homo sapiens; identical to SEQ ID NO: 4145
  misc_feature 2, 6, 10, 13, 15, 16, 19, 47, 48, 51, 58, 60, 63, 67, 74,468, 558, 597, 671, 707: n = A,T,C or G

SEQ ID NO: 4341 - DNA, 749 bp, Homo sapiens; identical to SEQ ID NO: 4242
  misc_feature 1, 2, 4, 5, 6, 7, 8, 10, 16, 21, 507, 571, 623, 659, 663,664, 665, 666, 667, 668, 669, 670, 671, 672, 673, 674, 675,676, 677, 678, 679, 680, 681, 682, 683, 684, 685, 686, 687,688, 689, 690, 691, 692, 693, 694, 695, 696, 697, 698: n = A,T,C or G
  misc_feature 699, 700, 729, 730, 732, 733, 738, 739, 748, 749: n = A,T,C or G

SEQ ID NO: 4342 - DNA, 782 bp, Homo sapiens
  misc_feature 2, 3, 4, 5, 6, 7, 8, 9, 10, 11, 12, 13, 14, 15, 16, 20, 21,23, 24, 25, 26, 27, 28, 29, 30, 32, 33, 36, 37, 38, 39,40, 41, 42, 43, 44, 45, 50, 681, 770, 772: n = A,T,C or G
gnnnnnnnnnnnnnnntttnnannnnnnnntnnttnnnnnnnnnnttttnaaaaacagctcttgttctttttgcaggatcccatcgattcgagactactgactctacgcttaaaaattattaagatggcaaatttcatcttgtttttttttaacttaaaaaaactacatataagatagttttgcctgttttcaggtttcttttcagtgttttaggtattcagtatttaaatcacaaaatttgtgatttgaacatttttttcttccttcatgagattttaagtggattgatacttgctttccattctgtcccgatgtctgacctttgtaatgtaaagaagaacattttgtttaattgagagaagtctgctgtgttcttgttgatagaggaccatcctagagttgggagtgctgtctgcacagcaacaaacccagagtctactttggatcaccttatatagttcatgagtaatcagcagatgcctttcctttctatgtctctctctcagtgaaaggcactgtttcttccacttggtgaggaatggcctaatgctcattgtctgtaacaggaatgctacaactgctcaaattgtaccatttatcatatttggtaaggtcttgccttagtcttgcctgttcaattataaaaggaaagaagacgtaaaagatgtagagttgtctgngtgattttccccccattatgtcagaagaggccttaagaaaactaataccccccacaaatatatctttttagatttctattatatatttngncttatcaaga

SEQ ID NO: 4343 - DNA, 736 bp, Homo sapiens
  misc_feature 127, 136, 660, 665, 677, 681, 709, 730: n = A,T,C or G
atacagctcttgttctttttgcaggatcccatcgattcgaattcggcacgaggttgctttcaaaagacacatatcaccatagtacatgtaataacacacataggctcaaagtaaaggggtggcgaangatctgttntgcagatggaaaaaaagatcaggggtcactattcttgtttcagataaaacagactttttaaatcaacaacagtagaaaaaggactagggcattacataatgaagaagggttcaattcaacaagatttatcctatcacacccaagattggagcactcagatttctaaactattatttctagacctaggaaaagaattaaacggccacataataatagtgggggacttcaacacctcactgacagtgttagatagatcatcaaggcagaaaactaacaaattctgaacttaaattcaacagttgactaattgaacctaatagacatctacagaatactccacccaccaacaacagaacatacttttttctcatgtgcacatagaaaatactctaagattgaccacatgctttgtcacaaagcaaatctcagtaaattcaaaaaagattgaaatcataccaagcatttcagactacagcatagtaaaaatgaaaatcaacacccaggagaaactctcaaaacatggnaactnaacaacttgctnctgnatgactttttgggtaaatataaaaatanggcttccttaaccctttttgnaacaat

SEQ ID NO: 4344 - DNA, 752 bp, Homo sapiens
  misc_feature 2, 3, 6, 7, 8, 9, 10, 11, 12, 13, 14, 15, 16, 21, 23, 24,27, 187, 688, 742, 744: n = A,T,C or G
gnnttnnnnnnnnnnnttttnanntantgctcttgttctttttgcaggatcccatcgattcgaattcggcacgaggtcaactctccttggtgagtgcctcagaacttaggaaaagagaacagcgcatgtctctctcatgaagatgacagaggacaaaagcaagcagaaatatacaaggatttgcgtnctctattatgaatttctctttgagaaataatacctgtgagaatgctgctccttcaattaggttcaggattggaggaaaaatcatataaaataggttcctgcaataatattgccccttgagtatgggtgggcttgtgacctgctcagtgctaaggaaatgcagtggaaatgatgctgtgtaacttctgaggccaagttataaaagatcatgcatcttttgccttgttagtttgctgacgcctgatatggagcactagaaagaaattatttttccaagcatcaacccggaagtcccagcataccgagggtggcagacatcatttcttcaatgaacttagtatttagaaagatatcttcactccaagcatcaagtcttttctgtcctgcaaaagtcttaagtcaaaccagaatccctagtagagggcacctttggattcaacagtaaaaggagaatctacaaaaccagctcatcaaaaggggcagtgatgggtatagaacctgncttacttaagttcaagcaatgattaatctagcttccctctggtggatgactgangnctttgcct

SEQ ID NO: 4345 - DNA, 752 bp, Homo sapiens; identical to SEQ ID NO: 4344
  misc_feature 2, 3, 6, 7, 8, 9, 10, 11, 12, 13, 14, 15, 16, 21, 23, 24,27, 187, 688, 742, 744: n = A,T,C or G

SEQ ID NO: 4346 - DNA, 737 bp, Homo sapiens; identical to SEQ ID NO: 4324
  misc_feature 133, 139, 160, 169, 615, 665, 672, 675, 682, 690, 699, 724,731, 736: n = A,T,C or G

SEQ ID NO: 4347 - DNA, 738 bp, Homo sapiens
  misc_feature 2, 5, 9, 624, 634, 718, 727: n = A,T,C or G
tnaanatcntgctacttgttctttttgcaggatcccatcgattcgcgtccgctctcattggctctgctggtccagaaagcagcccaggcctttaactccgggctgctgtgtgtggcatgtggttcataccgacggggaaaggcgacctgtggtgatgtcgacgtgctcatcactcacccagatggctggtcccaccggggtatcttcagccgcctccttgacagtcttcggcaggaagggttcctcacagatgacttggtgagccaagaggagaatggtcagcaacagaagtacttgggggtgtgccggctcccagggccagggcggcggcaccggcgcctggacatcatcgtggtgccctatagcgagtttgcctgtgccctgctctacttcaccggctctgcacacttcaaccgctccatgcgagccctggccaaaaccaagggcatgagtctgtcagaacatgccctcagcactgctgtggtccggaacacccatggctgcaaggtggggcctggccgagtgctgccactcccactgagaaggatgtcttcaggctcttaggcctcccctaccgagaacctgctgagcgggactggtgacccatggcttgggggtgctgangaaagcccanttggactggctaccccttctggccacccagtacttccttcagccttaactgggtgaacttgccggttcaaccaccaactttctnagcgagcangggccaaggct

SEQ ID NO: 4348 - DNA, 760 bp, Homo sapiens; identical to SEQ ID NO: 4331
  misc_feature 9, 10, 11, 12, 13, 14, 15, 16, 17, 18, 19, 20, 24, 26, 27,31, 649, 679, 680, 681, 682, 683, 684, 685, 686, 687, 688,699, 711, 719, 727, 745: n = A,T,C or G

SEQ ID NO: 4349 - DNA, 766 bp, Homo sapiens
  misc_feature 2, 3, 4, 7, 8, 9, 10, 11, 12, 13, 14, 15, 16, 17, 22, 27,687, 766: n = A,T,C or G
gnnnttnnnnnnnnnnnttttntaganacaggctacttgttctttttgcaggatcccatcgattcgaattcggcacgagcagagacctgacagtggcaatgtatggccacgttactgaatctacatgttgcaagagaaaaactagcagatgttctttggcagccctgtcattcagctattattgctaaagcactaggtgggaatcattatgaaaatttccatcctcaaatagaaaggagatttgacatatcctcttctcttgctggtttaattgatgggaagctttgaaattggaaatttgcttgtgattgtatttgtaagttactttggatctaaactacacagaccgaagttaattggaattgggttgtctccttatgggaactggaagtattttgacagctttaccacatttcttcatgggatattataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtacccattgggggatttcatacattgatgattttgcaaaagaaggacattcttncttgtatttaggtagtttgaatgcaataaggaatgattggtccagtcattggctttgcactgggatctctggttgctan

SEQ ID NO: 4350 - DNA, 735 bp, Homo sapiens; identical to SEQ ID NO: 535
  misc_feature 2, 5, 6, 8, 662, 722, 727, 730, 735: n = A,T,C or G

SEQ ID NO: 4351 - DNA, 735 bp, Homo sapiens; identical to SEQ ID NO: 534
  misc_feature 1, 4, 6, 15, 158, 160, 165, 167, 623, 668, 670, 688, 709,720, 723, 727, 733: n = A,T,C or G

SEQ ID NO: 4352 - DNA, 735 bp, Homo sapiens; identical to SEQ ID NO: 533
  misc_feature 9, 396, 667, 682, 684, 691, 697, 716: n = A,T,C or G

SEQ ID NO: 4353 - DNA, 756 bp, Homo sapiens
  misc_feature 2, 6, 7, 8, 9, 10, 12, 16, 18, 19, 20, 21, 22, 23, 24, 25,26, 37, 357, 657, 698, 715, 722, 753: n = A,T,C or G
tnaaannnnntngctncnnnnnnnnnttttaaacaanagctcttgttctttttgcaggatcccatcgattcgaattcggcacgagggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaactgtgggtctaccaatctagacaactcantggcaagcattgaggcaaaggctaatgtgtgctgtgttaaatcagcccctcttccagatccatttggctttcggctgtgcagatcactgtgtccctactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctgcttncaatggagattatatagcttgtggaagtgaaaataactctntttcctgtcctataaangactttntaagactttgctacttttaagttgatacagncaa

SEQ ID NO: 4354 - DNA, 751 bp, Homo sapiens
  misc_feature 2, 4, 5, 112, 125, 137, 145, 148, 150, 151, 153, 158, 165,171, 174, 178, 182, 184, 199, 210, 215, 261, 340, 347, 420,444, 541, 663, 674, 735: n = A,T,C or G
tntnnatcttgctacttgttctttttgcaggatcccatcgattcgaattcggcacgagaagtagaggaggaaagttcagacaatttcataagtgtctaaaaagagacagttntgcgaccattggncgaggagtaaangtcgcttnttngnncntttanttcactncaaatnganaaangaantnccagtttcctgacangcccaacccantgctnggccagttcctgagtccacttaatatatttaagaggaaaagatctnggaccacaggagaatggcgtggattgacctaccagattatgaccatgtagaagatgaactttttcctcctttccacctncagcctntccagagagacaagatggtgaaggaactgagcctgatgaagagtcagggaaatggacacctgttcctgtcctncaaagagaacagttaaaagaaatntcccaagctggatgctcagagattaatttcagagagaggacttccagccttaaggcatgtatttgataaggcaaaattcaaaggtaaaggtcatgangctgaagacttgaagatgctaatcagacacatggagcactgggcacataggctattccctaaactgcagtttgaggattttattgacagagttgaatcctgggaagtaaaaaggaagttcanatgaagttgcngagaatatgacatgaggccttctactgaatagatcctttctgacaacttattgaaagtganatgttgcttctgagta

SEQ ID NO: 4355 - DNA, 736 bp, Homo sapiens
  misc_feature 529, 560, 673, 707, 736: n = A,T,C or G
tacaggctacttgttctttttgcaggatcccatcgattcgatcacaggggaatgttagaagtgttttattaatttctttgtcagacaagtgtttaggaaactctcactccaggcctaatgctgtgctaggctctgcaaatgctaagagggggaagttactgtccctgcttccaaggagatcatgggtctagtgggaaacccgacacgttcaggtaccttcagatgggcactcagaagagtaagcccttagttaatgtttaaagatgtttaaagatgtctgagactcataggtcaaagtcagatttcagttccaccttattagacctgcactgctaaggagctgctttaggtaaggctgtgttcctagtcaccagggtgttcaaacacagtgctgggggcaatgtgggaatagccttcttttatttaggaagtaatgtgaagtcagtttcatgaatagatcttactttaagcattcattgagggttttggcaagaatagagtaccgtatatgaaggtgtttcctaatctncctgcaccaggaataatctagggctcattanagatgtcaaagatctggtctagtttcttaacctaaaacaagagtgttttaattccattttataggcggggagtctgagccaaacatgttatgtcacttttccaagcttcatancacaaaagtcttctgtcttcccatcctgactttnccacttcatagggactgtcaaaggcagcn

SEQ ID NO: 4356 - DNA, 772 bp, Homo sapiens
  misc_feature 2, 3, 4, 8, 9, 14, 15, 16, 17, 18, 20, 22, 25, 30, 113, 393,476, 530, 597, 612, 623, 640, 717, 743, 772: n = A,T,C or G
gnnntttnnttttnnnnntnanagnaaaanctttttgctacttgctctttttgcaggatcccatcgattcgaattcggcacgaggagaagctgacgggcatgtggtggaaacngctggtggcccggcgcagtggcaggtgcccgtgtcacggacaggcacggcccctctggaccgcttaaaggtcttcatgcaggtccatgcctcaaagaccaaccggctgaacatccttggggggcttcgaagcatggtccttgagggaggcatccgctccctgtggcgcggcaatggtattaatgtactcaagattgccccgagtcaactatcaagttcatggcctatgaacagatcaagagggccatctggggcagcaggagacactgcatgtgcaggancgcttcgtggctggcttcctggctggtgccacaacccaaaccatcatttaccctatggaggtgctgaagacccgctgaccttncgccggacgggccaatataaggggctgctggactgcgccaggcgtattctgganagggaagggcccgtgccttctaccgcggtacctcccaacgtgctgggcatcatccctatgcggcatngacctggccgctacnagactctgaanaactggtggcttaacantacaagccacgactcggaaaaccaagcattctctgcttctggctgcggaccatatcaacactgcggcaaatagccanttacccgttggccttgtccggacccnatcagccaaccgtggtattccataacaan

SEQ ID NO: 4357 - DNA, 778 bp, Homo sapiens
  misc_feature 3, 4, 5, 6, 7, 8, 9, 14, 15, 18, 20, 21, 23, 35, 48, 49,104, 115, 229, 481, 527, 567, 692, 755, 767, 773, 774: n = A,T,C or G
agnnnnnnnttttnngcnanngnaaactttttaangaagctttaatanncctttctctggatccctcgaggcgaattcggcacgagctacacagttcccattcnttaccttaacnttgtactgagagagacccaggtctgacctgtatagcagtttgagtcgaggggctgtcaaaggggttgccaaagtcatctaaaggacttggcaccagaagtagcattatgacttnggatccacttctttatagaccaatattggcagccatgaagctgcttgtcctgggtgcggaattcagttttagtggctgaatgcacagacagcaggaagagagaataggggacaatgaacaacagagagagaagaaatgcagtgtgtagggaacctgcaggtggtaacagttgaaactcatatcaatgatcttgcctatttaccactccatgtgcctactctggctgtctaatccagcagtaaccagtattgnattctagggccttccccaaattggagctacccccagaatttctcangcttttaattcctgaaaatcttttaaactaaaacttctangtcagttgtccccaggggaactgaggctgtttctacctgctgcattgtcagcaaaacttgctacatgctaattattccactttcagtgaagcaatcaatgagtgacagtaggaaataactttganagttggttggttcctaacatggcctcttaataatggaaatgagaccaaattggggacctaatnttgccaaggaanaatggnnaggt

SEQ ID NO: 4358 - DNA, 778 bp, Homo sapiens; identical to SEQ ID NO: 4357
  misc_feature 3, 4, 5, 6, 7, 8, 9, 14, 15, 18, 20, 21, 23, 35, 48, 49,104, 115, 229, 481, 527, 567, 692, 755, 767, 773, 774: n = A,T,C or G

SEQ ID NO: 4359 - DNA, 784 bp, Homo sapiens
  misc_feature 2, 3, 8, 10, 11, 12, 13, 14, 15, 16, 17, 18, 27, 717, 742: n = A,T,C or G
gnnttttnannnnnnnnnttttaaaanatcaagttcttgttctttttgcaggatcccatcgattcgaattcggcacgagccggagagaagcagcaggagggcggcggcgccgtgcgctgcgacacacctgccaactgcacctatcttgacctgctgggcacctgggtcttccaggtggggctccagcggttcccagcgcgatgtcaactgctcggttatgggaccacaagaaaaaaaaagtagtgggtgtaccttcagaagctggatacagcatatgatgaccttggcaattctggccatttcaccatcatttacaaccaaggctttgagattgtgttgaatgactacaagtggtttgccttttttaaggatgtcactgattttatcagtcatttgttcatgcagctgggaactgtggggatatatgatttgccacatctgaggaacaaactggttattaaatagagcatctgttgagggactcttttaaaaccacagccatgaacagacgttggggctaagagacagacagcctgcgacagtgtggacctacctgtagcagctagcaaaggcctctagcagctacagtcccttctggagtctttatttgcatgcaaaatgcaaaggagtcctggtgacctactccaagcactgcccttctgaacactccttggaaaacagtaaacatcattttggaatgtgaacaaccagagactncccaggagaaaggaaaaaaaaattntgaagatgcaaaatcttgggtggcttcaccgtcaatttttaa

SEQ ID NO: 4360 - DNA, 746 bp, Homo sapiens
  misc_feature 2, 3, 7, 8, 9, 10, 11, 12, 13, 14, 15, 16, 17, 22, 23, 24,25, 145, 160, 169, 177, 184, 186, 201, 206, 212, 220, 241,254, 259, 265, 273, 276, 279, 283, 285, 318, 378, 411, 534,638, 655, 676, 697, 699, 703, 731, 732, 733, 734, 735: n = A,T,C or G
  misc_feature 736, 737, 738, 739, 740, 741, 742, 743, 744: n = A,T,C or G
gnntttnnnnnnnnnnnttttnnnnatcagctctgttctttttgcaggatcccatcgattcgaattcggcacgagcacagtccttctggagccagacccgaagccacagtagcagtgccagctcagcagaaagtcaggacagcangaggaggaagaaaangaaggaaangaaaaacncaggaancntaaaaggcttaggancttangaaacntgcaggcnctgaagtggaattggaaaaanccaaaaccccaancccangaaaangagtcaangangancaangntaagagaaggagaaggagaaggatgaccaaaangtgaatctgcctgtgtaaaaggcagattttttaattgcttaatactaagtcatctgtttnaaatttggtatatgtaagagattcaagccttgnaatatgacatggaagaccctgtgctgcacttaaatatgcttgcttgattatttgattttacatcagagctttataacacgaacttttgtccagaattgtgagttgtgccatgttacatgaganggttttgctagggcctattatttttaccaccattaattagttggggtggagtttactgtaatgtgaaatttcccatttgaatttttaatggctggcaaagctgntttagtcttaaattcancggatgattgctgaatcattncaccctgtatgtccttttggntncatnaaagtttcagtaactttcaaaaaaaaannnnnnnnnnnnnnaa

SEQ ID NO: 4361 - DNA, 777 bp, Homo sapiens
  misc_feature 2, 3, 7, 8, 9, 10, 11, 12, 13, 14, 15, 16, 17, 18, 26, 27,702, 705, 718, 722, 731, 742, 751, 756, 761: n = A,T,C or G
gnntttnnnnnnnnnnnnttttatannatacagctcttgttctttttgcaggatcccatcgattcgaattcggcacgaggaaaggacagtgctacttgtatatgaaggttatagaacgagcggcttttcctcggcgtctctgggaacgggtccggcttagtaaaaactatgagaaagcactggagcaaatagatgaaaatctgatttactggccccgtttcattcgacacaaatgtaagcagagattcaccaagatcacccaatcctaattcgaattagaaaacttcactaaagcgacagaggaaacttgttcctttgagtaagaaggtggagcgtagggagaaaagaagagaggaaaaggcattaatagctgctcagctggacaatgccattgagaaggaattactggagagactgaacaagatacgtatggcgacatctacaacttcccattcatgccttcgacaaagccctggaacaacaggaggcagagagtgactcttcagatactgaggaaaaagatgatgatgatgatgatgaggaagatgtggggaaaagagaatttgtcgaagatggtgaggtagatgagagtgacataagtgattttgaggatatggataactggatccagcagtgatgaagatcaggatggtaaatcctccatgaggaggaggaagaaaaggccttatgcgaaacacaaangcnaaatgcccttganaggncctgcgganaaaccaacctnttggaaatngaatncaacnggagacaaacccgtgg

SEQ ID NO: 4362 - DNA, 789 bp, Homo sapiens
  misc_feature 4, 5, 6, 19, 25, 34, 39, 40, 42, 44, 50, 148, 593, 652, 661,723, 747: n = A,T,C or G
taannnatacagctacttngttctntttgaagcnctttnnananatacangctacttgttctttttgcaggatcccatcgattcgggcctccccacccctgctgcacacctacactgaaggaaggctatttgcagatgcagcaagaangcagccatctgcaaggcagaagaagagaccctcaccaggaactgaataagtcagtcagtctgggacttccacctctagaactgtgaaacaataaatttctgtggtgtaagcaactcaatctatagtagtttgttactattttgttatagcaaccaaagatgactaaccagacaggttatgtcactcgccaagtgtcttggtctgtttgtgctgctataacaaaataccttagactgggtaatttacaaacaacagagatgtatccagagatccacagttctggaggctgagaagtctaaaatcaaggcaccagcagattccacatctcgtgaaggctcactctctgcttcacagatggcactgcttgctgtgttctcacatggcagaaggggcaaacaagcccccctgggcctcttttataaaggcactaactctatgcctaaangcagggccctcatgactctatcacctaccaaaaggcttcacttctttatactattggangggtagaangaacttcctttctagaccttgaaaggttaagaaatttgaatctattaaacaagctgacaatngacagattaacaggagaaaaagcntatacattttttaatgtgggccaaatggcaaaagcttaaata

SEQ ID NO: 4363 - DNA, 763 bp, Homo sapiens
  misc_feature 6, 661, 672, 715, 717, 739, 760: n = A,T,C or G
tatagnatcagctcttgttctttttgcaggatcccatcgattcgaattcggcacgagcgaataaagcagaaaaggagagatcgctgaaggaaaagtctccgaaagaagaaaaactgagactgtacaaagaggagagaaagaagaaatcaaaagaccggccctcaaaattagagaagaagaatgatttaaaagaggacaaaatttcaaaagagaaggagaagatttttaaagaagataaagaaaaactcaaaaaagaaaaggtttatagggaagattctgcttttgacgaatattgtaacaaaaatcagtttctggagaatgaagacaccaaatttagcctttctgacgatcagcgagatcggtggttttctgacttgtccgattcatcctttgatttcaaaggggaggacagctgggactcgccagtgacagactacagggacatgaagagcgactctgtggccaagctcatcttggagacggtgaaggaggacagcaaggagaggaggcgggacaccgggcccgggagaagcgagactacagagagcccttcttccgaaagaaggacagggactatttggataaaaactctgagaagaggaaagagcagactgaaaagcataaaagtgtccctggctcctttcggaaaaggcaagaagangagagagtccncaaagcccggccggacagaaggacccctggaagctgcaaggancncagggaccgcagggccaacccnaggaggtgccccggaggactnaat

SEQ ID NO: 4364 - DNA, 821 bp, Homo sapiens; identical to SEQ ID NO: 529
  misc_feature 2, 4, 5, 6, 8, 9, 12, 13, 14, 15, 16, 17, 18, 19, 20, 21,22, 23, 24, 25, 656, 704, 708, 725, 765, 799, 821: n = A,T,C or G

SEQ ID NO: 4365 - DNA, 772 bp, Homo sapiens; identical to SEQ ID NO: 4356
  misc_feature 2, 3, 4, 8, 9, 14, 15, 16, 17, 18, 20, 22, 25, 30, 113, 393,476, 530, 597, 612, 623, 640, 717, 743, 772: n = A,T,C or G

SEQ ID NO: 4366 - DNA, 819 bp, Homo sapiens
  misc_feature 168, 175, 438, 483, 517, 523, 570, 595, 612, 631, 645, 674,733, 769, 805, 819: n = A,T,C or G
aaacagctacttgttctttttgcagggatcccatcgattcgggagaaatgctggccacagatggtgctgcccaacaggcccataccactcgttccagtcagaggtgcttggcctttgtgggatgaatgttcgttggttcaaatcaagctttttccaaatgaacaagancactggnctttaccatattttggcaaggatccgaaatcaagggttcttctttcaaagtgcttgccagggggaatcttgaaagaagggtaccccttgcaacaaaacctggttccctgtaaaccctcttcttgaagggaatcccctgcttgccccacttggcattttccaagtttgcccttcctcaagaatgtattaaaccccgaaccagggtacttgtcttgtgcccaagacgatcttgggaaacccggccccatgggatctgtacttgantgcttgctgagcttcacccactgagagtttacctctggagttcantgatgacttggatgttgtgggtgatggtatgcantgtctncttaactttgctttttgatccttcactaacccttgaagatcatttantcaaagaaattgcttgaagacacantggatattttgggccanatgcaaatggctggagatnggtgcagatcccanggatctcgaaattctgagaaagcttttgnaccattggcttaaaatggattggctactgcaaatgggaagccagaaccacttttattanttgatagtttggggaaccatttactttggtggattnaaattctcgtctttaaaagaagtatttctgaacatntttaacaaaaaaan

SEQ ID NO: 4367 - DNA, 765 bp, Homo sapiens
  misc_feature 5, 497, 630, 731, 736, 741, 765: n = A,T,C or G
taaanaatcagctcttgttctttttgcaggatccctcgattcgaattcggcacgagcgggactggtaccaccgcatcgaccccaccgtgctgctgggcgcgctgccgttgcggagcttgacgcgccactggtacaggacgagaacgtgcgcggggtgatcaccatgaacgaggagtacgagacgaggttcctgtgcaactcttcacaggagtggaagagactaggagtcgagcagctgcggctcagcacagtagacatgactgggatccccacttggacaacctccagaagggagtccaatttgctctcaagtaccagtcgctgggccagtgtgtttacgtgcattgtaaggctgggcgctccaggagtgccactatggtggcagcatacctgattcaggtgcacaaatggagtccagaggaggctgtaagagccatcgccaagatccggtcatacattcacatcagcctggccagctggatgttcttaaagagttncacaagcagattactgcacgggcaacaaaggatgggacttttgtcatttcaaagacatgatgtatggggattagaaagaactcaagacactcctgcttgatacagaacaaaaagagcttaacaggaccaacanggcttaacccagacttgacgtaacagaaatgtgccaataggtaataggtaattttctttctctgacttggtttggtttctttgaaataacactgttgtgtnggctngaaanggaaaaaaaaaaaaaaaaaaaaan

SEQ ID NO: 4368 - DNA, 763 bp, Homo sapiens
  misc_feature 2, 3, 7, 11, 12, 13, 14, 18, 443, 444, 445, 447, 448, 449,450, 451, 452, 453, 454, 455, 456, 457, 458, 459, 460, 461,462, 463, 464, 465, 466, 488, 491, 499, 534, 591, 619, 627,717, 762: n = A,T,C or G
gnntttnaaannnncagntcttgttctttttgcaggatcccatcgattcgccaggctagtcttgaactcctggcctcaagcaatcctcccacctcggcctcccaaagtgctgggattaaaggcgtgagccaccgtacctggcccttggtggaatctttagggttttctattcatacatataaaatcatatcattggcaaacagagataattttacttcctcctttccaatttggatgccttagatttcttttccttgcctaactgctctgtctagaactcccagcactatgctgaatagagtggcaagagcaggcatttgccttgttcctaaccttagagaaaaatccttcagccttttaccattgaggatgatgtttgctggtagtttttcataaatgatctatatcaggctgaataaatttctatttctaaaaaaaaaaannnannnnnnnnnnnnnnnnnnnnaaaaaaaaaaaactcgagcctntanactatagngagtcgtattacgtagatccagacatgataagatncattgatgagtttggacaaaccacaactagaatgcagtgaaaaaaagctttatttgngaaattggggagctattgctttatttgnaaccattntaagctgcaataaacaagttaacaccaccaattgcttcatttatggttcaggtcagggggaggtttggaggttttttaattcgcggccgngggccaatgcattgggcccggtcccaactttggtccctttagggng

SEQ ID NO: 4369 - DNA, 765 bp, Homo sapiens
  misc_feature 3, 4, 5, 9, 10, 104, 691, 705, 727: n = A,T,C or G
ggnnntttnnattatacagttcttgcctttttgcaggatccctcgattcgaattcggcacgaggtggctatccatcaacataagtaaaaaaaaaaaacactttnctccctcccccatttagattatttattaacatattttaaaaatcagatgagttctataaataatttagagaagtgagagtatttatttttggcatgtttggcccaccacacagactctgtgtgtgtatgtgtgtgtttatatgtgtatgtgtgtgacagaaaaatctgtagagaagaggcacatctatggctactgttcaaatacataaagataaatttattttcacacagtccacaaggggtatatcttgtagttttcagaaaagcctttggaaatctggatcagaaaatagataccatggtttgtgcaattatgtagtaaaaaaggcaaatcttttcacctctggctattcctgagaccccaggaagtcaggaaaagcctttcagctcacccatggctgctgtgactcctaccagggctttcttggctttggcgaaggtcagtgtacagacattccatggtccagagtgctcagaaactcaagataggatatgcctaccctcagctactcctggtttaaagttcagctctttgagtactcttcaattctttcaggacacttgggtggaattcagtaagtttcctntgaacaccctgaanggtgccatccttacagactaantggagacgtttccagatcagcccaagtttactatagag

SEQ ID NO: 4370 - DNA, 774 bp, Homo sapiens; identical to SEQ ID NO: 4259
  misc_feature 9, 13, 18, 27, 34, 36, 37, 38, 41, 398, 688, 689, 690, 692,693, 694, 695, 696, 697, 698, 699, 700, 701, 702, 703, 704,705, 706, 707, 708, 709, 710, 711, 712, 713, 714, 715, 716,717, 718, 719, 720, 721, 722, 723, 724, 725, 734, 735: n = A,T,C or G
  misc_feature 753, 773, 774: n = A,T,C or G

SEQ ID NO: 4371 - DNA, 779 bp, Homo sapiens
  misc_feature 2, 3, 4, 5, 7, 8, 9, 12, 13, 14, 15, 16, 17, 18, 19, 29,32, 77, 78, 80, 138, 193, 196, 213, 215, 266, 273, 274,287, 288, 294, 298, 318, 330, 340, 377, 445, 472, 500, 519,530, 597, 606, 643, 656, 676, 684, 685, 714, 718, 725, 733: n = A,T,C or G
  misc_feature 763: n = A,T,C or G
gnnnntnnnttnnnnnnnntttttaaaanaancagctacttgttctttttgcaggatcccatcgattcgctcgagtnncnaggagacgtgcagctgtccaaggctctgtcctatgccctgcgccatggggccttgaanctggggcttcccatgggagctgatggcttcgtgcccctgggcaccctcctgcagntgncccagttccgcggcttntntgctgaagatgtgcagcgcgtggtggacaccaataggaagcagcggttcgncctgcanntgggggatcccannactggncttntaatccgggccaaccagggncattccctgcangtacctaagntggagctgatgcccctggagacaccgtaggccctgcnccgatgctagtccatggtacattctggaagcactggcatccatcctactcaaaggcctgtcctgccanggaaggacgcacattcacctgccccangactgcctggagaccccggtatcatcantggcatgcggtcccattgngaaatagctgngttcatcgatggacccctggctctggcaaatggaatacccttctttcgtctgccaatggggtgatantgacttcanggaatactgatggcttcctacttccaagtacttcaangaggccctgcagntacgccctaccgaaaccccnttccttgnntggtgatgaaaagacacaatgtaatagtncccnaacccantttcaganaaaggaggaggatccaacattaaatattanttataaaaagaattta

SEQ ID NO: 4372 - DNA, 762 bp, Homo sapiens
  misc_feature 2, 3, 11, 23, 94, 185, 643, 701, 737, 751: n = A,T,C or G
gnntttgaaanccctttttgatncctcttctacttgttctttttgcaggatcccatcgattcgaattcggcacgaggttcttcaaagccaaccnagacaggcttagcagttttagagcttcagaacaaattgccaaaagccagagttgtttatgctagtgcaactggtgcttctgaaccacgcancatggcctatatgaaccgcttggcatatggggtgaggggtactccatttagagaatcagtgattttattcaagcagtagaacggagaggagttggtgccatggaaatagttgctatggatatgaagcttagaggaatgtacattgctcgacaactgagctttactggagtgaccttcaaaattgaggaagttcttctttctcagagctacgttaaaatgtataacaaagctgtcaagctgtgggtcattgccagagagcggtttcagcaagctgcagatctgattgatgctgagcaacgaatgaagaagtccatgtggggtcagttctggtctgctcaccagaggttcttcaaatacttatgcatagcatccaaagttaaaagggttgtgcactagctcgagaggaaatcaagaatggaaaatgtgttgtaattggtctgcagtctacaggagaactngacattagaagctttggaagaggccggggagaattgatgatttgttcactgccaaagngtgttgcagcactcattgaaaacatttcctgttcanacaggaaaactttntagttactaga

SEQ ID NO: 4373 - DNA, 770 bp, Homo sapiens
  misc_feature 2, 6, 7, 8, 9, 10, 11, 12, 13, 14, 15, 19, 21, 22, 137, 148,157, 161, 162, 163, 165, 167, 171, 178, 183, 186, 187, 199,212, 214, 220, 240, 248, 289, 357, 578, 666, 678, 687, 740,748, 753: n = A,T,C or G
gntttnnnnnnnnnntttntnnatacagctacttgttctttttgcaggatcccatcgattcgcaggcgtactgacaggtggaccagcggactggtggagatggcgacgctctctctgaccgtgaattcaggagaccntccgttagganctttgttgncagnnnancncgtnaaaaacnatgtnagnntttccgttgaanaagggaaagagantnttcttnatgtttctgaaaatgtgatnttcacagntgtgaattctatacttcgttacttggctagagttgcaactncagctgggttatatggctctaatctgatggaacatactgagattgatcactggttggagtcagtgctncaaaattatcttcatgtgattcctttacttctacaattaatgaactcaatcattgcctgtctctgagaacatacttagttgggaaactccttgagtttagcagatttatgtgtttgggccaccctaaaaggaaatgctgcctggcaagaacagttgaaacagaagaaagctccagttcatgtaaaacgttggtttggctttcttgaacccagcaggccttncagtcagtaggtccaagtgggatgtttcaacaccaaagctcgagtggcacctgagaaaaacaagatgttgggaaatttgttgagcttncaggtgccgganatgggaaanggtaccggcagatttcctccaaaggccatgggtacttacacattgggcattcnaaaactgntcttntgaccacactaccaggt

SEQ ID NO: 4374 - DNA, 786 bp, Homo sapiens
  misc_feature 2, 6, 7, 8, 9, 10, 11, 12, 13, 15, 18, 22, 166, 181, 199,634, 660, 682, 728, 731, 738, 758, 780, 786: n = A,T,C or G
gntttnnnnnnnntnttnaagntcttgctacttgttctttttgcaggatcccatcgattcgcccgaggagcggagcagaggcacccaggcagcctgcgcggagaaattggatcggcggggacggcctgcagctcccgcgcgcggggaaagggaagaagtcctcccntacaaagcaaattcncaaacttggaagaagcantttacacaggatgtgcagatctcaatggaaggacacgggaaacgtgaaaaagcaaggaagtggggacgcctccaaaggaacccagtaattctccagcaacagatccccatccaaaagaaattcaagaaatgtcatatagagaattgtggaaactgattttaaccaagattagagggattcaagagacttctgaaaaagaaagtaaggaaatgtcaacagcaattctggatatggttgaggtatttaccaaccagatacagagttttccagagcacatggcaaatgtggaactgaagaaatcactggatgaaatccaaagtatactcgaaagcttcaatgatagactagatcaagcagaaaaaaaactcttaaaacttaaaatcttgaagcttttactcaattcaaatatttaatgggttgtctctggccattcangtgaacaaaatctgctgggttaattntttttttttttgaaatgggatnttcgcttctgtcgcccaagcttggaattccattggccgggaccttnggnttactgnaagcttccgcttccaggttnacgccatttttccttgcttaancttctn

SEQ ID NO: 4375 - DNA, 786 bp, Homo sapiens; identical to SEQ ID NO: 4374
  misc_feature 2, 6, 7, 8, 9, 10, 11, 12, 13, 15, 18, 22, 166, 181, 199,634, 660, 682, 728, 731, 738, 758, 780, 786: n = A,T,C or G

SEQ ID NO: 4376 - DNA, 783 bp, Homo sapiens
  misc_feature 2, 3, 7, 8, 9, 10, 11, 12, 13, 14, 15, 16, 24, 170, 203,638, 679, 689, 693, 720, 730, 732, 765, 776, 780: n = A,T,C or G
gnntttnnnnnnnnnnttttaaantacttgctacttgttctttttgcaggatcccatcgattcgcccgaggagcggagcagaggcacccaggcagcctgcgcggagaaattggatcggcggggacggcctgcagctcccgcgcgccggggaaagggaagaagtcctcccntacaaagcaaattcacaaacttggaagaaacantttacacaggatgtgcagatctcaatggaaggacacgggaaacgtgaaaaagcaaggaagtgggacgcctccaaaggaacccagtaattctccagcaacagatccccatccaaaagaaattcaagaaatgtcatatagagaattgtggaaactgattttaaccaagattagagggattcaagagacttctgaaaaagaaagtaaggaaatgtcaacagcaattctggatatggttgaggtatttaccaaccagatccagagttttccagagcacatggcaaatgtggaactgaagaaatcactggatgaaatacaaagtatactcgaaagcttcaatgatagactagatcaagcagaaaaaaaactctcaaaacttaaaatctgaaggcttttactcaattcaaatatttaatgggttggactctggccattcangtgaaccaaaatctgctgggttaattttttttttttttganatggaatctngctnttgtcgcccagcttggaatcaattgcnggacctcggntnattgcaagcttccgcttccaggttcacccattnttctgccttancctnctg

SEQ ID NO: 4377 - DNA, 783 bp, Homo sapiens; identical to SEQ ID NO: 4376
  misc_feature 2, 3, 7, 8, 9, 10, 11, 12, 13, 14, 15, 16, 24, 170, 203,638, 679, 689, 693, 720, 730, 732, 765, 776, 780: n = A,T,C or G

SEQ ID NO: 4378 - DNA, 772 bp, Homo sapiens
  misc_feature 2, 3, 7, 8, 9, 10, 11, 12, 13, 15, 17, 23, 585, 697, 731,747, 760, 765, 769: n = A,T,C or G
gnntttnnnnnnncntntttatnaatacagctcttgttctttttgcaggatcccatcgattcgaattcggcacgaggaaccaagaaaatatttaaaaatctaagcagtcctttgctcattaaaggataaatcagtagttaacactttttctacaaagaaatgggtgtgcctggatgggtcgtgtaggtgagttttccaaggattatggtaacaaatgagtgagacctctatggagaaaatattgaaggacattaaagaagacctcataaatggagagagatatatcattaatggatagggaagcctcaatggcataagtatgtcagtttctttcaaaactcacctatggattcaatgtgattccaaaccaaatcccacaaggtctttcctggaattggaagccagattctgaaatgtatttggaaaagtaaagaggcagggttagctatttcattaacaaagaaggaacatcaggcagggagacttgtgttattattaaggcttattataaattattattgtgatcaagatagtgtatttttggtgtagagatagttaaattgccaatggattgagccaaatttncaaaacagacccacaaataaatgaactctaatttacaacagagacagtactgcagatcatggggggaaaggatgaactattgagggattggcaacttttttggtaaggctanacagccttacgtggggtcacagtgtctgtggaantaggcacctctgctgnggtattgtaagancactntgancat

SEQ ID NO: 4379 - DNA, 781 bp, Homo sapiens
  misc_feature 2, 3, 4, 9, 12, 13, 14, 15, 18, 24, 25, 27, 32, 44, 624,636, 642, 663, 667, 673, 680, 682, 758, 759, 767, 774: n = A,T,C or G
gnnnttttnaannnnctngtttcnngnatcanttccaagccttngtgcaggatcccatcgattcgaattcggcacgaggggattacaggcatgacccaccgcgcccagcctgtaatttcttatactttgtattttgtacttgtattatgcttctgaatacgctataattatttatgtacatgttttttttcttcaatagactggtggaactcttcgaatgtagggactcctagagctagatactcaattattttttattaaattgaatgacttgaaactacagatcctttatttaaacttcccaaatttctgctttatctaggcaactctttaaattcttttatctcatgtagatttcaaaggctgaaataattgagattttttagtttgaagaaaagagaactgaggatttaatgtcattattattatatttttaatggactgtttgggagtaagttgcagacattgttcactttcactcctaaatacttaaatatttcctaaaaacaggacattcttttttttttttatggagtctggctctgtcgtccaggctggagtgcggtggcacgatcttggcttactgcaagctcccccttccagattcacgctgtctcctgcctnactgctcgggangctgangcaggggaatcgcttgacccnggangcggangttgcananagcctaaacgggccattggactccagctgggtaccaagaaccggacctccgttggaaaaaaaaaaaaaaaaaactnngcctttanaactttngggggcg

SEQ ID NO: 4380 - DNA, 768 bp, Homo sapiens; identical to SEQ ID NO: 531
  misc_feature 2, 3, 7, 8, 9, 10, 11, 12, 13, 14, 15, 16, 17, 25, 370, 431,440, 452, 483, 500, 599, 615, 644, 645, 660, 670, 686, 713,734, 745, 768: n = A,T,C or G

SEQ ID NO: 4381 - DNA, 755 bp, Homo sapiens
  misc_feature 4, 5, 6, 7, 8, 9, 10, 13, 14, 15, 16, 17, 38, 105, 223, 405,429, 484, 527, 569, 611, 653, 708, 733, 734, 752, 755: n = A,T,C or G
agcnnnnnnnttnnnnnaataaactctttgcaacttcnctttttgcaggatcccatcgattcgcccaggatgaactggttgcagtggctgctgctgctgcggttncgctgagaggacacgagctctatgcctttccggctgctcatcccgctcggcctcctgtgtgcgctgctgcctcagcaccatggtgcgccaggtcccgacggctccgcgccagatcccnccactacaggggagcgaagtcaaggccatgttctaccacgcctacgacagctacctggagaatgcctttccttcgatgagctgcgacctctccctgtgacgggcacgacacctggggcagttttctctgactctaattgatgcactggacaccttgctgatttggggaatgtctcagaattncaaagagtggttgaagtgctccangacagcgtggactttgatattgatgtgaaccctctgtgtttgaaacaaacattcnagtggtaggaggactcctgtctgctcatctgctcttcaagaangctggggtggaagtagaagctggatggccctgttccggcctntctgagaatggctgaagaagcggccgaaaactcttccaaccnttcaaacccactggcatgccatatggacagtgaacttacttnatggggtgaacccaggaaaaacccctgtcacctgtccggaaggattgggaccttnatggtgaattgccacctgacagctnntggtgaaccgtgttcaanaan

SEQ ID NO: 4382 - DNA, 762 bp, Homo sapiens; identical to SEQ ID NO: 4372
  misc_feature 2, 3, 11, 23, 94, 185, 643, 701, 737, 751: n = A,T,C or G

SEQ ID NO: 4383 - DNA, 765 bp, Homo sapiens; identical to SEQ ID NO: 530
  misc_feature 2, 3, 7, 8, 9, 10, 11, 12, 13, 14, 15, 16, 17, 24, 25, 26,188, 560, 651, 710, 727, 732, 739, 742, 751, 765: n = A,T,C or G

SEQ ID NO: 4384 - DNA, 820 bp, Homo sapiens
  misc_feature 1, 2, 3, 4, 5, 6, 7, 8, 9, 12, 13, 14, 15, 18, 24, 25, 153,170, 185, 231, 258, 324, 714, 739, 756, 803: n = A,T,C or G
nnnnnnnnnttnnnnctntgaagnnatagctacttgttctttttgcaggatcccatcgattcgaattcggcacgagatatttgtacatgcatatttcaaagacctgttaatggtgtccactttggattcttacatgaaacgattcaagtggcncattggtaaggcctaanggaccacgccaaaangggttcccaacttatttaaaggtatttcaagtacccttccaaaaangttaaatggcatttaagacactttcangaatggttaaactggcttctaaaacaaaaactccctaaagtctggtccctatgcaatatatatttntaatataccatatatattttttaccataggaatactcacaaaagtgcaagccaataataacattggcaagaaaaagtaatacatatctgctaggtgacaatatcaaacaattcaggggaataattttactttaattaacattaacagaatttctttttccacttcaaatcaatcatatttctgtcatctccaacctaagatattttttagattgtctccctattctttgattcaaaagccaattacagaaactatgaacttgacctaattctggtttttgacaattatgagacagaaataaagaaatgcaagcagttcttttctttgccactgaccattttttaattcatcatcctctatgatgatggtgctttcacaactgcagctctnctgtatgtcaaaatcattctggttncaggtaaatggacaaanggagatttgccttcagtgtctaaaaggcaatttacttttcaagctgncttaattacctatgggt

SEQ ID NO: 4385 - DNA, 767 bp, Homo sapiens
  misc_feature 1, 2, 3, 4, 5, 6, 7, 8, 9, 11, 12, 13, 14, 15, 18, 25, 27,462, 493, 528, 558, 573, 648, 683, 700, 761, 767: n = A,T,C or G
nnnnnnnnntnnnnnctntgaagcnanagctcttgttctttttgcaggatcccatcgattcgaattcggcacgaggctatgctaaacagcctttacatgtatggtctggttaaagttcctttgttccttttgttttaataaaatgtgtcactgattttttagctcaaaaatcatcactggtaattccaagcccccaaaatatggttaaaaagattttttttttaatcatgaagagaaaattagtagcattctttctctcccattatttattggttttcctcactaatctttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgntttctgtctgcttttttcttatgtctcttgntgagttttatattttcagtggttatttttgcttgngttagatcattattaaaatatatccaatgnccctttgatacttgngctctgctgagaatgtccagtttgcattaaacatcccagtctcatccttcaggaatttgcagtcaatgagaaganggagacaaatttaaagatgaggacagaagcatctntacagatgaaaattacntaaataaaacattctccatcaacactaaaaaaaaaaaaaaaaaactcgacctttagaactntagggn

SEQ ID NO: 4386 - DNA, 765 bp, Homo sapiens
  misc_feature 9, 642, 659, 677, 736, 740, 745: n = A,T,C or G
ttaagctanagctacttgttctttttgcaggatcccatcgattcggtcgggtctccaacctcattaagcaccacagggttcacactggagagaagccctataagtgcagtgactgtgggaaagcatttagtcagagcttccacccttattcagcatcgggagaaattcacactgggagaaaaagcctcacgttgtggtaaatggtatgtgggaaaagccctttagttatagcttcagtgctcccgaaagcaccagatcatccacacgggagagaagccgtacagatgcagtgtctgtgggaaggccttcagccacagctcagccctcattcagcaccagggcgtgcacacaggcgacaagccctacgcctgcacgagtgtgggaagacctttggtcgcagctccaacctcatccttcaccagcgagtccacactggagagaagccctatgaatgtactgaatgtggaaaaaccttcagccagagctcaaccctcattcagcatcagaggattcataatgggctgaagccccatgaatgtaccagtgtggtaaagccttcaccgaagctcaaatctcattcaccaccagaaagttcatactggggaaaaaccctacacctgtgttgaatgtggtaagggcttnagccagagctacacctnattcagcatcagataatncacacgggcgagcgcccctacaaatgcatgagtgtgggaaagccttaatcagcgtctgncctnatcancaccagaggattacactggg

SEQ ID NO: 4387 - DNA, 734 bp, Homo sapiens; identical to SEQ ID NO: 4307
  misc_feature 6, 9, 12, 24, 28, 36, 44, 443, 509, 544, 670, 687, 712, 733: n = A,T,C or G

SEQ ID NO: 4388 - DNA, 768 bp, Homo sapiens; identical to SEQ ID NO: 531
  misc_feature 2, 3, 7, 8, 9, 10, 11, 12, 13, 14, 15, 16, 17, 25, 370, 431,440, 452, 483, 500, 599, 615, 644, 645, 660, 670, 686, 713,734, 745, 768: n = A,T,C or G

SEQ ID NO: 4389 - DNA, 10 bp, Homo sapiens
  misc_feature 1, 2, 3, 4, 5, 6, 7, 8, 9, 10: n = A,T,C or G
nnnnnnnnnn

SEQ ID NO: 4390 - DNA, 936 bp, Homo sapiens
  misc_feature 4, 8, 11, 19, 29, 35, 58, 63, 72, 83, 91, 93, 94, 128, 133,189, 191, 228, 250, 251, 354, 447, 469, 491, 535, 559, 596,634, 650, 670, 692, 698, 713, 720, 733, 747, 753, 776, 799,817, 820, 822, 829, 839, 846, 852, 856, 876, 892, 929: n = A,T,C or G
ttangtgnacnccctgganaaccacttgntttttntgcaggatcccatcgattcgagnaaatngtcctgcantcctatatgcngaattttntnnatatcttgacccaaaataactggggtaaaatatntagtngaaaccttgtatatattataaacttagctttgtaatattaagtatgaaagcagcananatagatagtctcagaagaagaagaaaatgtataaatncttggggagagctgtgataaanngactagacttacctttgagttcctagccgatccctacctgacagctttcccagctgggaaaaatctgcttgggcaagggaaagggggaatatgattattggangaacttcccaccttatagggactggcaagaggggatacatgaccagggaatgaaccataaaagggagagaaattggacatttaaattttacanggaattaagatgagatctaagnataatttgaaagattttgaaanaaagagccaaatccgaggaaagatgtaaggaaagtgatggggangggaaaaaaaattatgggatggtnaagactttctaaagttaatggggggaggaaatccaanggaccaccaagggtaaggtttaaagaaggggaaagganccaaaggaattttaanggaacccatggttttttcancccccagaaccaggggagaaanccaaangggaaaggaaagganccggaanggcttggagcccnccagggggggcttncaccgnccctggttaattcccccaccccnctttttgggggaagggcccaaanggccggggtggaatccancgnangggcccngggagaaatnggaccancccatncccngggcctaaaccaccgggggnaaaaccccccctcttnttaccttaaaaaaatccccaaaaaaaaaacccgccanggggcat

SEQ ID NO: 4391 - DNA, 769 bp, Homo sapiens
  misc_feature 10, 28, 612: n = A,T,C or G
tattatacanctacttgttttttttgcnggatcccatcgattcgaattcggcacgagattatacagttccccacattgaagttgggaagaagatatatggagagcagttgaagacataaggggctctggggaacagcatagttttgctttaattctccagcttgttctcagtaagggtggaaggagaaagagaggaagtatcgattttacagacgtcacatcgtactgctaagaacagacagaaaacttgttgtaataacccgtacacactgtaggagaactaaggaggcccctggtgtagcaatcattttcccaaggatgacggattgtgaggcaggaaggtgtgaaaagaggcagtcatttatataattttggggtttccgctgaggaaacctgagtgaactcacttcagatgcatttggaatattttaataaaaaatacttgattttggctgctgcaggaactgctggaagaaggaaacaatcctagaattggcataaaaacacactgactcattactcctctttgttactattaggcatcagagatacatgttttgttgattttagttacagaaatgagacaaagttgaatctgaatacattggcttncttgttcaaggagctcctcttggatacaatagctatttcatgaaacttctttagagaacaaccatgatacttccaacaagctattttagaaacaaaaattatgctggatctaattactcctaaaatggtcattttcaatgaatattgcactgattct

SEQ ID NO: 4392 - DNA, 883 bp, Homo sapiens
  misc_feature 2, 3, 4, 5, 8, 9, 12, 14, 15, 16, 19, 20, 21, 24, 26, 36,40, 47, 57, 105, 261, 339, 342, 364, 366, 390, 393, 425,452, 480, 502, 613, 636, 655, 661, 662, 663, 664, 675, 695,708, 723, 740, 770, 781, 785, 798, 808, 811, 814, 827, 867: n = A,T,C or G
  misc_feature 870: n = A,T,C or G
gnnnnagnnagngnnnttnnnccntnttaacctttnacanctcttgncttttagcangatcccatcgattcgaattcggcacgagatttaatcttccataagatntttcctcagtgtcttttacttcttctcctgccatcagattcttaccttgattgaaaagccatgttaagtgcaaggcaaattctttacgtctttatacagagattaacaatctctgggtgatgggagcgttaagtgattaacctttgtcactagtanatgtgggaggttagaaaagtgctgccctttttgggtctcagtccctcagttctgcaattacaggcagcctcattattnggncaaatctatgtaaaattgatancncatatccaattaaaaaggatggtnagnggcaaaaaaaaaagagagagagattgattatnacctagtccttgatagcccaacagggngaatatagtccataataattggattggncattggataataactaaaaccntaattggattgtccgaacacaaatattaagcttgaggggatggataccccatcttccatggacgtggattattactgatggcatggcctatggcaaaaatatctcatctgnggcataagccccaaactaaggtncccgccaggaattaaattnaccaannnngccctccgagncctcttaaaaacctattagnggaggtccggtanttacccgtaggaatncccggacccttggaatnaaggaatacccatttggattggaaattttngggaccaaaancccnccaaacctttagnaaatggcccngtnggnaaaaaaaaaaaanggcctttttaaattttggggggaaaaaaattttggggggnaanggccctattttgg

SEQ ID NO: 4393 - DNA, 768 bp, Homo sapiens
  misc_feature 664, 717, 735, 746, 748: n = A,T,C or G
actattgacacctcttgttctttttgcaggatcccatcgattcgctccctctgcttcctcaaacccaggcttcgctgcctctgcggagttcttacctgtctctcctttccacccgggttccctggaggaagctaaactcagaccaaggccctgggctccccaggagttaaaagggaatacgctgtcccaagattctagaatgaagagtcaacgtagcccgagtggcttaaacctcctgtccttaaatgcaagaaatgttttctatcgagccctggacaggtgtctctgctggcctggggttttcaacaggtcatgcctgcctcagaccccagggacaaatgttcttccagctctaactcattctatgctttaagcttttgacctatctttgttttcccagtgccacaccaaatgctgcctggggatctctctttcttcctgagttcccatataagaagccccccatttaagaattcagttggaatgggttgtatttcaaaagttgctttgcaagttagttatttggatttcaagttgcattttaccagggtaacaatattataatgattggttaccttcccagagcaatccagaaatgcccacataacccatgtcacacctgaaccaccctgagttcttctatccttgaacctcttaagctttnccctaactctaacaggtctcatggtccactcaaggtgtttcatgcttctcaantacgtccctttccactgntgtctaccctntntccaaacacaacacaaaaca

SEQ ID NO: 4394 - DNA, 769 bp, Homo sapiens
  misc_feature 17, 625, 695, 761: n = A,T,C or G
tttaaatctatatacangctacttgttctttttgcaggatcccatcgattcgtaacagactaaattttctctgtaagaggttatttcctagatagttaatatttttggtactactttgtgctgtattttataactattaaggaatgttgcagagaaatgctatcaattgttaaaattttgccatgaatacagcagcctcactgaattctcttagtagttctaatagcttgccatttgattctaacaggttttctatgtaaaagatggtgtcatcttcaaacaatgatagtttcatttcttctctttcacctcttaccttccttgtgtttctttagcattgggcaggtccttcagggatatgtgaaacagtggcagtaacaaccagacatcctggcctctttgtttttttttccatgatgaagtctcactccgttgcccagctggagtgcagtggcacgatctcggctcactgcagcctccacctcccggcttcaagtgattctcctgctcaaccccccaagtacttgggattacaggtcctgccactacacccgactaatttttgtacttttagtaaagacagggtttcaccatgttggccagctggttgagaattcctgacctncagtgatccacctgcctcgtcctctctaagttcttggattacaagtgtgagccaccacgcctgccattgnggcctctttattggtcttcttgaaaatgccctgaagtgtcttaatacacataatgttgctgtaaancaatgatt

SEQ ID NO: 4395 - DNA, 765 bp, Homo sapiens
  misc_feature 10, 26, 719: n = A,T,C or G
tgaacctttntacacctcttgctctntttgcaggatcccatcgattcggaaaaagagatgggtcagggaggaaagccaagatggaaaatggatgggaatgaatgaggaacatgatgtgggttggggtgtcaattcatggttaatacaacatgtgtggctcagtataaccagattgtcataagaagctcaggcagctctccccctctgttgcctggggcttttcgcagttacaataaaagtggaaagatgaagaataagggcaagcagaagacacacacatttgcctgtttccctctttttgtccagattgagtagatgggaggcagggctgttacccatgatggtgtttcataccagagtcaatctactagtttgcttggttttataggcgtgattcccaaattttgaatctgaagttagctgtcagtttaaattcagagggtccgcagttgtttttcaggtttttcttgattctgcctttggaaaccaggaagatgttgaatttacttttcatctgacaatattgcacatctgtgaacccaactgatctgaaagtgtttacctcttaactctgtgaagttagctggttattctggatggctgggacaatggtgaggaccgttataatggttactctcacctgtgctccagacgctccacttggtgctagaaatcacagtgaacaaacatggttcttgcctccacacacttgcagttantagggcagactgacgacattaaaaagatccatcggggtggtataat

SEQ ID NO: 4396 - DNA, 789 bp, Homo sapiens
  misc_feature 434, 445, 501, 607, 654, 690, 705, 707, 721, 722, 723, 724,725, 726, 727, 728, 729, 730, 731, 732, 734, 735, 736, 737,738, 739, 740, 741, 742, 743, 744, 745, 746, 747, 748, 749,750, 751, 752, 753, 754, 755, 756, 757, 758, 759, 760: n = A,T,C or G
  misc_feature 761, 762, 763, 764, 765, 766, 767, 768, 769, 770, 771, 772,773, 774, 775, 776, 777, 778, 781, 783, 784, 785, 786: n = A,T,C or G
ttaaaccttttgacaccctacttgttctttttgcaggatcccatcgattcgaattcggcacgaggtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttctgcccctcgagacactcttgggagatgcattttccgtctggctcacagggggagggtgaggctttgcaccccagcccctgcccaagccactgtgagggtgggtgctggctgagcccccggggcaacangagccaagcangtgatgtctttgttctcggctcccacagcagaaccaggtgagggggcgcctgccanggccagacccaagtggggcagcctgaacctgcttcccctgtggccggcatgccccgatctttacacactggtgaccctgaaagaagaaggaggaaggaaccttgcnggggtgtctgaaggccgcactgtcagcttggccggtccaaacctgtngcttggaacttggggtctgtttacctaataaaagtncccacaagtgccctnanttaaaaaaaaaaannnnnnnnnnnntnnnnnnnnnnnnnnnnnnnnnnnnnnnnnnnnnnnnnnnnnnnnnttntnnnnttt

SEQ ID NO: 4397 - DNA, 775 bp, Homo sapiens
  misc_feature 7, 14, 26, 618, 687, 740: n = A,T,C or G
ttgaacnatttganacctcttgactntttgcaggatcccatcgattcgaattcggcacgagataacactgagaaaggagtatggtatacttggtttgaactgtgtgctacactaccaggccccttccacattatactactaatttatttaaaatagataggtatcacactgagaggatataaaaaaaatttctgcctcttcatttttgtttcttgtttgaacagaaaaaatgaccaaaatattgggagtacttctaaggaaaaggcaacacacattccagttaacacttggatgtgaaaatatcaatgaatattagaatttataagtcaaactggctctgctcgctgattgcaatttttagttacattcactattttgtgctaaatttaagtcattggtatacgactggccagagtccttggttttaaacattactgagaactttatatatactcttaatgggtattttatataatgtcgaatgaaacttttatttttagatttttaaaaaatattttgcactttggacttaattttacactaaattgtatcagccagcctaagggcattatgctaaatgtaaatctagttcttggttaagcttttattgaaagatangtggtgctgtaagttaatatattgtagtgaaagtgtgggagaaaagttaaattggcacttaaatcttanttttcaaggaaaacgtgtcccgcacatactgcattatgatggacttgtctcangtgaagtgaagaagtgaaagaatcaagtgtatggc

SEQ ID NO: 4398 - DNA, 828 bp, Homo sapiens
  misc_feature 3, 4, 5, 7, 8, 12, 13, 19, 26, 32, 112, 114, 200, 306, 414,448, 517, 580, 599, 607, 612, 634, 642, 667, 694, 721, 739,743, 772, 773, 777, 803, 806, 810, 815, 822, 824: n = A,T,C or G
ttnnnannatgnnaaaggngcagccnctttgnaacccttggtaaagccccttgttctttttgcagatcccatcgattcgaattcggcacgagtatctattggcagcaaagantntttattggtatactacaatatgatttaactgttattttggggataaatagtagaaaaaagtgaaacagaatgaaggcaggtgtttnttattctaatgatggaataatacagagatactggacgatctctagcagttaattattgtgacccatataaaattatacaggtcacagtataattctctattaccgnttttacaccagtaagtcttagataaactaagcatgcttatgaattatgtatacagttagaatgcattatttttacagaggaacaattgcttgtatgtactaacactgnactcttggcttgcctcaagttctactcattattntatataaaatactattaggctgggcacggtggctcacgcctataatcccagcacttttgggaggtggangctggcggattacttgaaggccaggagttcgagaccaccttggccaaaaatggggaaaccccnatctctataaaaaatacanaaaattancccangtgtcatggataccatgcctgnaaatccancttctttgggaaggctgaaggcacngggaatcggctttgggccccggggaancacaagtttgcaaatggagcccaaganccatgccacttggacccnaaancctggggtggacaagagtgcaacacttgnntcanaaaaaccaaaacaaaaaacatcagantantggnttggngaagccnanttgc

SEQ ID NO: 4399 - DNA, 782 bp, Homo sapiens
  misc_feature 3, 4, 5, 6, 7, 10, 19, 21, 25, 31, 32, 48, 55, 58, 59, 67,73, 79, 102, 123, 307, 357, 358, 360, 383, 412, 424, 435,439, 452, 480, 483, 491, 497, 498, 499, 517, 525, 533, 547,549, 555, 567, 568, 569, 572, 574, 575, 576, 589, 592: n = A,T,C or G
  misc_feature 606, 611, 617, 619, 633, 641, 642, 657, 658, 664, 666, 669,670, 672, 687, 689, 692, 699, 700, 703, 706, 711, 712, 715,723, 726, 729, 733, 736, 744, 745, 749, 753, 757, 758, 759,760, 762, 765, 770, 771, 773, 777, 780: n = A,T,C or G
gcnnnnnctngggaggggngnttgngggttnnccctttctcaaaatanctggacntcnnactcgccnaaacanataggncggggcgcattacatgattctgncttaacgaagatagaagcatnttattgcataagttttcttctgtgtgtgggaatcatatgtgggtgtatatatgtttaaggggtatgcatccgggtagacgtttgtgtgtggacatgtgtgtacaggtatataagtacatgtgtcatagccttggtacaggtctcatagccttgcagcactgtgttcctggcgggagtggcatcngtctgcatgtctgaaaatgccacgtgtgcattctgctgatcaccaaggtnngnggctgtaggcatcctctcttcantgcgtcagaagtctgaagaacatgtagcngcaccggggcgncatgagaaagnaacntgtaggatttatnaactcatttcttgaagccactcactgtntgnttttaagnaccaannncgattgcccattgccaantacagaanagacttcntttggtgagtacangnatgagngacttctctccnnnggncnnnctataatgaactntcngaatcctgacttcncgcancagtcncncggactcccctganctgggctnnttccgctccccacanngaaatnangcnntnccccattccccaaangncgnccccccnnctnccnccccnnccncccacccnccnccncccnccncccccccnncccnccancccnnnncnccngcccnncncccnccnct

SEQ ID NO: 4400 - DNA, 754 bp, Homo sapiens
  misc_feature 4, 10, 742: n = A,T,C or G
ttanatacanctacttgttctttttgcaggatcccatcgattcgaattcggcacgagcagcgcccagctccgaggttggagcagccccgccgggcaacttgaatttctgcaaacgaacacagcaccgggagctctgcagacctgtgtcggcgcggaacccggactgagacatgccttttgaacttctcagatagaggaaccccagtgaagactgatcagttcttacaattctcaaagcatggcccataaatatgtgggtttgcagtatcacggatcagtgacatttgaggatgtggccatagccttctcccagcaggagtgggagagtctggactcttcccagaggggcttgtacagagatgtgatgttggagaactacaggaacttggtgtcaatggcaggacattcccgttctaaaccacatgtgatcgccttattggaacaatggaaagagcctgaagtgacagtgaggaaagatggaagaagatggtgcacaggataagaaagctccagtctacaaacaaaacatgccagaagatttttaggcgatgatgccacctgcacatggaaccaaaagatttgcagttggaagatgatacaatcggctgtaaagaaatgcccacctctgaaaactgtccatcttttgctctacatcagaaaataagtagacagaaaccacgtgaatgtcaggaatatggaaagaccctttgtcaagactcaaacctgttcacatgaaagaatncatagtagtgaa

SEQ ID NO: 4401 - DNA, 751 bp, Homo sapiens
  misc_feature 4, 5, 24, 32, 512, 631, 703, 727, 735, 751: n = A,T,C or G
tccnnttctaatgcttggctactngttctttntgcaggatcccatcgattcgcccaaaaccatttattgaagagacaaccctttcctcattgtttgcttttggcattcttgtcaaagatcagttgtccataaatatgtggctatatttctgggatctctcttttgttcccttggtctacatgtctgtttttaatgggagtatcatactgtttctattactgtaattttgatgtatattttgaaatcaaatagtatgatgctgctagctccattctttatgcttgagagtgctttggctatttagggtcttttctagttccatacaaattttaggtttatttttatgcttctgtaaaaagaggccattggaattttagtagagattgcattgaatctttagatctctttggatagtattgacatattaatgattctaatttcttgaatctatgaacatgagatatctttccgttcatgtgtgtattcaacaaattcattattattattattantattatgattattatcattattattgagacagagtctcaatctgtcacgcaggctggagtgcacgatttcggtttactgcaacctctgcctccggcttcaagtgattctcttgcctcangctcccaagtagctgggattataggcacgtgccaccacgcctggctgaataattggatttttagtagagacngggattttaccatgttggccaagntgggtctngagcctttagaactan

SEQ ID NO: 4402 - DNA, 747 bp, Homo sapiens
  misc_feature 4, 5, 8, 9, 28, 91, 606, 698, 742: n = A,T,C or G
agtnnttnntttttgactccttgctggnctcttgttctttttgcaggatcccatcgattcgaattcggcacgaggccacatagcaatggtntaactgcaggactcaggtccacttgcccagcagctggcagggaagggccatgaggcagtagagtccctacaggccaagaaactgagcagaacccatgcctccagctcaccagctgcattgaagcccccagctggcagggagactgctgtgaatggacagggtgagctcatccccttgaagaacattgagggagaattgtcaagtgctattcacatgaccaaggatgccaccaaggaggctctacatgccaccatggacctcaccaaggaagctgtgtccctgactaaggatgccttcagtttgggcagagatcgaatgacctccaccatgcacaagatgttgtccctgcccccagccaaagtctggtccagaatctgttccacaggatctctttcaaatgtctcagataatgctggtgttcaagggagccctcttgtgaataattatggccaggggtcaccagcagccaacagttcaatttcacccaggccctggaccgccaaacagctactcanctgcttaactggcccacaagtacagaccagagacaaagcaagagaagaagcagagactgtttggcccgggcccgagaagaagcttgctggcnaaggggacgttccaacgaagagaccactgtccttcgagcagganttaca

SEQ ID NO: 4403 - DNA, 778 bp, Homo sapiens
  misc_feature 4, 7, 8, 9, 20, 741, 778: n = A,T,C or G
gggnttnnnccctttgaaancttttatacaagctacttgttctttttgcaggatcccatcgattcgaattcggcacgagggttgttctaggtagtttcatgcggatgctgacctaaactagaatgtagaaattagtaggaaagtgaatgcccactaggtggaaacctgaaagcacggggacctgcgatcttgtttactgttatattcctgctgcgcagctcagggtctctatgtaaaaaatgagtgaatttattttctagctggtgcctacaaaataatctgcaatgtatccatactggtttattaatggtaacaaatgaaccgtactaatatgagataataggggaaactagatatggagtgtatgggaattctatctttactatttctggaaacctaaaactactctaaaatagaaggtttatgttttgaaagcactctgctcattgcgctcttgtctgaaaagtgaagcctggcctcaagccactttgagtatttctcttctgccagttaattatcttaccattgcctctcagtgatattaagagaaaacccatccttaacatttttcattactttttaggttcaaaatgagcctgtttggaacaacctcaggttttggaaccagtgggaccagcatgtttggcagtgcaactacagacaatcacaatcccatgaaggtccacgaaaagctttctggggcttgtaggaagaagtttgggcagagtttcttccatcaanggccagaacccgagatgaccttgggaacctcctttan

SEQ ID NO: 4404 - DNA, 772 bp, Homo sapiens
  misc_feature 6, 25, 29, 686, 698, 714, 715: n = A,T,C or G
ttgaanctttatacagctcttgttntttntgcaggatccctcgattcgagaaagaaaaagaaaaaagccatatggcatagaaaaaaaaaattctgtctttggaggaaaaaggaaaaaagtcccaggtttgaagccagttgtggcctcttactaggtatattattgagtctttcagctctgtttcaaaatctagaaaatgagttcagtattacctgtttaaatttgtgaataacgcattgatgtacaccctggattccctaaaactgtcttaactgcgtgagtccagtggactcagtgcatgagtctaaatccttagacttctatcagaccttctcccctagcagtttcatttgctctttaaatacaaacattggacactcatgcagaaccacagaaatcatgtagacaaactagaaattatcgtgcactcacaaattatagcttccattattaggtaatacatgctaaaccctagcaaacattaagtacgtgaactcctattactaaatagtaatcactcaagtaaactggacaaaatgtcttacggagggtcacatctcatgtgaaattaaaccatgttgcaggcagtgctacacctgagattttacacaggtatttacatttcttttgcctttgtggcaatatgtgcctgttaagataggctattagagaactgggcaatgagnaaccctacaccntaaagtacaaggaagnnatgtgccatatcagcagattttttgcttatttagttagtaatgaatcctcaaactct

SEQ ID NO: 4405 - DNA, 771 bp, Homo sapiens
  misc_feature 5, 8, 9, 17, 20, 90, 198, 202, 207, 351, 416, 444, 527, 556,574, 575, 688, 716, 722: n = A,T,C or G
ggtgnttnnccttgaanttntatacagctattgttctttttgcaggatcccatcgattcgaattcggcacgagctcagctcatgggaatntgcctctcactggtcctcactgggtttatcccagtgaccaattctaggatgaccagaagaatgattccactgggcttgggagtgtttgctggtacctctaatctctgngtanagttnatggtacctgtgtgctctgtggctaggtcctcagagtcagtccctgggcaggtactgtcagccttcagttttccccacagactgtgttcctgggcctgaatcgctcagactacatgttccagcgcagcgcaaatggctccccancctgaaacagatcgaaatcaacaccatctctgccagctttgggggcctggcctcccggaccccanctgtgcaccggtgggtcccctgggcagnccccggcatacctgtggggtgacatgctgatgggtgtacagtcactggctaggccagggaactccagctatgattgtgctttnctgggccccgggtcacatgttgcccctgnccaccccgacagcagttnncacttgtaatgagatccttggtatgtcaaggagaaaaaggacctcatagctcatctagtgctgtcctccattgaacaggcagaaggaacaatatcttgaaaaccccaaaatanaggaaatgcaagggacttctggcttggnggctgngcctggtacatcatttctaccagcattgatgctccaggttcaatgattt

SEQ ID NO: 4406 - DNA, 786 bp, Homo sapiens
  misc_feature 3, 4, 5, 6, 8, 9, 10, 655, 673, 696, 716, 725, 737, 780: n = A,T,C or G
ggnnnntnnnccctttgaaaaccctttatacaagctacttgttctttttgcaggatcccatcgattcgaattcggcacgagggacaaacagtggcaaaacaacactggctaagaatttgcagaaacacctcccaaattgcagtgtcatatctcaggatgatttcttcaagccagagtctgagatagagacagataaaaatggatttttgcagtacgatgtgcttgaagcacttaacatggaaaaaatgatgtcagccatttcctgctggatggaaagcgcaagacactctgtggtatcaacagaccaggaaagtgctgaggaaattcccattttaatcatcgaaggttttcttctttttaattataagccccttgacactatatggaatagaagctatttcctgactattccatatgaagaatgtaaaaggaggaggagtacaagggtctatcagcctccagactctccgggatactttgatggccatgtgtggcccatgtatctaaagtacagacaagaaatgcaggacatcacatgggaagttgtgtacctggatggaacaaaatctgaagaggacctctttttgcaagtatatgaagatctaatacaagaactagcaaagcaaaagtgtttgcaagtgacagcataaagacngaacacaacaaatccttnctgaagtgaattaggaaactccnaggagtaatttaagaccttnaccaagatncatgtatactgnggtacaatgacagccatggttcatatggttgatttttattgcncatggt

SEQ ID NO: 4407 - DNA, 838 bp, Homo sapiens
  misc_feature 2, 3, 6, 7, 8, 10, 11, 12, 13, 16, 17, 18, 21, 28, 48, 56,58, 59, 63, 105, 109, 115, 118, 119, 134, 138, 147, 188,191, 219, 228, 244, 266, 278, 282, 285, 309, 310, 314, 325,350, 377, 389, 399, 403, 416, 422, 427, 428, 437, 440: n = A,T,C or G
  misc_feature 444, 453, 455, 461, 468, 478, 481, 483, 487, 490, 514, 550,557, 562, 563, 578, 594, 632, 684, 689, 694, 708, 731, 735,750, 757, 758, 759, 765, 766, 776, 795, 796, 800, 809, 810,820, 821, 822, 824, 829, 836: n = A,T,C or G
gnnagnnngnnnnttnnnccnaccgganccacgtgaaccctttgttanaacccctngnncttncgcagggatcccatcgattcgaattcggcacgcagggcagcncttntatctngtnntttaaactctggccngccnttcctaatnctcagaccaacaagtagtgttttcccattcggatcgcttancanaaaatgaggagagtcttgtggccatcanctttattgnaagccgaaccactgtnagcaaaaataccaaggagaggnctgatcccactnttgnaanaaaaagaaccatgagggccctgcnnaatncaactggaccntggggatactcactgaagaaggtgnatctatttaggaatgcaaattgtcttnctaccccagacnccccaacaanaaanacttggggtgganggtganatatnncagccaagnaanaacngtttgcatntntccttnttggttngacaaagacntgntnccanatngtcctcaaaggtacataaatacanacatatgatatttgtgtatatataaacacatatgtntagtaanatccnncatttaccttggggngagacttgaagaaacnccagccttctttctagagagcctctgcttctggtattnacctgtcacaaaagcccatacctggttgtcaaaccctttccttgtaactganggagngcatnttacgaatatgggngtagagtaaagtagccaagtgcntatnggaaaatttaagccngaaaaannnaattannaaaaattccnaaaacagcccaataatctnnaggntggggaaannaaaaacccgnnntnggttnttttgtntt

SEQ ID NO: 4408 - DNA, 676 bp, Homo sapiens
  misc_feature 6, 13, 45, 74, 168, 216, 239, 289, 299, 328, 357, 392, 407,410, 419, 461, 508, 537, 538, 543, 556, 560, 573, 579, 589,614, 627, 642, 652, 670, 672, 673: n = A,T,C or G
aacctntttacantcactggtcttttgcaggatcccatcgattcngtgaagtggagatatgtgaatgaccttgntcttttatttgaaatatattttcctatgtcttcattttccttcactgtctgtggtgatttatgtgcatcagataagacaaccacctctcccagnctcgtcagactggtctcatacaggagaaagatctcaacaatgtatccngccagagattttaagggcttctncaatctcaaaaacagactgctatatctcctttttgtggcccactggagcntataatgtgntatgtcctgtcagaaccctcatgaatagnatggtaggagcaagactctttagacatanctgaaaagcttacttggtggatgtgtgtatgcagntccttctatcttcanggngaagttgancaaagatgtttatctcccactattctgtctaacccgaaaganatatttgtctccattcagctgcccctctgtcctggggagaaagtagnggaaggggcccatctgtgtcacctcttgnntctgnggctatctctcantggntctacacttatanctaatnattttcaagntctgtgcggtggtgcctcaaacagngtgaatatccatnacaggtgggggggcncgaagggtancataactcctcatatgananntat

SEQ ID NO: 4409 - DNA, 781 bp, Homo sapiens
  misc_feature 2, 4, 5, 7, 8, 608, 621, 682, 702, 710, 722, 764: n = A,T,C or G
tntnncnntttgaaaccttttatacaagctacttgttctttttgcaggatcccatcgattcgaattcggcacggaggccatacaagagactccagatatgcagctagagaaacttaaggaaggtgagcttatcaacgtgcattcagaaagtggttatgattacaagaatgaagatatcccagaggaattgacattgtcagaaaacttcacattaatcgaattctcagagatgtctcacaacattgaaagcacaaaagatgaaatgttagaagctggtgcacagtaaggataaaggagtatggcagttcaccaaggcatggaaaagatgcctgctccatattgttaagttatacagtgagaagaaggaggcgaacatagttcagactactcttggtaggtttttaccaaaaaataaaatattttaagctcaatatttttgacattgcaatgtactttaaaagatgctgggattaaaggcgtgagccaccgtacctggcccttggtggaatctttagggttttctattcatacatataaaatcatatcattggcaaacagagataattttacttcctcctttccaatttggatgccttagatttcttttncttgcctaactgntctgtctagaactcccagcctatgctgaatagagtggcaagaacaagcatttgccttgttnctaaccttagaaaaaaaatncttcaccntttaccattgangatgatgtttgctgttagtttttcataaatgatctatatcangctgaataaattctatt

SEQ ID NO: 4410 - DNA, 762 bp, Homo sapiens
  misc_feature 574, 600, 689, 705, 747: n = A,T,C or G
tatagtaatacaagctacttgttctttttgcaggatcccatcgattcgggcaactgtaagaaattcttctttcaaggcagttgtcttcgtatctatcattttaccatacctggttaaaacagagtcccaggtacatattaaagcaagccttcatacatgttggccctctatctaaaagcctcttcccactcctttccctttacctggtaatccctgttattccctagatgcctgctttaaagagatttcctttggtaaatcaccctgaaccctcagactagtccagacctctctttgatattttcctcttgacattcagcatttatcccaattgaaagtaataattacatttgtgtagttattagattatctgtcttccttagtaaaaagtaagcttatgggctgggtgccatggctcatacttataatcccagcacactgggaggctgaggcaggaggatcacttgaccccaggagtttgaaaccatcctgggcaacacagaaagatgccatcaataccaaaaaaaggaaattaggtgagtgttaaggtgcaccagccactctggaggctgangtgggaggatcacttgagcccgggangtgggaggatcacttgagcccgggaagtgggaggatcacttgagcccaggaggtcgaactgtagtgagctgtgatcatgccactgcctncacctgggcaacagantgagaccgtgcctcaaaaaaaaaaaaaaaaaactcgagcctntaaactatagtgagc

SEQ ID NO: 4411 - DNA, 773 bp, Homo sapiens
  misc_feature 11, 19, 641: n = A,T,C or G
tgaaaaccttntttacaanctacttgttctttttgcagggatcccatcgattcgaattcggcacgaggggaaagaaaataactttgtgaagccagtgtattctgtttttaaaactgtgcctgcagtgcaatactccttctggtgtattttatccattatttcacttgctggtcgtcatttcacagccagctttgacatgcccgtgaggacaggagccgccgcttcagttgtcactgcagagccatcgtatgtcagttgcaatttccatctgaagctatgtctttgacttcactttaagcagaaaattttgtaccctggtggtcgagtcttcccttaaaaattgttaaatcatttggctttaatggttcaataatttggggtggcttcatggtgtttcttttcttcccagtttaaaaaaaaaactttttaagcgtaaaatctttaaggggtacacatttataagtctggctaatttctaatatgctaattaaacatttcccattttaaggttatatacagtgaggctcttcaggacaattattttctgggttgattgggcatatgtttgcccgtgtaaacacggatatgataaagtgtcagtaacaatggaaaaggtcccagaggcattaggcatctaagangatgccctcagaaacgtattctggcttgatttgtgttattaacttcagaagaacctttcaaatgtcccaatatcgttcttagtgctttgggaaaaaatatttaacacactggtaataaatttgtatcagaag

SEQ ID NO: 4412 - DNA, 795 bp, Homo sapiens
  misc_feature 19, 79, 84, 173, 187, 200, 220, 230, 232, 246, 305, 307,346, 350, 352, 371, 372, 379, 401, 454, 489, 506, 524, 526,538, 539, 554, 564, 584, 606, 644, 646, 661, 662, 672, 674,686, 740, 751, 759, 767, 770, 786, 791: n = A,T,C or G
tttgaaccctttgaaaccnatatacaatctacttgttctttttgcagggatcccatcgattcgaattcggcacgagatnatagntttatccatacaatattgcgattgtctctggtcttgttgctttcctgcactagattgtgagcaccatgacattagggatcatatctttncattgtactgttanctacacataacanactgcatgctatacgttggnaaatgttaantnaatgaatatcttcncaggctagcttttttgatcgccccaacgcctaggctagttttctctcatcctgcctcanantgctgtggtgatgcatcccgctagcacctgcagagacancccngntggtaatgttggccacagnnccagctntgctgccagtgcccatcgatgnggacatggaggcggtcctagcttcaagctgacggtgctcccctgctgatacanaaactcctgattccaaagctcattattttgttagntttatgccctgtgtctntgtatcaccacccccatngntaaagcctggtnnttatgtctggagaangaaggcaatnggagggaggaggcctaatgngctcaaaatcaccccttttttntatgaaagtgcctcaaactcatttaccttggctctcanancctgaggaatgactnnttttcttgcnanactctttggttnctcatttaaaatggacccctgggggggaatttcttttcttcaatctgacagaanctaaattttgnccctgttntcaagggnaancaccaactggggcttntactngggg

SEQ ID NO: 4413 - DNA, 801 bp, Homo sapiens
  misc_feature 2, 4, 5, 8, 425, 461, 519, 679, 766: n = A,T,C or G
gntnnccntttgaaaccttttatacaatctacttgttctttttgcaggatcccatcgattcgctcagatgccagtcacaagtcccaggcctctcatacttctgaccgactggctacaaatcaggggttcccactacctcctcagattagataatttgctggataaaactcaggaaacattattattaagggcacaactcagcaacagcccagtagaagaggtgcacggagcaagcaccggggggacgtggagtttctgtgccctcctagggtggcctcctgcccagctcacccttgtgtgtgcaaggtccccgaatcttgtagttagagtttctgtagaactcaatctctaatcctttccttttctcttcatttctcttcaggataagggaccggggggtcggtgctgaaagttccacactctangcactgggtctcttgggtgaccagccccatccagangccatctaggagggctgcttttaatcacagcgttagcattaacagttgtgattgaaangggcttgttttgaacaataaaaaatatttctatctcaggaaatcccaaagatataggaactgtgccaggaactagagacaaagatgaaatatgtcttatatcacatttcttttgaattggttaaagtgccaataagacaacaaaaaataatattaacccntttatataacacttggggttaggtggttataaaataatctaaaagatgaatttaaaagtattgggggaggatgtacataggttatantgccaaatacctatgacgttttatataagggactt

SEQ ID NO: 4414 - DNA, 735 bp, Homo sapiens
  misc_feature 3, 6, 7, 9, 19, 95, 196, 206, 265, 279, 289, 294, 320, 342,364, 380, 389, 400, 407, 438, 440, 472, 482, 495, 496, 498,515, 531, 540, 545, 548, 560, 566, 571, 600, 614, 633, 686: n = A,T,C or G
ttnaanncntttgaaaccntttttacaacctacttgttctttttgcagggatcccatcgattcgaattcggcacgaggtctcttggtgcgctttnatctgtcctctaaagcacaccctgcccctccctcctctgtcctcatgccgccttgtgcgtggtccccagctgttggtgtcagggcaaggacaaagacccgngacacctcangtctgagtcctggtgattgccaggccctggggaatgggggaagatgtggtcagaggctnttcttgtgaccggngcaagatgtntcttntgctggaccggcaccttttgtttgtnccattggtggcagatgtgagcnacatcaggcgctttctcagtgnatttcacgagccacangtggggctnatccaagccgnccagcanctgctgtgtgatgagcaagccccacagaggnanaagctgctggctgacctcctgcacaacgtcanccataacatngcggacgagaccnngnctgatgacccccgtggnttgaagcttggagttncgatttcanagcangtntggctatctganatacanctgtnagagccggatcccgagttacctgagggangtgagctcctaccntccacggtgggtgcggagnctaagaggaattctgcggtcttgctcattgcagagctccgtcatcatcatgcnctattcaaaagaccaagcggagcgcttgcacgaagtgttctgcaggtct

SEQ ID NO: 4415 - DNA, 766 bp, Homo sapiens
tatattttacaagctacttgttctttttgcagggatcccatcgattcgaattcggcacgagacagatcctccctctgcagatggtgagcagtttcccactcggctcttttgattgttctgcaattttcaatgaccatggcacaaatttatttaaagctgaaatacttcacttctattaaagcagttggctgggtatattgtttttgctgaaattattactctaggaggtaaatctaggctttatttactactttgggaaagtacatttaaaggccatgaatcagaaactaggttacaaacgttaagactcaaaggatctgtatactgaggcctatatttccatgaagtggttctctactctcagcaaatctagtattgctgaatgttgtagcattataagcaggaaaatcatcttactgcacataatctatccccacagaaacctatgacatttaggtattatgcaggcatgtgtcttcagttggctgtctccttattttaaccatgtgtccctataaatacttcagatccaaaaggttttttccacacttcgttataaaaaagtactaactagcacatatctgcattttattccgggatccacatctccaaaaagttgattataaagtttacagcaagcatagaattcaaaatttccttttttttctaaatgaccaacaatacaaactttctcatgtacacacacatgagaacacacatgcatgtcatacacacatcatgcattcatcacacaaagcaagcacag

SEQ ID NO: 4416 - DNA, 773 bp, Homo sapiens
  misc_feature 6, 17, 83, 96, 98, 106, 114, 118, 119, 121, 127, 131, 133,144, 218, 265, 293, 310, 312, 325, 327, 335, 339, 349, 350,354, 364, 371, 373, 387, 389, 398, 411, 440, 446, 462, 476,477, 485, 504, 520, 536, 539, 544, 545, 546, 547, 553: n = A,T,C or G
  misc_feature 560, 568, 572, 614, 625, 641, 649, 651, 665, 671, 684, 691,697, 708, 717, 720, 724, 749, 762, 768: n = A,T,C or G
tgaacnttgaaaccttnttacaactacttgttctttttgcaggatcccatcgattcgaattcggcacgaggttggccttttcnattcagatgtttncntgcaggangtgcctgngatnnantttggnttgntnacatgagtttnatatgcatgcgcatttttggatgccaaacacataggcagatgaaactaagaagccagatgctagagatcgcagngcgatgaattgaaactagcctaactggctccactgttggagtcattngctcaaactactccaaacttttgtttgntctactgaaaacattantnggaaaggtacagngntaatttanggcngggaagcctnnatcncgtgagagtnaggtctntntatgcgatgctggnanggaaggatnggagatgagagtnattttacgggcgcctatctcctcctcttnctatcntgccctggactgcganctcatctttcatannctcttgcntggtggtaggcccagcaancggatggattttaagnatctcagaattttcanttnatcannnntcactntcagagntccttttntttntcaagggtacccagtctaactggttagcttcttttcaatagncctccttactnacttacgcctagtcanggacgaanantaatggtaactganttactntcctccaacaaancattagntgattngactttttacncctcattcnganggcnttagaccccttttgtgcactttacncaaggatgttganacctanaattt

SEQ ID NO: 4417 - DNA, 790 bp, Homo sapiens
  misc_feature 5, 8, 9, 83, 414, 494, 626, 679, 702, 731, 777, 785, 790: n = A,T,C or G
ggtgnttnnccctttgaaaaccctttaatacaagctacttgttctttttgcaggatcccatcgattcgaattcggcacgaggnaaagcttcatgttccgcacctggggggcggatgttatcaacatgaccacagttccagaactgtcagaagataaatttctgttgttctcagccatccagtttgtggtactttgtaacggcagccctaggaagctgatgcaggtgggattgattcccctgctccagagaaaggactgttttcacagaagaggcgatgcttgaactgaatctgaagggatcaatgtggcttcccttggcaaggcatggagtgaaggtggagtatatcccaagtggggaggacagcacgtgacatggcgcagggcttatgaaacaacatgccttcttctcttcangtacttaagctacattagtaagaccagaacttagtggtgagggttgaagctggctggacaggcagttaggagtgagtcangcgatggtgagcctccgtgccagaacaacttgtaggctgtggaagcaacccgcaaagggatggcagcggtgatatatatagttgaaagatcactgtctgctgtgtagaggatggatttggaagagtcaccanagcaggaataagaagttaaagggcctgcaccagggcttgtagcatagagtttnagaaagtcttggggagaattgantcaccttgacctactgattcatttggaangtgggaatgcaatcatgggggtaagtcctctaagataggacctttnaagtgtanggatn

SEQ ID NO: 4418 - DNA, 715 bp, Homo sapiens
  misc_feature 8, 9, 606, 629, 659, 681, 711: n = A,T,C or G
ttgattcnntccttggccttttgcaggaccctcgattcgcccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgagtgcataagaatttattatttcccctgaatgttcaaagtggtgtgtgtgtgtgtgtaaaagaaccaggagcaaacaatcttaataggaatgtgcgatcttgtgtttatctttagcacacttaattagctacaacccgggactgttgccatttgaacaagttgttaagaaaatctgccatgttttgctctttttcaaaaggaatgactttaataaccatagcaacacttactcagttttgtgatccactccaagattatgggagcaagaacagatactcctgaaagcaaccctcaccttctccccgccccctgccctcacaagtcctgcctgtgtgaactgaagggtttggaagctctggtttctaggantgcccagaagctagaaagactanggtgtctagttattgaggggcaattgtcantggcagtgtgggggcaccccantggtattcgaggcactggattgctttttgnctcc

SEQ ID NO: 4419 - DNA, 750 bp, Homo sapiens
  misc_feature 2, 7, 586, 702, 709, 710, 718, 737, 749: n = A,T,C or G
tntatanatacagctcttgttctttttgcaggatcccatcgattcgaattcggcacgaggtctcatcctgaggccactttctagggccatttctggcaccagatgttttatttcagctcccccaaaagcaaaaccctgaggcagggatcttggttgaagtggggaggggatcccagaaagtggggtgagggtacggaggcatgaggtaggaaagggaagaaaggagataaaatgtgtgttaatgagcaggttagcactgtggaccaccacgctcaatcccactgagacgtgaggaagctgggaatgtatccaccaggccttaatttatcaagatgaggattactcctgagatgttaactccttgttgttggacctaggctgaacatgcttccgtagccaagaaagggcttcaggtgaagagacacagagaaccttctgcaggccacattccaggctgggataaggggaattgggtgtgacatcaatagcatctcatcccacagtgaactaagaagatagaagagcaaatgcaaggaatatttgcatgctttcaatacttactcatcaaagggtcgactcgacttanaagaaattacaaatcctgcttaccattttcagcccaatatgctcacgttggccaagccacagctgcctttaaatagtaccaactcttgaaaaaaaaaaaaaactcgagccctttanaactatnntgagtcgnattacgtagatcccgaccntgataagatccnt

SEQ ID NO: 4420 - DNA, 749 bp, Homo sapiens
  misc_feature 8, 104, 138, 147, 249, 264, 268, 270, 278, 280, 313, 329,330, 333, 341, 342, 350, 355, 412, 434, 464, 467, 469, 483,511, 516, 561, 586, 609, 622, 666, 680, 703, 724, 725, 726,731, 732, 734, 743, 747, 748: n = A,T,C or G
tttgaaanccctttgctacttgttctttttgcaggatcccatcgattcgaattcggcacgaggcgaaacaccactgcaaggtgaacagcctgggttactagcanaaaaacatcattcagtctgtaaatatttatgaanatctgtganaggcactacccttaccctggagctaacctgtgacccagagagcaaggactcttgcttttacagaacacatattcttgtggaatgagaggggctatcatcaantaagcaaatcattcnatgnantgtgttantntattttcccattgctttaaagaaatgccttttnctgggtaacttataannaanagaggatnnattggctnatggntccacaggctgtaccataagcatggtatcatctgctcagcttctggggaagcttcangaaacttacagtcatggcaganggcaaatgggaagccagcactttacatggncananaaggaggaagaganagagagaggcacgaggtggtacacactnttaancaacctgatctcgtgagaacccactatggtgagaacagcataganggaatgatgtttaaccattcatgantaaccaccctcatgatccaatcncctgcaagcatgnaccaacttcaacactggggattacaatttgatgtgaaatttgancagggacacaaatncaaactcatcactaagtatcagngctttgggaaaaaaatacgtnnntccanncntgatagatncctnnt

SEQ ID NO: 4421 - DNA, 745 bp, Homo sapiens
  misc_feature 2, 9, 349, 350, 355, 372, 383, 503, 508, 557, 559, 570, 576,577, 601, 602, 604, 609, 641, 644, 659, 660, 662, 668, 670,679, 680, 681, 685, 688, 703, 704, 709, 710, 712, 713, 714,715, 720, 721, 724, 725, 728, 730, 731, 732, 734: n = A,T,C or G
  misc_feature 736, 737, 738, 741: n = A,T,C or G
tntataganacagctcttgttctttttgcaggatcccatcgattcgccgctgcctgcacggcgatgagaacagcgaggtgtggcggagcctgtgcgcccgcagcctggcagaagaggctctgcgcacggacatcctgtgcaacctgcccagctacaaggccaagatacgtgcttttcaacatgccttcagcactaatgactgctccaggaatgtctacattaagaagaatggctttactttacatcgaaaccccattgctcagagcactgatggtgcaaggaccaagattggtttcagtgagggccgccatgcatgggaagtgtggtgggagggccctctgggcactgnngcagngattggaattgccacanaacgggccccnatgcagtgccaaggttatgtggcattgctgggcagtgatgaccagagctggggctggaatctggtggacaataatctactacataatggagaagtcaatggcatgttttccacagtgcancatcncaccaaaatatcagataggagaaagaattcgagttatcttggacatggnanatatgactttngctttnnaacgtggatatcagttctgggggnngnttttngaggactccaaagggctggttattcccagcanttnatgctgtatatgggnncncagaantnactttggtnnnactnggnaaacctttgtacggnnacaanngnnnncttgnnatnnctncnnnangnnnganaaat

SEQ ID NO: 4422 - DNA, 752 bp, Homo sapiens
  misc_feature 5, 104, 107, 130, 131, 136, 140, 141, 150, 155, 157, 164,167, 169, 175, 242, 249, 271, 282, 302, 332, 333, 338, 340,341, 342, 347, 358, 391, 393, 398, 412, 421, 429, 430, 437,446, 450, 470, 477, 479, 517, 527, 530, 532, 536, 542: n = A,T,C or G
  misc_feature 543, 545, 561, 569, 571, 592, 604, 627, 647, 654, 665, 668,681, 686, 718, 725, 727, 731, 745: n = A,T,C or G
aaatngctaggctactcgttctttttgcaggatcccatcgattcgaattcggcacgagcccagctctttgggaagctgaggtgggaggatcactcgatcccagnggntggagacttgcctgggcaacatnntgcancctnntctctaaanatatntnttgcatngantngcccgncatggtggtgcacgtctatagccccagctacttcagaggctgatgtgggaagatcccttaagcctangaggtcngaggttgcagtgagctatgatngcaccattacnctccagcctgggcgacagancgagactccgtctcaaaaaaaaaagaaaanngactntnnncgaanggagacacgtnaaagtcttgctaattgtcatatccactcccaantntagcntttctggatgatgnccattcctnctgcaatnnccttatnatccatctnaacnttttgcaacctatgaactgnttcgtananttaattactaccaatacaccctatgtacaggagcatanggaaatcaanaanantgangaattnnantctattaaaggccacnagaatggntnacacctgtaatcccaacactntgggaggccacngcgagtggatcacctgagatcangagttcgagactggcctggncaacatngtgaaaccccngtncctactaatggtncaaanattaccaagccgtggtggcacgtgcctgtgancccaagntnctcnggaagctgtagcangagaaat

SEQ ID NO: 4423 - DNA, 725 bp, Homo sapiens
  misc_feature 11, 17, 21, 26, 34, 106, 509, 585, 607, 665, 675, 693, 704,708, 710, 724: n = A,T,C or G
gtgttgaatcnttctcncatnaaacnctttgganacccaccgattcgaattcggcacgagggtgattgggctggttctgtaccgggtgtactccgtggggggcgtnatctggcaaagccttggaggtgggactgtggaggcaccattgattgaactgtgtcccctgcagttcacatgttgaggcccaaacccccagtgtggctgcatttggagtagggcagtaattatggttaaatgaggtcgtatgggcgggtgctgatccactaggattaggatccttataagaacctgccaccttctctctgccacgtgaggacatggggagaaggcggctgcctcccacccaggaggagcccttactggacactgggccctggctgcaccttgaccttggacttctagtccccagaactgtgagaagtagatttctgctgattacgctttcctgtctgcggcctgagctaagacagcggcgcttggggagaagcagaatttgaggagctcctcantggcaggctgccctggccctgctgtcagcagaggggaatggccatccatgctggcccctaccagccgggccttcantgagctccccgggtaggtgaanctctctaactctgtgtcccccgcaaacaggcccacgagccaacgcctatggggtggantgaaaattangaagaaacattacccgangggtcactctntttnanaagacctcaatggnt

SEQ ID NO: 4424 - DNA, 737 bp, Homo sapiens
  misc_feature 1, 5, 20, 36, 608, 626, 659: n = A,T,C or G
nggtnagttaatttagcctngtgaactcttggaacnccgattcgaattcggcacgaggagcagagatggccacagaagccagagaagctggacgaggcctttttggcaacaaaagagtgacttaacgcagttctaatgtcctacatttttatgctcttatcctgcagttacaggataagtcaagatacacggtctacaaagaaattttgttctaattttataatagtagagatggggtctcactatgttgcccaggctggtcttgaactccagggctcaagcaatccgcctgcctaggcctccctaagtgctggattacaggcatgagccactgaacctggctgtacaaagaaatttatggcagagagatatgctctttattttggggaggtggcatggcattatcaaaatagcatgggctttggaatgaaaaccttggtgaccgtgagcaaaggaagcatcatttgcttgtcttcaaaagagggatagtgcaacttaacctgcaggagtaaatgagataacaatataatagtatttattaacagagtcttgctgtgtacctatagtacatcaagattccatttctactttttttcctttttcactgnctaaaagttttaataacnttttaaataagatgatggtatatcaaaagccanttataggctactaaatatttttaattatttcttaagaaaaaaatttaagctaaaagaaccaaatgggatatttttttg

SEQ ID NO: 4425 - DNA, 718 bp, Homo sapiens
  misc_feature 3, 21, 516, 653, 654, 657, 658, 659, 660, 661, 662, 665,666, 667, 671, 672, 674, 675, 676, 678, 679, 680, 682, 683,687, 688, 693, 694, 695, 696, 697, 698, 699, 700, 706, 708,709, 713, 715, 717: n = A,T,C or G
gtntttatcctgctcttgcantcgtaggaccctcgattcgaattcggcacgagccctccttgcccagagcaggcattgctcatccactaggcacttcttcctgccaaggcacctcttcctgccaagtcagtgtctcacgatccctttcaacacagccacgaggaagccatgatacatcaactggcactggcaaataaaatcaaacctatttgcctatccagtcttatcccactttgttgttttctctaagtagttggaaaacaacatgtccagagaaaaataccagaacttattctgagtatgttcttcagagcaaacctttagaatcttaatgatgtttagacactcaggaatgagtgaaccagttgcactgatagaatcaaaacaatactgcaaatattagtcatgttgcctattatgaaatatatctgtgtgtgtgtatagatatgaaaaaaaaactctaaagtctgagttaaagagccctgccaggtatagttaaatgctctctaacctatnaagaattcaattccatttggcacctccaaatctggtatccagaaggaagaccagagaagcagcccccgatgcaatttgcaagatgtgttcctgtctgggggtgccacacgttaacagcagcttaaaaaaaaaaaaannttnnnnnnatnnntaannannntnnntnnattnnaactnnnnnnnnttcttncnntttncnant

SEQ ID NO: 4426 - DNA, 721 bp, Homo sapiens
  misc_feature 2, 3, 11, 28, 623, 659, 673, 678, 699: n = A,T,C or G
tnncttaatcntgctcttgcatttctgnggacccatcgattcgcccaagtgaaaagactgctgtcagatagcacttgccttccccatattattcagctactgctgacctttgaccctatccttgttgagaaggttgctattttgttataccatatcatgcaagataacccacagttaccccgcctttatctgagtggagtatttttctttatcatgatgtacacaggttccaatgtgcttcctgttgctcgatttttgaaatacacacataccaaacaggctttcaagtcagaagagacaaaaggacaagatatttttcagagaagtatacttgggcacattctacctgaagcaatggtttgttacttagaaaattatgaacctgaaaagttttctgagatttttctaggagaatttgatactccagaagcaatctggagtactcctgggctggcaggcgaaccgactgcggaggcgctacttggactggaggaaaaggaggctgcaggacaagctggcggcgacgcagaagaagctggacctggcctgagactctgcgccttccgcccattctgtccccctcatggccaccttgccatgttcgcgccggaccccggtcccgncggcgcccagaaccaggcttgccacacagtccccgnctgccatggccggntcttnctggaatgttgcttgttgaanatgcatatagactacccggaaa

SEQ ID NO: 4427 - DNA, 723 bp, Homo sapiens
  misc_feature 8, 10, 15, 40, 652, 668, 699, 722: n = A,T,C or G
attgggtncngctcnttgttctgctgcaggatcccatcgnttcggataatacttgtggatcttgatgctaaggagcctgctccttatgcatcaagaaacacataaccaggtacagaaactctgcagagtactcatgagtggcaggaggagctgtaccacaagaaggaagggctcagggaaggggacatgtcttactcacttgttagcttccacggatgggatgtggcagtgctcatgaaaggatcttggacaagtgtcgcagcagaacagccgtccccatttgttgcacacctcacatatatttgagttttccggctagaaggggagatgtagacatcaccgggatcagtgagacccttggaccctagaatatgtgacctttttatgtatcaagggcacacttgtaaatttctgtcctcaaaatattaaagattgctgagtggagatctcagaagacattttggtctgcggcaaagttcagtagatagtggctgtgtgtcaggccagaaaagttttctttatgaaaccagagattctgacatgatgactagtgacaaaaataggatgaattagagattttttgagcaatttattaaacagctgggaaaacctggcccagaaatagtgtcttttctagctgctacatcgtatnctttaaactgacttgncaagggtgatttactgagaatttaatatgantggaataaacttctgagatatcnc

SEQ ID NO: 4428 - DNA, 717 bp, Homo sapiens
  misc_feature 7, 8, 24, 25, 486, 487, 489, 491, 492, 493, 494, 495, 496,497, 499, 500, 501, 503, 504, 505, 508, 509, 512, 515, 517,518, 522, 523, 524, 525, 528, 532, 533, 539, 540, 545, 546,549, 550, 556, 557, 558, 559, 560, 561, 563, 565, 566: n = A,T,C or G
  misc_feature 567, 568, 569, 570, 578, 581, 583, 584, 585, 586, 588, 589,590, 592, 594, 597, 598, 599, 600, 601, 602, 607, 608, 609,610, 615, 617, 619, 622, 630, 637, 638, 642, 646, 647, 650,653, 658, 659, 661, 662, 663, 664, 665, 668, 670, 671: n = A,T,C or G
  misc_feature 673, 676, 677, 681, 682, 685, 686, 687, 689, 691, 693, 694,695, 697, 700, 702, 704, 705, 707, 708, 709, 710, 714, 716: n = A,T,C or G
tggtgcnnggtccttgctcttgtnngctgcaggatcccatcgattcgaattcggcacgaggtccaggccaataatcagttggttaagtgaaaaaagtgtttaaagtgaagaattataaagaaagtcattatggatctcaaacttttactttaattgaaaccataaaaacatatattcactcaccaatgttttatgcagggttaatgccttctctttaaaattggacttctgattggatttctacctcatttttcttatgtaaacacttatagttcacttttgatatttatgggttttgatttttgaaacaaagggaaaatgttaaaacatatactgttcagtaatgccacctaatccatgcgggatatgtcccaggacccctagtggatgcttgaaaccacagataccaaacatgattactgtcagtcggaacatttttttttttttggagacagagtcttgctctgttgcccaggctggagtgcnntncnnnnnnntnnntnnnttnnaantantnnttcnnnntantccnnttaaanntttcnnatnntttctnnnnnntncnnnnnntcttattnatntnnnntnnncntntannnnnnttttnnnnttcantnantantctttttncaccttnnattnttcnnttntcnttttnntnnnnnttntnntnttnntttnnttnnntntntnnnantantntnntnnnnctcntnc

SEQ ID NO: 4429 - DNA, 746 bp, Homo sapiens
  misc_feature 7, 8, 10, 97, 100, 103, 486, 507, 583, 645, 651, 658, 668,684, 700, 724: n = A,T,C or G
aaagggnntnattagttatccctttccaatcccgtaggatcccatcgattcgaattcggcacgagatgcctgccagctgagaggcagttggattccnttngcngagcaggcatttcagcagattcagcagtcagagtgcaccaagaagggtgctttagtttggagtttcaaaaggccatactgtaatagtgaaccagaaatcaagcagccctcagaaagactgaaacgcatctacggatcatctcaatctgattgcataaaggtggttcaagatttattagtgctttttactcgcctctccaatttttcatatataatgtccagcaccacatcaaaaataacccagcatagatggagataagacactatcactaacacaatagaaatagatccacaaaagatttagatcagggatcagcacatttattatataaaaggccagataataaatatgttatgctttgttggtcacatacagtctcttgnatattctttttctatttttgntctataaccctctaaatatataaaaactattcttagcttggagatcactcaaacactttctctggcataatcaganatatcttcaaactatgcttcaaatgttcaagggaaataactgataagattgaaaaattccanggagangcacaanaagtcattanaaaaaaaagcccctanaactatagtggagtcntattaccgtagatcccgacatggntaagatccattggtggagttcg

SEQ ID NO: 4430 - DNA, 728 bp, Homo sapiens
  misc_feature 11, 29, 615, 694, 696, 713: n = A,T,C or G
aggggttggangaagccctttgaattccntcggacccatcgattcgaattcggcacgaggttctgagcagttagtacgtggcagttgtattattagaggaagcctgtcttgtttttttttaaataagctgatagagtgaggattcttttaatcaagactgtttgggattgaattgccactcctgcttaccagagtgtaggcagtttttcttaaactttccaagaagactggtgtcctcatctaaaatacgaaatgcttacagtaattgcctcatggggttgtttggggtgactaaatgtagtaggatttactacatagtaagttctcaatacattgtagctattattattagttcggtagaaagaatgtgcagattcttatgagtttaagtaggctttcggggagatagattgactctggtcttttaaaagttaattttgaagttgcagttttgtgattaagccttaaatctgttattctttccttctgaaatccttaaaaacagaatgtttagtagaaggtgataaccagatttctttattccaagaactctttgctctcatgtctaacctttattttcctggtacttactgatgccagaagcttctcttagtnaatataatacatctcctctctcctaatttgctccccgtctttccttgtaagggaaaagtaaatttactttccaagcctnanggttatttatggattangtgaaccactgaaat

SEQ ID NO: 4431 - DNA, 787 bp, Homo sapiens
  misc_feature 617, 736, 744, 751, 757, 767: n = A,T,C or G
ttttgaaaccctttatacaagctacttgttctttatgccggatcccatcgattcgaattcggcacgagggcagagtaagtacggtaatttctgcacccgaatgggtagtgttgcctttgaagtagtcaccttgggaagatgtatgtttattccagtgaagctgaccttacacagaacattcctagaaccctctttagaaactgtcaacttgtaagggtcttcagtgttggtaaatctttgtcctttaagggtagatctattttttgaggaatgatttttttttttaacagctaaagagcattagaaaataagtctgctaaataaaatgggtgaagcagctcaggatgatcttggtgggcaggaggaggggttggataaaacacaaggtctgactataaagttgtgaggcctcttgccttgcatggcttcaaaggtaatcccaaaggggaaccctaagtgttcttggcacatgcaacatcaagaaaataactccaattatgctaactcttgagtgcatatgttctagtgtatttggttaaaaaggtggctttgttcattttcagtcatatttcgtataagcagaaatggaaaactccatctctgtgatttctcccaanggaaagatctcatctactgcttagagaattaaaatgaaaagcacttggtgtcatgtctacattagccccccccccccccaaaatgtgccaatgggtaattcctggatacctgagtcttncccgtttnggaaaantgggtnaaggaccctntaaaactatagtgagtcgta

SEQ ID NO: 4432 - DNA, 744 bp, Homo sapiens
  misc_feature 2, 3, 4, 8, 13, 14, 16, 19, 24, 552, 629, 649, 662, 689,690, 700: n = A,T,C or G
tnnncttnatttnnanccnttggntctttctgcaggatcccatcgattcgggagatttcaacttaacttgaccactgcactccagcctgggtgacagagcagacaagactgtgtctcaaataaataagtaagtaagtaagtaaatatcctgtaggtatctatgtgactcaaggctagtcactttcctatctatgctccagttttctcatatttgagacaagagacttgattttagcataaaggtgagagttgaagtaatgagtgtgaaagaggaaagggagaaaacatacagagaagagcagaaaacacaagcagctggtaggcagagaatgcagaaattcaagttagagctgttggaagatgtggtaggctgactaatggtgccccaaaaatgtctaagtcctaatccccagaacatgtaaatatgttaccttacagggtaaaagagactttggggatatgattaatttaaggatcttgagataaggagattagcctggattatccaggtgagcccaatataatcacaagcatccatataagacaggcaanagagcagaatcagaataggagatgtgatgaaggaagcaagagattgcagggattccaggaaggttctgtgagccaangaatgccaggtggacccctngaagctgaaaaangcaaggaaaatggattcttcttctcannagcccttccncttaagggacccagcccttgccagcaaatttggccaacttcact

SEQ ID NO: 4433 - DNA, 858 bp, Homo sapiens
  misc_feature 7, 32, 37, 178, 192, 202, 207, 211, 215, 216, 231, 256, 261,264, 270, 278, 280, 281, 285, 300, 301, 306, 308, 310, 316,333, 338, 339, 345, 347, 352, 355, 357, 358, 374, 383, 384,395, 415, 419, 430, 432, 443, 447, 454, 457, 458: n = A,T,C or G
  misc_feature 462, 469, 474, 476, 483, 485, 487, 495, 504, 505, 516, 519,520, 521, 526, 530, 537, 538, 541, 542, 544, 547, 550, 555,562, 566, 569, 570, 573, 574, 585, 586, 593, 594, 600, 603,606, 615, 616, 619, 624, 641, 643, 644, 645, 656, 671: n = A,T,C or G
  misc_feature 674, 675, 676, 678, 679, 680, 685, 688, 695, 696, 698, 704,707, 711, 712, 719, 728, 731, 736, 742, 743, 746, 747, 754,755, 759, 761, 765, 772, 777, 780, 784, 785, 787, 791, 794,795, 803, 806, 809, 811, 816, 836, 838, 843, 847, 852: n = A,T,C or G
  misc_feature 853, 854: n = A,T,C or G
tttaaanctttaaacaagctacttgttttttntgccngtatcccatcgattcgaattcggcacgaggtacttcctaggagtggttgcatttgggaatggaattgttaaaacttgatgcttaggagcgaatgcagactattcattgggtgtttggggtgggggaagggggggtgggcanaggaggtatgcacnggagaggggntctgngctnctcnnattattgcacaaccnctaaccattgttctataactgcatnaacanatnataacngggccttncnngatntatcttaacgcttannttttncnanatatanatgtaactaatcactcnctttnngtaatnanctttnccntnnttttgtaagaacgccnctcctctgnnactgacctttnttacttccccccccttgccncctngaccttcctgntntttctcacgtngatngtggcanttnnggantaacatnaatgntnaaaggcntngnttcttatntaaaatttnncactctccacnatnnntttangatnaaaaccnnctnntnttncanaaaancgttttnctanttnnaannaccctttttannatttttnnaacaanaanctnttatttttnnttnccatnctaaccttttacaaaantnnnggttaaccccnttttttatataaaanctnnntnnnttatnaanaattaannantatttngtnaaannccctttnaaaaataanttnaaaangccctnnttnnatgcaannattntnaatntgtttanccccnccntttnncncatnggnnttgtcctngcnttnancaatntaccttcattttaaaaaaangncccanattnttttnnnacct

SEQ ID NO: 4434 - DNA, 767 bp, Homo sapiens
  misc_feature 7, 9, 11, 25, 35, 37, 38, 52, 57, 79, 90, 92, 97, 98, 101,102, 105, 109, 110, 113, 126, 127, 138, 142, 145, 155, 163,180, 187, 190, 203, 207, 212, 244, 246, 255, 270, 272, 274,281, 286, 287, 312, 321, 323, 325, 328, 339, 348, 359: n = A,T,C or G
  misc_feature 360, 366, 370, 371, 373, 375, 381, 389, 390, 394, 399, 403,410, 421, 425, 445, 447, 457, 460, 483, 486, 498, 529, 578,583, 587, 592, 600, 602, 606, 607, 620, 630, 636, 643, 649,650, 671, 675, 676, 693, 696, 698, 703, 707, 708, 715: n = A,T,C or G
  misc_feature 718, 719, 723, 726, 728, 739, 741, 745, 746, 754, 756, 758,766, 767: n = A,T,C or G
tgtggtnanangaactcttgcaatnccctttgcgntnnccgcaggatcccancgatncgaattcggcacgagggccacnccgcctgtgangnatttnngtnnctntttnntgnacctggcatcctnnttccttccccncctngcnggcaccgccnaggaccgncggccgggggacgagcncggagcngcngccaggtagaacnatanactanatagcactgaattaacctgcactgaaagctgngnacctgcatnatgtgcactcatgangnangtgaccntgtcnnaagtgcaagtgcaagtccagaaccnatctgctgntntnacngggagccaaanactgaacangaaccagtctnnacggtnacanncnangatgantatccctnntacnactanctcnctgcccnttgaaaatgcnggtngacccattcaaaacttatgntngacccatctncanatatgacatgcaccagtgcaagntgnacaaaagcatancccctctgtagaactaaagcacctgtgcctnaaacttgtaaaaaaacccaatggtttaaatccgggaaggacccttaacncatcnggantgccngtttaacnantaanntaccatcatgaanaaggaggtgncatatnccaccgngggtannttgaccccaattgccaaattncccnntttactttatcaaagtnggnanctttntggnnggagggnaanntatnttnantggcaaatgcnanaacnnccaaaagntncnaaaaaacnn

SEQ ID NO: 4435 - DNA, 732 bp, Homo sapiens
  misc_feature 2, 5, 14, 22, 366, 455, 466, 497, 528, 547, 554, 607, 661,666, 667, 709, 725, 730: n = A,T,C or G
gnttnttttaaccntaaggaancctttgatgcaggatcccatcgattcgaattcggcacgagggcaaatagccctaggagtcccatttttttaagctgagggaaataattttcaagaagcttgtcttactagtagcatcattcttttttactggctcacagcttggaaggggtgatggtttttcctatgaaagctaacaacatttgagcagatccagtgtgctggtgagtcacagtgaaagtgtggagtgctaaggaagcctcctggtggaaatgtaagttcagagaaggtctgcagaaaatacagggtgaaatgttatcaaggagccagggtattatttaagaagaggagggaggggaaaaatanaaaatcaaatacactaatagaagtaaaattccctattcagaaaaactagtgagggctgagctccagtaatcagagagaagtctaatcangtcactactgncatgggaggacatagtcactctctctttcangagcctatgaagcttgcgagagctcagctanggaataagggtggccaganacagcancattaactggcacaaatctcaaggggcctgtggggcctgaaaaaaggaggatnacaggacatgctgacagtaaatgcttcattctgtgcctaacaattttccacttncctgnngactttcctcaaatggatttacttaaacttttcccaaccttnaacaggttaacttgcntccanct

SEQ ID NO: 4436 - DNA, 823 bp, Homo sapiens
  misc_feature 2, 4, 5, 12, 19, 688, 703, 719, 726, 736, 760, 768, 771,784, 791, 798, 813, 816, 822, 823: n = A,T,C or G
tncnntttaatnccatcanctcttgttctttttgcaggatcccatcgattcgaattcggcacgagggttcatgcagtaagatttgttgtttatttgtaaatagaatggtattctatttcaaacttttaagacaaacctgttgccgcaaggctgatgcacattggatgatgactgttttctggttccagatcttgtctttgtgatataggagttatggaatgagccctggacaggatcctaagatccgggtttgttcctacttctactcattaatagcagtttgacatttaatataggaataatgttaacttgtcacttaaaacaagattctcttcatcttgttttcaagatttcaagattcttttaaaaattagcatgaagtatgggataatgattggggaggaagtatttttaaaaagccttcttgagtttttatgcatattacatttttattcaataaaaaattccccattgttttattgaaatggattagttgtcgatcctctgaattagacatattctttaaaaataagatccgttgtcagccatctaaaatgtttttataaattcatacttacattcttttttgccggttgcagtcagcctttagtgccaagagagaacattacagcatggatgaatgcaattggtttgatcatcactggcctccaagtgagttaataattgngaattggacttaagngatgaaaaacaagccngctgttncctgtcaggnctctagaactatagtggaggccgnttaccttnatncccgccttgaatnaggaatnccttggnggagtttggacaaanccncaactnn

SEQ ID NO: 4437 - DNA, 1035 bp, Homo sapiens
  misc_feature 1, 2, 4, 5, 8, 295, 299, 301, 309, 310, 311, 312, 318, 322,324, 330, 332, 338, 341, 343, 344, 346, 354, 357, 365, 366,367, 371, 372, 373, 376, 377, 379, 381, 382, 383, 390, 398,400, 401, 409, 415, 418, 421, 423, 427, 428, 429, 433: n = A,T,C or G
  misc_feature 436, 439, 443, 454, 455, 459, 466, 469, 477, 481, 484, 489,492, 493, 494, 501, 508, 511, 514, 516, 525, 532, 533, 535,538, 546, 549, 554, 560, 565, 573, 575, 577, 579, 585, 586,589, 590, 598, 599, 605, 607, 608, 618, 623, 625, 629: n = A,T,C or G
  misc_feature 631, 636, 637, 641, 646, 650, 651, 657, 659, 660, 661, 662,663, 666, 667, 670, 677, 679, 680, 681, 687, 688, 691, 695,700, 703, 706, 709, 713, 716, 717, 719, 720, 726, 729, 732,733, 737, 741, 742, 750, 751, 755, 756, 760, 761, 764: n = A,T,C or G
  misc_feature 767, 774, 776, 778, 781, 786, 788, 802, 805, 811, 815, 816,819, 822, 833, 836, 838, 844, 853, 855, 857, 869, 871, 873,874, 878, 880, 884, 886, 888, 890, 891, 892, 895, 897, 898,899, 900, 901, 902, 903, 908, 909, 912, 918, 922, 930: n = A,T,C or G
  misc_feature 934, 944, 950, 951, 953, 958, 959, 960, 964, 965, 967, 968,971, 972, 974, 979, 982, 984, 987, 988, 991, 996, 1001,1004, 1016, 1018, 1025, 1027, 1028, 1029, 1032: n = A,T,C or G
nncnnttnattccatcagctcttgttctttttgcaggatccctcgattcgaattcggcacgagcaaaggattgagagagaaaacttggctttattgaaaaggcttgaggccgtgaaaccaacagttggtatgaaacgttcagaacaactgatggactatcatcgcaatatgggctatctcaactcatcaccattgtcaagacgggccagatccactcttggccaatatagcccattaagagcttccaggacatccagtgctacgagtggtctcagttgtaggagtgagcgatcancggntntcccttcnnnngcatcntatntnaatacntntccctnttncnntngttctgtnttnttttatannnttcnnnccnntntnnncctcttntccctgtncnntttgattnttttanttnttntntttnnnctcnttnctnttcnttttactatcnnatcntctttcnttntttctttntttntanttctnttnnntcctttncttcacnttntantncttcgcctntttaacnntnttntttatttntcnttctngtaatntttcntttatatntntntntttcanntcnnttaattcnnctctantnngtcctttccntattntnattngncctannatantttcnatannttctcntnnnnnctnnttnctatttntnnnaattcnngtntgtntcatntcnctnctncttnctnntnntttttnttnatnntatntttnntatcttcnntctnncttnntanatnttatctntntntcnttctncntataaactatactnttnatcttnctcnnttntcntatctaatctncantntattantttctctantntntcatacctcgancnannctcntnacgntntntnnnatntnnnnnnncttannatnttcatntaanatattatnatantttatttctnttctanntntctcnnnatanntnnctnnantctanttncnttnnttntatcnttttnaangtattttttttnantatctantnnnatnccc

SEQ ID NO: 4438 - DNA, 992 bp, Homo sapiens
  misc_feature 4, 6, 8, 9, 13, 21, 26, 28, 29, 79, 90, 118, 190, 267, 357,384, 459, 467, 476, 495, 497, 498, 499, 500, 556, 600, 604,631, 650, 664, 701, 761, 775, 843, 912, 923, 926, 934, 941,970, 987: n = A,T,C or G
cggnangnncgtnaacggaancccgncnnttgcggatccctcgattcgaattcggcacgaggaactagtcatgccaggnactaaattttngggggcagtgagggatctggtgcagaancaacctgatcaatgggacaggacagggagtctcaaaatagccataactgcatataaacatctagtatatggntaccacagtattcaattcaagggggcaaaatagagactttttaataaatggtgttggaataaattatagttatttgntcaaagagttataattttatgcattccttacacccatgcactagatgatcctccaaatggattaagactgaaatgggaaaagaaaaaaanggggggaattccctatatcatctgggnctaagggaaaaaattttttccaacctatggacccaagttcccacatggtaacctggaaaaaattaaaaaaacccnggacctcntcctcctcntaataataatattaataantnnnnaaccttttccaatggggccaaaaaaaaataaaatccccaatttaaatggaaggggnaaaccaattaaaaaaaagggaacccaaaaattaaaattaaaaanccanggggaaaaaaaaaaataatttggggangggaataattaattaattnaaccaaaaaacctnccccaggaaaattccattaaaaaggaaccattccttnaaaaataaatgggaggaaaaaaaaaaatgggaaaaaaaggcccaccaagaaaaaaatttncgccaaaaaaaggnatggacctgggacaacctcaaaaaagggtattaaaaaaaatccccttaaaaatatgtaaaaggggttnaacctcacacatactagggaaaaattaaaataaaaattattccggagaaaaaagccacccatcagaatngacaaaaaagnccnaaagcctnggacaanagacccttttggccaaggctggccaggangggaaaaaaaaaaaacncccct

SEQ ID NO: 4439 - DNA, 812 bp, Homo sapiens
  misc_feature 1, 2, 4, 5, 6, 14, 637, 673, 708, 711, 730, 732, 737, 752,761, 787: n = A,T,C or G
nncnnntttaattncaatcaagctacttgttctttttgcaggatcccatcgattcgaattcggcacgagcttcttttcatttttcttaaactaatttctcacaattttcatttttgtcctgagacttgaagggaaagtaagttttaatctagaccatattatttagttacatctaatctctctagacaaaagacagtctggagagtactctttagttctatttattaattttgtctctagattgagccagatttccccatgcatagctggcattttattggcctctgcagaattgctttttctggattggactttggtaatccatatgaaaatctctatgaaatttaattgctcgccaggtgtggtggctcacacttgtaatcccagcactttgggaggctgaggtgggcggatcaccagaggtcaggggttcgggaccagcctggccaacatggtgaaaccccgtttctccccagaaaatacaaaaattagctggtcatgagggcacacactgtagtcccagctactcaggaggctgagggggaagaattgcttgaacccaggagatggaggttgcaatgagtgaagatcgtgccactgcatccagcctgagcaacagagtgagatcttgtctcangaaaaaaataaatttaattgctgtggatctgtaaanggtgtttatcgtaacagttcataatattctatttnaanatgcgtgggagaaattttntntgganccagttatgcctttnctggaatgntggttgggtttaccttaaggccactnaatttcagctgatggtttttctggt

SEQ ID NO: 4440 - DNA, 830 bp, Homo sapiens
  misc_feature 1, 2, 4, 5, 6, 14, 21, 660, 752, 758, 764, 804, 813, 830: n = A,T,C or G
nncnnntttaatancaaacanctacttgttctttttgcaggatcccatcgattcgaattcggcacgagcttcctccaggcattataatattaggttaatttagaggagcatatttatatgtggagttacattgtgttggccattcaggagactgactgtgaaagaatccaaactttatatttctgccttgccagtttttttttccttttcttcactccatttgagacactcttgacctaatccagtaaactctaattaatagtcttggtaaattctgtttcaagccatcctgagtagcgtcactgacacccgatctgtttcagtaaggtcaaattagcatcctttactatttttctggcatttaaatgaatgactttgctatggtttttcaagtgtttatagtaaatatgtccatttgatggaaatataaatatgcattaagtgtaagtggctaggcacaccctgctgtcactttttatggtaatcaagtgtctttcactttctgttgtttttaatagggaccagctgacaacgccacattaaaaccacagggactcaaaagataactcccccaccccctcacccggcactgcttttatcttgcaaaagtattcatgtttttctcttagtatgccaattacacccgttctctgacatttncacttatgtactcatgggaaggaatgaatgggttactcaaactgggaccattgaatttggggacacctggtggactccactggccttaaganctacanggttanttggaaacagtggggcaccgtgggttgacttggccttttntttgccagngggttttgggccttgan

SEQ ID NO: 4441 - DNA, 820 bp, Homo sapiens
  misc_feature 1, 2, 4, 5, 660, 693, 720, 769, 772, 789, 796, 799: n = A,T,C or G
nncnnttttaattccatacagctcttgttctttttgcaggatcccatcgattcgaattcggcacgagagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacccagtgttctgaggtcacatgggtttggactgtctcaatcagaaagattaatgactgttatcaagaacatgaacattggcttcctccatagagaagaaaatcagtatctgagttgcataccaggcagtattaaaaatctaacangtctgtttggcccattgatagatctcaaatggngtctccttctgggtatggattttgccnttggttaccctttctcaatgtaatggaagtattttacaagccaattggnggnggaaatggtgctcttgncttttcntgnttacaaactactttcacattg

SEQ ID NO: 4442 - DNA, 856 bp, Homo sapiens
  misc_feature 2, 3, 4, 5, 6, 11, 22, 579, 585, 592, 625, 657, 659, 688,690, 695, 718, 768, 773, 789, 793, 824, 832, 838, 839, 840,841, 842, 843, 844, 845, 846: n = A,T,C or G
gnnnnntttanttccaatacanctcttgttctttttgcaggatcccatcgattcgaattcggcacgaggatagaataaccaatttaaaatgtcttatagataaaatctagaatgaagctttggtaagaagtctgagctacgtacataagattatcagcaacatatatgttaaggtggagccatttaaagaaagaacagaagggacctatgatttactgattgttgaaaatcaaaataaaggaggcagagaaaataaagattgtgagtcagcaggacttttgtcttattttcaagtggatttattgattacttttcttcttacagccaagtgcaagatttgtgaatgggcgtttgaaagtgagccactatttctccagcatatgaaggatactcataagcctggagagatgccttatgtttgccaggtattgcctttttctccagggagttttagcagttttgctctcaggaagaatacaaagaatctactaatgaatattgttgaccacctactgcatacactcagtttaggaactctgagtaggtacagaagaaatagtaaacacagtttatcttcanggtttncatgccnggagaaaaacataaaaagaacatgttccctacnaaaaaaatttttttttaattaccttgggcatngngggtgcaccactgtagtccctagcttacntngggangcttgaaacaaggaaggctcgcnttgagcctcaaaaggataagtccctaacttcctcaaggaaggcttccggnggaanctatgaatcatgcctncaancctggggcaacaagtggagaattttggcttntttaaaanaaaaannnnnnnnnaaaactcggg

SEQ ID NO: 4443 - DNA, 800 bp, Homo sapiens
  misc_feature 7, 15, 17, 92, 208, 487, 507, 542, 553, 563, 587, 597, 615,620, 628, 630, 639, 642, 648, 657, 658, 661, 663, 667, 672,674, 675, 683, 687, 689, 690, 692, 693, 694, 695, 702, 708,709, 715, 716, 717, 721, 725, 727, 728, 729, 730, 731: n = A,T,C or G
  misc_feature 733, 739, 742, 749, 750, 752, 753, 759, 761, 762, 763, 764,765, 768, 769, 770, 771, 772, 775, 776, 777, 781, 782, 783,786, 787, 788, 789, 790, 793, 797, 798, 799: n = A,T,C or G
tttaacnctttttanancctcttgatcttttgcaggatcccatcgattcgaattcggcacgaggaagaaagcagatgccattttatctattngcacatcaggactgacagacatgaaaaaattggccaagtgggcagcagagtccaagctcgacccaaatgaccccaacaatgcccctttgatgcagcttatctcggttgctaccagnggtgaatcctatgtccctgatttctttagactggagcagctgcaacaggagtttaactttgtttcagatcaagaattaaatagatccaaacgatttaggcttcttcatcttagaagccaagaggtgccagaattccgaaattataagcaagttccagtctatgaccgagaaattatggaaaaggtattccaggactatgagaaacggttacgagacagaaatgtaatagaaaccaaggaacacatagacacccatagggccatagtagccaagtacctncagcaggttagagaatcagngataaatcgtttcttaattgcaaaacaatattttntttttggctgntatggatagnagaagaagaagttcccaatttcancattttgggnctaagccttttcaagctngccanaacaaaancngaccactgnggncaaggngaaaaaggnnggnangaangtgancnnccccaaancctngnntnnnnggagacntaaaanntggctnnngaanattngnnnnnancttacnacnttccaanngnnggaaancnnnnnttnnnnnaannncaannnccnnnnnggntttnnng

SEQ ID NO: 4444 - DNA, 784 bp, Homo sapiens
  misc_feature 2, 47, 79, 654, 712, 726, 729, 737, 755, 784: n = A,T,C or G
tnaaccctttaacaagctattgttcttttgcacgatccctcgattcnaattcggcacgaggcgggcgcgaccggaggcngtttccgttactatggcaatgacggcagggactacaacaacctttcctatgagcaaccatacccgggaaagagtgactgtagccaagctcacattggagaatttttatagcacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcaggtggcccatatccgagcagaaagagatattttggtagaagcagatggtgcctgggtggtgaagatgttttacagttttcaggataagaggaatctttatctaatcatggaatttctccctggaggtgacatgatgacattgctaatgaagaaagacaccttgacagaagangaaacacagttcttcatttcagagactgttcttggccattagatgccgatcccccagntgggtttcattccntcnggatattnagcccgacaacccttttnttgggttgcccaagggtcatgtaaaattn

SEQ ID NO: 4445 - DNA, 772 bp, Homo sapiens
  misc_feature 2, 9, 29, 63, 64, 80, 89, 90, 93, 94, 101, 102, 105, 107,109, 110, 112, 113, 119, 121, 123, 133, 134, 136, 137, 145,149, 159, 161, 162, 170, 181, 185, 186, 187, 193, 196, 205,217, 235, 237, 252, 297, 301, 305, 325, 363, 402, 412: n = A,T,C or G
  misc_feature 416, 427, 428, 451, 459, 465, 468, 486, 496, 501, 521, 532,544, 551, 576, 580, 625, 650, 652, 665, 695, 711, 724, 731,739, 741, 752, 766, 767: n = A,T,C or G
gnaacctanaaacagctattgaacttgtngcacgatcccatcgattcgaattcggcacgagannaaaggtgtgagccacngcgcccggnntanntaagaannatnantnngnncttgcngnanaacatctgtnntnncaacttantacnaacaaatatnannattaaacncttcactttgncttnnnaactgntcnaaacactgncactttggcttnaaaactgctcccacaatntngctagcatttttggngattcaacattcatgtcaaaccaccacactagggctccccagttncttnattnactcattgttgcatgcacanattttggtatgatctatctcagccggtcctactccttnggggattccttacacctccaaaattttgaattataagcntttttctccnaganctccctcattnntttacttatcttaatcattctcntccaacancacttnatntactttgggaatgccaangaatccgatntcttnttcactcgtcattacctctntgcctgctctntcttttcttggntgttatngacccagtttagaggatgcagagtncttnaatataatcactactttgaaaacatcctcagctgttttgctcctnttgactttgcttggcaaaactcagncntggctaaaacttntggccatttgcacctgcctcaaacactggngctggctacaaacaantgctaccagcatngactggntccacttngnaattcggaccncacctcatgtaggnnctcac

SEQ ID NO: 4446 - DNA, 771 bp, Homo sapiens
  misc_feature 5, 6, 8, 10, 12, 14, 19, 23, 31, 35, 41, 42, 56, 771: n = A,T,C or G
ctaanncngngngnctcgnactngccgaacnaaanaggctnnggcgcatctgtagnaattggctttccgtttgcatatttaaatgaactttgtggcttttgttaagtataataaaaagcatggagtcaaatataagccaagagtattacagagacttttaggctgactcagtatctcaagttctgtgtagattcatctaaacactgctgttatccatgctatactttaccatgttatcccaaaagggaatcatcagcaaattttaccagaaactgctgaattcaagatatattcaatatatattatacttctgacatcctaggaagcctatccaaagaatacattactttgatagaatttgttctttatgaaaattcattttgactctcattgataactttattccattttgggggaggactgaggagtcagtgggatgggaacagagctaactacaaagtctttgagtttagatgggcagcagaaggggaaaggaagtaggccgtgggatatataaggacttttccaatggaaaacaattgtcagtggaacctctatgactacttgttcaatttcagaattaaacttcctgtatattttaggtggaatcaagctgagttctagtcaaaatgctcgcattatttcccatgaaaaatcccccaaacaccaagcagacagaacagtggttgataaacccatcatattccatttctgaagaaaatcatcaagccccaaatcttgttttagaaaatttctcaagaactaattctn

SEQ ID NO: 4447 - DNA, 732 bp, Homo sapiens
  misc_feature 3, 4, 5, 6, 13, 14, 15, 18, 19, 119, 712, 732: n = A,T,C or G
tgnnnnttgattnnngcnnttgtctttctgcaggatcccatcgattcgaattcggcacgaggtttctttttttcagagttttgctgctaagaaatatctcctcaacatttgacttcatngtggccaataatggtctctgaattgattcagacattcacacagcttgaagaagatctaaaagatgaagatgagtcattgagaagcaccaacaaagtaaacagaacgaaagtttcagtcccggatgcaaatggaccctcagtgggggagataccccagagtgaactcatcttgtatttatcagcttgcaaattcttggacacagcgctttcttttccacctgacaagatgccattatttcaaatttataggtgggcatttattccagaagtggacacagagggccctgccttcctgtcggatgtagaggagaatcaccaagaatgcaaaccccacactgtcaggattctagaacttctaaaattaaagtttggggaaatcagtagctctgatgagatcaccatgaagagtgaattcccgcttctgcgccaacattctgtttccagcatcaggcagttgatgccattcttcatgactctaaatggtgcatttaagacccagagacagctgcctgctgatagcccaggaactccattcttggactttcctgtccagatgcccaaggatcttaaaacaactgggaagaatgcatcgnaatatgaatttctggaaccn

SEQ ID NO: 4448 - DNA, 858 bp, Homo sapiens
  misc_feature 3, 7, 15, 19, 30, 37, 272, 326, 347, 351, 369, 372, 376,378, 380, 389, 395, 396, 411, 417, 456, 457, 459, 468, 471,489, 493, 494, 499, 515, 525, 528, 545, 546, 578, 596, 601,604, 623, 650, 660, 666, 674, 691, 702, 703, 722, 724: n = A,T,C or G
  misc_feature 726, 731, 732, 734, 738, 739, 740, 743, 746, 748, 753, 757,760, 763, 766, 768, 771, 791, 795, 802, 816, 817, 824, 826,832, 834, 837, 838, 839, 842, 850, 856: n = A,T,C or G
ttntttnaattttcnaatncttgctctttnattccgnaggatcccatcgattcgaattcggcacgagggtagcacaggcctgcccttgcacccatgctgtacagtgcggttactagacttgtggccgttgttgtgctgtcttctcattagcatgcaatattcacttgactgaattcctttttagctaagagaaatattacagggcatgatcattttaggttattaaggtgtctaactcaatatgtaaactgctgaaaagaattatatgtttntatcagataatctcaacatttcaaaagacaacacattcagactacttccctttncccccaacttttatctaatgnctgnaacccccatgactagtgnccnaaanangngttttagtnaaattnnagtcacccgtggatnacaaangcaaccctggattcccaatcctgcttgtgggggggtttnntnggccaaatnganttaattttcttgggcaanaaannttttncttcttaccattaccnggaaccccantanttgcccaaacttttggnnaattttttttaaggaaaaaaaacctggaaatngggggttaaattcttggnaaaanttntttttttttaaaaaacttnccattttattttaaaaaaaaccccccntttaaacctngggggntccttttncctttttggaccttaanttaaatggaanngatttggggaacccaatanantnaatannantatnnnaanaananaattnattnatnttntancnaantaaaaaaaaaaccccttttnaacnttttggnggggccgtttcccnnaaacccnancttatnanaannnttnttaatttnggcaanct

SEQ ID NO: 4449 - DNA, 1718 bp, Homo sapiens
  misc_feature 1, 21, 36, 47, 52, 55, 59, 75, 79, 81, 93, 97, 103, 104,111, 121, 123, 128, 129, 146, 148, 152, 156, 172, 176, 180,189, 196, 199, 202, 203, 205, 209, 215, 224, 233, 237, 246,251, 254, 255, 267, 282, 290, 292, 302, 305, 306, 308: n = A,T,C or G
  misc_feature 310, 311, 326, 335, 336, 337, 349, 351, 353, 356, 360, 364,367, 371, 380, 381, 386, 388, 391, 395, 396, 403, 405, 406,408, 421, 422, 424, 425, 431, 438, 439, 446, 447, 449, 451,455, 456, 460, 461, 462, 470, 472, 480, 483, 484, 490: n = A,T,C or G
  misc_feature 494, 497, 498, 502, 503, 504, 505, 506, 507, 511, 513, 514,518, 522, 525, 526, 535, 536, 539, 546, 557, 558, 559, 562,563, 565, 568, 577, 579, 584, 586, 595, 597, 599, 603, 607,617, 620, 625, 628, 638, 641, 648, 651, 653, 657, 668: n = A,T,C or G
  misc_feature 672, 676, 689, 691, 692, 696, 700, 702, 704, 707, 708, 711,719, 727, 732, 738, 740, 741, 745, 752, 756, 764, 765, 767,770, 771, 775, 776, 784, 788, 789, 801, 802, 803, 816, 822,824, 830, 831, 834, 838, 841, 845, 847, 851, 854, 857: n = A,T,C or G
  misc_feature 859, 865, 877, 879, 881, 882, 884, 890, 900, 903, 904, 916,917, 923, 928, 935, 939, 943, 948, 956, 968, 970, 995, 997,998, 1001, 1003, 1007, 1011, 1021, 1026, 1034, 1035, 1036,1048, 1052, 1057, 1060, 1068, 1070, 1072, 1077, 1080: n = A,T,C or G
  misc_feature 1089, 1094, 1101, 1108, 1111, 1115, 1124, 1127, 1143, 1146,1155, 1165, 1174, 1178, 1182, 1185, 1195, 1199, 1204, 1209,1211, 1220, 1223, 1225, 1226, 1229, 1235, 1238, 1250, 1271,1279, 1281, 1283, 1285, 1288, 1290, 1292, 1296, 1301: n = A,T,C or G
nctctaaaaatatcttttttnattataaaactttcnaaagtcttatnggacnttngggnaactccttaaaaaacntccntnaaaaataaaggnaggntctttnnttggggncctcccaaanantttcnnatactctaactgctcancncacnctcnaccatcactcaacatntatntctntacacattntatctcncanacnnantacnactctnattactctnctatatatntacnaaactactntcctnatnntactctataccnatactctctctatcntctatctntntcatacttanagnngncnnatatcactatactanatcactctnnnctcatacaccantntnccntatntatntcntcanatctcattnnttatntnacnatannctacacncnntnacatctaacatanntnnataacnatctcannttatctnntntncaannctcnnntatcactncnattcattnaannacttanaccnccnntcannnnnnacancnncacnttanctnntctccctannctnaccctcncatacatattnnntanncnccnatccttacntnacaantntcatcctancncnttcnactntcattctccnttnccttnatnacccaactcncantcacaanatncntccncaccactcttntcantacncaacctattcatncnncatnatantntntanntcncatacacnaccccatnctatnatcaancnntcantccttcntttntaatcatnnanccnnctcnnctcctatnatgnnctctgcccctannntatcatcttcacnacaacncnactctnnctnccanacnatcntnatanacncantntcactntattctaacatnantnnanaccacntactccatantcnntctaacatactnnattaanaatanattactnctcntatntcctnctatctcnatcactcctccncnctcattacacatctcttataatctncnnatncncatntctntcatctcttntatcntctctatnnnactctcctatcncatntatcnaancattactntntntatanatnacactctcncatcnctcatancactatntcncttnttatatatntanattatcatcgtatacntcnctactctcnatcactcatnatactatanactntatnccncatatcacanacanacctntcatntntcacactcnctntnntanactatntcncactcctcacanctctcatatctctatacatcnctactctntntntnctntntnatcntcttncattntntnctctatcntttcnntcatatncgntntcanatntnacnatcatctctnccatctntctctngtctntnattncttccacnatctctcttcanntttacacacacntacattctatnttctctctatcttctnctctnacctntctcnctnanacnacatatcttatatcnnncatntcatnacnnctactatcatacncatantacaccatatntntncatctctctnccantnccntatctctatacnctctatatcncntttcatatatanttacnacatnnctatanattcntatatctctaccatatactntcttctactctatcangtaantatnctaanntattattatatcncncantctctctcacncaccnctctatcncatcntntctcctctatccn

SEQ ID NO: 4450 - DNA, 1015 bp, Homo sapiens
  misc_feature 6, 14, 15, 18, 60, 98, 241, 246, 251, 255, 257, 265, 283,295, 304, 306, 309, 318, 323, 325, 327, 329, 339, 344, 347,356, 358, 360, 362, 374, 377, 388, 398, 400, 405, 417, 418,439, 441, 445, 448, 451, 454, 464, 465, 469, 470, 471: n = A,T,C or G
  misc_feature 472, 475, 476, 481, 490, 491, 497, 499, 501, 502, 504, 505,506, 507, 508, 517, 525, 526, 528, 529, 530, 533, 535, 537,541, 543, 544, 546, 547, 548, 553, 555, 566, 567, 570, 572,573, 576, 585, 587, 592, 600, 608, 612, 616, 618, 621: n = A,T,C or G
  misc_feature 631, 632, 633, 634, 639, 641, 643, 645, 647, 650, 654, 655,656, 658, 660, 667, 669, 670, 674, 681, 682, 683, 686, 689,691, 694, 695, 697, 700, 702, 706, 710, 714, 715, 716, 720,721, 722, 723, 724, 733, 738, 740, 748, 750, 755, 760: n = A,T,C or G
  misc_feature 763, 764, 765, 766, 770, 771, 774, 775, 777, 785, 786, 788,796, 797, 801, 804, 806, 809, 816, 817, 823, 829, 831, 839,844, 845, 847, 851, 860, 862, 867, 870, 874, 877, 881, 885,889, 899, 902, 908, 915, 917, 920, 921, 922, 923, 928: n = A,T,C or G
  misc_feature 929, 931, 933, 938, 941, 942, 943, 950, 951, 954, 962, 970,972, 975, 976, 982, 983, 987, 988, 994, 995, 996, 999, 1000,1007, 1008, 1015: n = A,T,C or G
gggggnttttaaannttntgggcttgttgggttgcaggatcccttcgattcgaattcggnacgagactggactaatatcattttaaataatattgctntttagcttcaaaagacagagcctccagcatattattattattatagtaatctgattctttagcaattcagagaactcacctcattagtgctcccttgctctatctgggcctgtgggaaaatacccttgcatctttctatgggnatggnccacnggancnccatctgnctttaacatttttgaagnattggacttttnaaggaagcngnacncaattcccntggtncntncnattctagaancccgnaancgtttcccngncnanttaaaggggaanttntccccccttgnttgtttgccncnccccngttttttacagnngggccggtttttaaaaaaganangtgnttnttnttnaaaaaattannatannnntcnnttttnggggccatnncccttntngnncnnnnnggtgtatgnacgaaccnnannnatnantnttantnncnnnttttnanttttcccacgnnctntnnttncaattatcnantctcnggtactcngggcctcnatcncaantntanataccccttnnnntgcgncncnananatnatgnnncncnctataantnnggantgttggnnnccnaananatnntntantnatangtantgtnnntctnnnnnctatacccnctgtngnttgtgcancnctcgngtacnctnnnnacannatnngntataatanntngtctcccnntagntgntntanagtgacnntccttntttaangnaccatctntcggnnancgtnactaacctnantttancanctcntcntatnaaancgtnacccccgctntgnaatggngggaatngnatnnnnaagtnncntnacaangtnnngtcttanngtntgccttcnctcgtatntntannttgcgnnacanngggtgnnnaanntaaaggnncgcgccn

SEQ ID NO: 4451 - DNA, 740 bp, Homo sapiens
  misc_feature 4, 5, 9, 18, 39, 48, 310, 396, 439, 530, 533, 543, 544, 550,553, 562, 614, 643, 646, 655, 658, 676, 678, 690, 706, 714,723, 733: n = A,T,C or G
tggnntttnaaatttttnatgcgttggttttgcggattnatcgattcnaattcggcacgagcctagttggccatcagactttcagcaacttttatcatccagatagtcaccaaatgaaataaaatagaaaaatcccttgagcaatgaaacaattgtgaatgaacacaaagtccatgaatttaatccttatccgtttgctgagccaagcatgtgcatctgcagtgggtggcccaggctggcagcacagataccaccatttcccttttctttgctcagggcatggcctgtttatctcgttgcaccagatgangggttggaaggatgatggtggtggttgtttcagatctactgacagcaatgagaaatcaatgacagttgacaggaagagaggacccntccacaggcaaaagaggaatgcccagcaatcttggtccttgcngtgcaatactggccttgaggccaagtcagcaggggattcgtaagtcactaacttctaactgaggcagggaaagtaccatgttctggaaaangtnccaagaaacnnggaatngangcagtgtancaagaagcagattttggtgcccaatagatttgaatcctggttctgcttcttnctttgtagagtatgatattgggtcttttnctnccaaagctnttnttaaagacttaatatgtncnccaaatcttttnggatgtctgacttttnaatgcttnacaataggnatttgctggnattatta

SEQ ID NO: 4452 - DNA, 763 bp, Homo sapiens
  misc_feature 2, 6, 9, 14, 15, 344, 399, 529, 575, 597, 635, 649, 656,665, 668, 681, 708, 730, 734, 737: n = A,T,C or G
tnttcnaanttccnngctcttgtcttttgcaggattcctcgattcgaattcggcacgagcttggaggctgtttccagctagagaaagacctgcttatttctcactgaataaggttccaacaggctgccaaatcctgtgtatgcctgtacccaaatggaaggagtgcctttcctcaattcataaaaaagacaaagacagtggtagggatcagctattatgtcagtacatgaaaggaaccccctatctcaatcaaaatggtaaaggaagcttgtctcaaataacagcaaagaaactcagtttaccagactataaaagttctttggtcaagaagataaagagctctncagaataagaatacctatacatgtatggatgtgtggaaagtcgacaaaatgtgtncaagcaagttgaattctggaaactttgagtttagcaaataggagggtaagaaggctgttaccgtatttgaggaaccagatcttgaagggttcatattccataataagtataatatgaatattaattttgnaatagaacagtttctacctgtataaaaaggaagccttaaagagatngaagttagagatttactcatangggggatgattggtaactacttacttatttccggaatntcaaaagaccctantggaatngggggattntanggggaaaaaaatngacctcttttctcaaagatgaaactgnaaatttttttaccttaagaccnttgnaanaatggaaattacctttttaaccttgg

SEQ ID NO: 4453 - DNA, 730 bp, Homo sapiens
  misc_feature 4, 15, 344, 349, 388, 404, 454, 465, 552, 581, 613, 661,667, 673, 685, 701, 705: n = A,T,C or G
cgtnttcaaattttnaactcttgtcttttgcaggatccctcgattcgttggtgtgtaaataaaactttagaaagggtctattgaactttggacaggcaagctccatgagctctccctcactctttgaggcaggttaaagggtacggccatgaccaccaccttaatccttcagggactatttacaaaagattgaaaaatgtgcccagggcccgtacctgcccctctgtggaactagcccaactcaagtgggctggcaggcaagcctggctttcatggggacagaagagagagtttgcggggagcttggcatttttcaacacatgctttttggcttctcctactgnattgnaatttccatgatatttggtgggaaaaatggacacccggnctcttttgctttttgnctgctgcttttcagctattggggattctgcgccttgggataatgaagcangctgtcatttncttcccctaaataatgcattacaaagtggaaatgcaaatttcctgtgcaagctctaaataccaggtggtatttccttaatatattgnttttgacctttggggaaattggtattacnagctgactttggaaattaaaatacatcaaggncctcattttaaataaaacaatcgatatcttaatttttaaatcagactngattcnattccnggaaaagacatncatatttgctttatgnggtnaaagtttggaattcaggaggacaat

SEQ ID NO: 4454 - DNA, 706 bp, Homo sapiens
  misc_feature 1, 14, 17, 19, 25, 283, 329, 351, 358, 374, 393, 403, 407,436, 440, 452, 488, 489, 493, 497, 503, 514, 524, 533, 561,579, 593, 600, 608, 636, 640, 645, 650, 652, 653, 655, 689: n = A,T,C or G
ntttgaaatttcgntantncttttntttttgcaggattcatcgattcgaattcggcacgagatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaaagtgttggggcttcatgaactangatgaaaggagcccctgaccatgacaaggggcacatccaggatttncgccaccctgaatttagtaganctaatangccctggttgttactnttgggcaaggaatgccgtnaacctttganggtncgcacccacttgtgtgttgccctcttgtnctgncggggaaacatncaccccttgtcttaaccaccaaactttgcttgtgtnntcancaanggttgncctttcccaangacttactgnatgtacccngaccctaagccttgcctttcacatattnggagcttttggattcatntgactttgaccccntctgctntcacttgnggcctgaactgttgatcaatgttggcanaatnaaccnccttntnnanctaaagctactttaccatccatataatgggattnaaaaaaaaaaaaaaaat

SEQ ID NO: 4455 - DNA, 885 bp, Homo sapiens
  misc_feature 3, 7, 10, 18, 20, 24, 41, 122, 124, 311, 333, 342, 382, 428,441, 452, 458, 473, 481, 504, 505, 509, 512, 514, 515, 517,520, 521, 522, 523, 524, 525, 528, 533, 536, 537, 539, 547,548, 550, 552, 553, 558, 561, 564, 565, 569, 570: n = A,T,C or G
  misc_feature 572, 573, 580, 581, 584, 585, 588, 589, 592, 594, 597, 599,602, 604, 608, 609, 611, 613, 614, 622, 625, 626, 628, 630,631, 634, 638, 639, 642, 645, 646, 647, 649, 652, 653, 657,659, 665, 666, 677, 679, 685, 692, 693, 699, 701, 702: n = A,T,C or G
  misc_feature 709, 720, 722, 723, 724, 738, 741, 743, 749, 751, 753, 759,762, 763, 765, 768, 770, 772, 781, 787, 789, 797, 798, 800,803, 806, 813, 814, 823, 825, 830, 836, 841, 843, 845, 846,847, 850, 852, 855, 858, 861, 865, 866, 870, 872, 875: n = A,T,C or G
  misc_feature 877, 878, 880, 882, 885: n = A,T,C or G
ttnttcnaantttcggantnctcnttctattgcaggatttnatcgtccttaatttcggcacgaggcaagctggagagctgcagaggctggtagcgtggctcagtccaagcacagaggcctcntnaccatggaagctgatggtataactcagtctgaggatgaaggcttcagaacctgggggactacaggtgcaagttctggagaccgaatgctggagaaccttgagttctgatgtccaagagaaggagaaaaaggacttcccagctccagaagagggaaaaagcaaatttggctttcctctgtcttcttgntctatctgggtcctctgctgantggatggtncccaaaacttttgggtgaaggtagggctttcttaccctgntcatggattcaaatgccaatctctttttggaaacactttttccagnacatacccccttnaaataaaaatnttttanccttgtatcttcttnttaaaaantaataaaaaaatttttaatattnntatnttncnntnttnnnnnnccntgttnaanntntatttttnntnanngactnaantcnntacnntnnctcttcnntannatnnaantntcnanttnancttnnantnnatcttttntanntnanntanatcnnttntannncnttnnatantnactatnntctttgtttantntcacanttatctnntctctntnntatgttntaattctactntnnntatttaaaatgtcnatntntatctntnanaccatnttnncncanantntttatctanttctanancctttatnntnttntcnttatttnntgtcttgtntntatcnattttnttatntncnnntantnctntanttnttannattnantananntntnccn

SEQ ID NO: 4456 - DNA, 793 bp, Homo sapiens
  misc_feature 2, 3, 4, 349, 449, 485, 560, 584, 598, 610, 635, 655, 658,690, 696, 707, 722, 732, 735, 747, 748, 749, 750, 751, 752,754, 755, 756, 757, 758, 759, 760, 761, 762, 763, 764, 765,766, 767, 768, 769, 770, 771, 772, 773, 774, 775, 776: n = A,T,C or G
  misc_feature 777, 778, 779, 780, 781, 782, 784, 789: n = A,T,C or G
gnnnttttaaatccagctcttgtcttttgcggaccctcgttcgaattcggcacgagaattgataataattagacaaactgaactaaatttttttaacagatacctgagtgccaagcttaacagatacctgagtgccaagcataataaacaggaaatatacacttcaaaaaagaaaaagaaaaatgaatgcatacttatcaaatacttgctgtaagagcattaagtactttacataagtcaaatcatttaatcctcatgaccctaagaagttattttaaagatcttttgagaatgagaaaaaaggatgagtaagggtaggtgatctatgtaaaacaaataaattctagtnactggcaaagctgagatttgacctaaatcaatctgccagaagttctgagttattttccatgtgcctcacatagcagaaagggagatggcataagcacatntcaggcctagaggtaacatatactctggcaaaagcntaaaaggtctatgaaattttacagcaaggaaaggctatttctaacagggaggactcagaggaaaggaagccaccntttaaagtttgggtacctggaatnaatttcttaagacntttccccagatnggaggacccggggaaagaaagaaanccttcccaggaagggccaanccnggagccatggtggtcaatggtggtggtttaangggccngaaaaaaattnggtggggaaaccccnacccccaggnccngggaaaaaaaannnnnnannnnnnnnnnnnnnnnnnnnnnnnnnnnnanaaaancctc

SEQ ID NO: 4457 - DNA, 870 bp, Homo sapiens
  misc_feature 1, 5, 6, 7, 8, 9, 10, 16, 22, 28, 30, 32, 115, 256, 279,382, 384, 388, 406, 407, 415, 435, 443, 444, 445, 466, 475,479, 482, 487, 488, 492, 494, 499, 508, 513, 515, 530, 545,547, 553, 571, 574, 575, 577, 592, 596, 602, 619, 629: n = A,T,C or G
  misc_feature 637, 638, 658, 666, 699, 702, 706, 712, 716, 723, 727, 728,745, 747, 748, 749, 756, 757, 762, 767, 776, 777, 789, 795,799, 802, 803, 804, 815, 832, 837, 840, 853, 863, 865: n = A,T,C or G
ntttnnnnnntttagngggccnttgcgntngntctttctgcaggatccctcgattcgaattcggcacgagcaacagtcccaaccagtcgaattagacccatttggtgctgctccntttccttctaaacagtagatacttctgatggattctcggcattaactcctgtttcaaaaaagtgtgaacagttttatgaatttgaaagaaaatttgggtagctctttatagcattcattcttaaagatcagtccagaatanggtgattctaaataaacccaatngaagaatgaagtatctctacagggtagtaacttggattcctcttcagggagaaaaagggagccttaaatttgcaagcctcttaacctaaaggggtttcttggntncctngccttttccaaccccccnnaaatggcnaagttgttgggggccctttncccattgnnnaaaagccccctttggggaccnttttttaangggnggngttanncccncnttttntaaaagggnccccntnggaaacccggtgganttttttggatattcncnaaaagnggcaatttttttattggngcnntnttccccttcaaaaanttangggggnaattttctaccataccncttaagtttncacccttnnggaaaattttttttttaaangggccccntttttaaaatttcccagacaaggttaaaaaccnatnttanttattntttnaaagccntttnnaaaaggtattatttttngnnnaagggcnntaaanttttnagtccttannccctttttttcncaaaanctanccnnnaattaaccgcntttttggggcctaaaanaactnggncatttttttaaanaaaagggccntnttaat

SEQ ID NO: 4458 - DNA, 1046 bp, Homo sapiens
  misc_feature 14, 30, 47, 48, 55, 64, 74, 78, 79, 84, 89, 93, 94, 95, 96,98, 106, 108, 109, 114, 115, 119, 120, 121, 122, 123, 124,126, 127, 130, 134, 138, 139, 142, 151, 154, 160, 161, 163,166, 170, 171, 173, 186, 188, 190, 195, 198, 200, 203: n = A,T,C or G
  misc_feature 206, 221, 222, 225, 227, 230, 236, 237, 239, 245, 249, 255,258, 259, 260, 269, 271, 273, 284, 308, 315, 316, 317, 320,328, 330, 331, 339, 341, 344, 346, 351, 369, 371, 374, 377,378, 379, 386, 387, 391, 392, 397, 399, 400, 402, 403: n = A,T,C or G
  misc_feature 405, 411, 423, 432, 436, 440, 444, 446, 454, 461, 468, 478,482, 483, 490, 491, 499, 507, 509, 515, 517, 519, 524, 527,528, 532, 537, 544, 549, 552, 554, 559, 560, 561, 565, 567,579, 580, 581, 582, 583, 584, 591, 592, 594, 595, 596: n = A,T,C or G
  misc_feature 598, 599, 603, 604, 614, 620, 621, 623, 632, 637, 641, 642,644, 664, 665, 669, 676, 680, 684, 688, 691, 692, 698, 699,702, 703, 706, 723, 728, 729, 730, 731, 733, 735, 737, 739,751, 764, 765, 769, 770, 773, 775, 776, 782, 783, 785: n = A,T,C or G
  misc_feature 788, 789, 792, 794, 795, 799, 801, 804, 805, 809, 812, 818,822, 826, 829, 832, 833, 836, 843, 844, 845, 853, 855, 859,862, 870, 872, 874, 880, 881, 883, 884, 886, 894, 895, 899,903, 907, 909, 910, 911, 920, 923, 924, 931, 932, 938: n = A,T,C or G
  misc_feature 942, 943, 944, 945, 947, 949, 952, 953, 954, 956, 958, 961,964, 966, 967, 969, 971, 976, 977, 980, 982, 988, 996, 997,1000, 1001, 1004, 1005, 1006, 1007, 1013, 1015, 1018, 1021,1028, 1030, 1033, 1036, 1037, 1038, 1045: n = A,T,C or G
ggcgggtcctccgnggaaaaaccccttttngggaaattcggggtagnngaaaacnctttggggnaaacctccgncgcnnaaaangcgcngagnnnngnggaacggngnnccacnngcannnnnntnnggnggancccnnggnacgggtttnccncctttnnancgngacnngngggcacgggggancngngcacnagnancanaangcacggagccggccnnaangnganagtaanncncctaangaangtagangannnaaacatggntncnccacaaggcangagcagcaccttggggctgctggnaagcccnnnatnatgggggncnncttggacnangtncnggcanaaagggggcgggggcatncnaanccnnncccctcnncatnngcaancnncnnancggggnaacccaaccagngcgaaatanccancggngccntnaatgcgcnaaaccanggggcancacggagggncctnngcgcggnnacaaggcncacccctngnacacgngngnggggnacnncacncccanacgagcnggcancgnanccccnnncatnangggacccctacnnnnnnggggcgnnannntnngcgnngggggcacantaccannanacaccgcgngcganacanncnttccaaaccacggacgaaannaccncgggagnatantaanaccnacnnccaaannggnncangcacaatcggcaacccntgggnnnntncntnangggagcccgganccccccacccagnntccnngananncaatgnncnccnntcnannaccncnccnntaanccnggggcncagngggnaanggnngangcccccnnnacgggggncnttanagnccctaaanantnaccccnngnntncacaaacnncaanaagnggcnannncccctcggnganncaaaagnncgcgancgcnnnnancnccnnnangntcntcngnncncnccacnnggncntccgcnccgggagnncannggnnnncccctncnctnccnaaaagcngngcntcnnncaacccnc

SEQ ID NO: 4459 - DNA, 743 bp, Homo sapiens
  misc_feature 221, 318, 358, 366, 378, 379, 405, 406, 416, 419, 421, 486,528, 541, 551, 598, 608, 621, 628, 637, 646, 647, 681, 682,694, 710, 719, 735: n = A,T,C or G
agggctgctcttgttctttttgcaggatcccatcgattcgaattcggcacgagaaaaggagccagaacttgatgattttgaaaattctcagcctttctggttggcagagggtgatgaaattgagacacggcaaagatcaattcaagagccactccggggagaatggcggtctaaagataaagccaagactgtgcctttaaagcctgctgttaagacctganaaggtagtgccttagcatcctcttcagtcacactcaaggcctctccgtcaaacaatagggcttctacctttttagcaggagcccaaggtagaggtanaagagttcctcttggagagatctatgggtatagcttttgnctattgcngtgagatatgcnngaaatccactgtagctaggactgacnngaaaagaacngtncnaaatgaaaagagctgtcggcacccctagcattctgctggcaggaaccagctgagaaagtgctcangactacacatgcccctttcatcaaaagggaaagatgactcanaagttggaagcangagcctaganatgaaggccaaaagtcatgggagaattctttttccaatggttgagancctaattcanggaactttcaagnggtttgnccctggctnggaattcannaagtccagtattgggatcaatggactctttttgnngccccccccaantttcctgggcctttcnttttggtangaaaaaagggtttttncccctttt

SEQ ID NO: 4460 - DNA, 906 bp, Homo sapiens
  misc_feature 2, 3, 6, 7, 30, 32, 77, 111, 121, 147, 186, 187, 193, 212,219, 223, 225, 227, 243, 248, 251, 265, 266, 268, 269, 277,295, 310, 312, 313, 346, 354, 370, 380, 396, 404, 410, 412,416, 428, 439, 443, 468, 487, 512, 515, 516, 517, 542: n = A,T,C or G
  misc_feature 545, 565, 570, 571, 574, 578, 581, 582, 599, 604, 606, 617,625, 632, 636, 653, 719, 728, 744, 748, 756, 773, 777, 791,796, 797, 800, 803, 823, 826, 832, 835, 847, 848, 849, 854,860, 862, 884, 885, 888, 904: n = A,T,C or G
gnnttnntttttctaagggcttgctccttntntttctgcaggatcccatcgattcgaattcggcacgagcccacacntgccatattgaaccgtttctgcactaatcttctncacgggcacngcgtggagggaacgtctaggggaaangggagagcttgacctccatctaggttacttttatctggnnaaaaangaacactttttggacttantgtaatngctntngnccctgtaaaaggcaangctanccncttaactttcccanntnnaccttttnagccagggaaccaaatgnaaagggttaatggtntnncatggaacaggactactttgcttcccctttggnggacaaantttccctagaaacaancttacccttnaaaacacccaaaaacnttcccaanccccancntggnttgggcattagngaagcatggtnggtncccaaactttacccaaaaggggacnttggggagcccaccctttntgacttcttgtgggaaattactttntannngaggaacctggacttggccttggantanaaaaaccccttgtaaatttnccctnnaanttanccnnattccccttaaaagacnttttntnttgggaaaganttcatttngccttgntacntatttccctttttttgnggtggcattaaaattaattttatttaaaccttggtttcaaactggaccaacatttgggttttcttnccaacttangggaaatttttggaanttcnaaaactgnttcgccttttgaaagancttngctttttttttggnaaaanngtnttnggaatttgggctgttaaccnaantttccnttntttggaatcccnnnagganggggcnanatatcttggggcaaaaaaaatnnctnggtacccctttttggntt

SEQ ID NO: 4461 - DNA, 1235 bp, Homo sapiens
  misc_feature 6, 17, 18, 31, 32, 34, 39, 49, 50, 53, 56, 57, 60, 61, 66,74, 90, 97, 98, 99, 106, 107, 112, 126, 127, 130, 131, 132,138, 139, 141, 147, 150, 155, 157, 158, 163, 164, 170, 172,173, 176, 183, 189, 194, 206, 208, 209, 213, 214, 244: n = A,T,C or G
  misc_feature 253, 266, 271, 280, 288, 293, 294, 302, 311, 326, 327, 330,333, 337, 339, 342, 345, 350, 372, 382, 383, 384, 385, 402,403, 404, 412, 413, 417, 419, 420, 436, 437, 440, 441, 449,451, 463, 471, 472, 481, 490, 501, 502, 503, 506, 510: n = A,T,C or G
  misc_feature 513, 515, 517, 518, 525, 529, 534, 536, 542, 545, 556, 562,565, 566, 568, 577, 585, 586, 601, 602, 614, 617, 618, 633,634, 636, 638, 643, 646, 647, 651, 654, 697, 715, 717, 732,737, 758, 763, 774, 780, 782, 787, 796, 803, 813, 814: n = A,T,C or G
  misc_feature 831, 841, 888, 892, 900, 906, 908, 914, 915, 917, 936, 945,946, 947, 964, 973, 976, 1000, 1030, 1037, 1043, 1050, 1054,1055, 1066, 1081, 1083, 1088, 1091, 1107, 1116, 1126, 1129,1134, 1145, 1147, 1163, 1168, 1181, 1185, 1187, 1197: n = A,T,C or G
  misc_feature 1201, 1208, 1212, 1222, 1223, 1231: n = A,T,C or G
ctaatnctgtaacctanntttcttgacgccnncntcgcnctaaactacnntgnctnnggnnctccncccttacnccacccctcacccccntcctttnnntctccgnngcctnccccccccctcccnnctnnntgcccnncnccctanccnccccncnncttcnncctcgncnntcnctctccnttcccncctcncccccttcctcncnntctnnccccctcccccccctctccgcacctctctntccccctcncctgtctcccccnccctncccttcccnttcctctnccccnntacttccnctcctcccncactccctcctctcnnccnctncctntnctnccnctcancccccctctcccctctcacccnccttcccccnnnncccctcccccctctctnnntctcctcnncccncnnctcctccttctccctnncannccccctcncnccctctaccctnctcccctnntcctccctncctacctcnaccttccctcnnnccntccnacncnanncctctcntctnctccntnctctcnctncttccctcctncctatnccnncnttctccccntttctccnnctcctcctccctccnnctcctcctctcnttnnatccctctcttcccnncncntctcngcnntctntcntctctcttcatcatctctctcacatctctctctctctctctcnctctccactctcttctcntnttctaccctctctcnctctntcactctctccctccctctanccttnctctctcctcncccttntntcctncctctctcntccctcntccttccccnntcctcctctctcctccntctctctccnacctcctcctcccccttcacttcctcccctctcctcttccttccccncctncctctccncccctncnccttcnngncatcccccctcttctctcncctcttccnnncccttccttctcctcanctcaccctnctncctcctcctcttcccctcctctcnatccccccccttctctctcccctctatccntctccantcctcncctctcnctcnncttactacacnctccctctccccccntntcctnccncctcctatccctctcnattcctccncttctccttntcncctcnttcccttctcntnctcctctccccttctntcctnctccctccttccntctncncctcctctcntctncttcttnctcnctctcccccnntctcctcnccct

SEQ ID NO: 4462 - DNA, 999 bp, Homo sapiens
  misc_feature 3, 9, 12, 27, 38, 45, 120, 141, 169, 255, 262, 268, 336,344, 349, 352, 356, 357, 363, 364, 365, 371, 372, 373, 384,385, 389, 403, 404, 407, 415, 416, 418, 422, 426, 428, 429,430, 431, 434, 437, 440, 456, 458, 466, 467, 470, 472: n = A,T,C or G
  misc_feature 473, 478, 479, 481, 487, 492, 506, 507, 509, 511, 519, 523,527, 530, 551, 556, 564, 567, 568, 570, 578, 587, 595, 608,611, 613, 616, 620, 624, 625, 626, 629, 653, 654, 657, 660,661, 664, 665, 674, 676, 677, 686, 687, 694, 698, 700: n = A,T,C or G
  misc_feature 705, 706, 707, 708, 709, 710, 718, 729, 739, 753, 768, 773,774, 775, 780, 782, 803, 805, 806, 808, 814, 819, 823, 825,838, 844, 850, 853, 855, 867, 877, 878, 880, 884, 885, 886,888, 897, 902, 905, 908, 920, 922, 934, 940, 941, 942: n = A,T,C or G
  misc_feature 947, 948, 949, 952, 963, 965, 989, 992, 998, 999: n = A,T,C or G
ggntatttnaanttttctaaaagcttngctactttganctccgtnggatcccatcgattcgaattcggcacgagcccaaccccaggtgtgccgcgtgctgcccttgagagccctgccccncgctgtgaccccggagatgcncgccctggtggtagactggctggtccangtgcacgtaggagtacctgggtctggctggtgacacactttatctggcggttcacctgcttgattcctacctgagcgctggcccgngtgcgtntacatngtctgcaactgctgggcgtgggcttgcctgtttgtggcgtgcaaaatgggaaaagtgcgtgctttccngagacccnacttnctnttgnntcttgnnngcggannntctttttttanngggngggaactttattgnnctncccaaacnntngcanttcntnnnnccnccnctngaatttttcgggcttnantaccaaannccngnnccganngnttgtanccttncggacttttttggnncncntccttttncaangganatnaaatccccccaagttgaaatntttancattgtgncanncntaaatttncttgggaancttggtanttttgacttgganagncnccnaatngccnnnccngggattttggaaaaccccgggttnnctnatnngcnnggtttttgngnnatttttttnnacccttngggngnccaannnnnnattttggntttctaaaatnggggggcctnggggcttttcaatnggggttttcatagcncccannnaaaantntttttaacaatataccccctnanngngtaaantttgngggnanaaccccctttttnataagncccctnttntnaaaaaatttttnttaaaatggnnanatcnnntntatttttanacctntanganaaatttctcacntnaacatttttgtnatatannnggatnnncanaatatttggtnanccaaaaaatattttatgttggacnccnaaaaann

SEQ ID NO: 4463 - DNA, 879 bp, Homo sapiens
  misc_feature 2, 9, 15, 23, 30, 31, 32, 36, 37, 39, 48, 50, 54, 56, 59,60, 69, 71, 206, 213, 247, 253, 281, 282, 284, 288, 301,302, 303, 308, 323, 347, 349, 355, 358, 359, 360, 361, 364,383, 407, 408, 411, 416, 428, 437, 442, 452, 457, 462, 467: n = A,T,C or G
  misc_feature 487, 490, 501, 502, 506, 507, 512, 521, 524, 528, 534, 543,552, 565, 577, 580, 583, 585, 595, 604, 608, 627, 632, 633,640, 644, 646, 650, 659, 667, 668, 678, 679, 689, 697, 708,720, 724, 735, 740, 741, 743, 747, 749, 755, 757, 758: n = A,T,C or G
  misc_feature 759, 762, 764, 775, 779, 783, 791, 800, 805, 807, 808, 814,815, 817, 819, 820, 821, 825, 826, 827, 828, 831, 837, 839,850, 851, 853, 860, 864, 867, 868, 869, 873: n = A,T,C or G
cnaaatacnggtacntatcttcncaaaggnnnctanntngccctaaananaatngngtnngggggttangnccattttgatgttacaggatacttgtaagtgactttttgccattctcttttgttacccatggcctttgtcacccccttgaatatctcttttactcagttctcactttctgttgttgacatacttgttgacatgtnccaccantccatgaaatgaaataccatatcttccttgtgtngatatnacttttgtgagtatttaagacatatatnntnaacnaatgtaaaacttnnnaaatngattctcttctcatnaaaaaacatttaaagggaacattnanaatatnctnnnnacntttctctgaagaccttacnatttctattacttcaaaactcccnntanatcanccttctactacnagagtgaanggaanaccctaacanatctnccctngtganttttacctttgatctacaangcnctcctttcacnnttcnnggtcnttcttacgntanccgnatcctntttcctctntttccccanccatccttccccnataattgccccntcntcnanttaaccctcnctctttgcnttgnaacccctcgcccccctccntcgcnnccctttncttnangatnctccccctngccatccnnacccttcgcnntaacccccancccctctnctaccttttcntccaaaaacgtncctnccatcccctantcggnnantctngnccctcnannnatncntacctctcaanctcnccantcaaaccnccacattcncccanannacaaanncngnnnaccnnnntantccatntntacactctccnnanctcactnctcnccnnntacnctacct

SEQ ID NO: 4464 - DNA, 959 bp, Homo sapiens
  misc_feature 1, 2, 6, 10, 18, 19, 23, 27, 200, 218, 309, 349, 353, 355,360, 363, 369, 376, 384, 388, 401, 413, 414, 419, 424, 432,449, 450, 466, 475, 490, 491, 493, 504, 509, 511, 513, 514,517, 557, 570, 571, 578, 590, 595, 597, 600, 617, 639: n = A,T,C or G
  misc_feature 662, 671, 677, 683, 684, 686, 697, 701, 712, 714, 722, 735,774, 782, 791, 796, 799, 800, 802, 811, 812, 815, 831, 858,860, 862, 867, 868, 869, 870, 871, 884, 898, 900, 916, 919,920, 930, 952: n = A,T,C or G
nngttntttnaattttcnnaagncctncgctttcaaaccttggatcccatcgattcgcttggggtgagtctcatcttcaccctttcaccaactgtcctggtaacaatctcccttccatttccttgttcttacagcataccccatagaatcaagcctcgttattgccagggctgaactgacttttttgtttttgtttttgntttaagcagtaccattgngcaccttgggaaaattcctgtgttgatctaattttaccatattcttcactccactgaccactccaattaggatactcctggcactcttggntttagagaggcttagatatgtggctatttatccttttggncttnancactnggnttttgncttttanctaaaccngganttttcctgggganccaaaaacttgnnaaatngtttnttttcccnaggaagtcttcaaattnngggaaaaccccccaangccttgtgnggggtttttggccanncnaagggcgttantattntngnnctnataatttttcggggttggaaaaacccaactctggttgggnttgggggaatggnnccttttnaaaattttggcnggggngnatntttcttggaataggccnccttgggaaaacccccaaaatncttggaacagcccgcaaataaanatttggggnccttcnctgggnncnttctttaaaanaaanggcctttgggnancctttttnggggggaaaaagntgggggccctatttaaatttcggaaaacggaaatacgtntccctcancaacttttnaaaanaanntncataaaggnnaanaaataacctttggggngccccttttaagaaaccccttttaatntngngaccnnnnnattttaacccttngaatatcccaggancntttggtttaaaggaanccnnttttggatcnaaaatttttggggacaaaaaancccccct

SEQ ID NO: 4465 - DNA, 839 bp, Homo sapiens
  misc_feature 4, 5, 16, 18, 37, 42, 45, 289, 367, 369, 379, 384, 394, 396,399, 400, 425, 428, 488, 504, 532, 599, 603, 632, 651, 679,683, 684, 692, 696, 700, 704, 742, 744, 749, 755, 757, 776,778, 779, 781, 782, 786, 791, 807, 808, 809, 810: n = A,T,C or G
  misc_feature 814, 823, 824, 825, 830, 831, 833, 834, 839: n = A,T,C or G
tggnnttttgaaattncnttagggcctgctcttttcnaatcngtnggacccatcgattcgtcctattttacgtggttgttgagaggatccgatggaatgactagctgaaagtgtttgtaaaagtcaggataagtaaagcaatgctgcaggaacaaacaatccccaaatttcagcagcttactacaaaaaaatatgtatttctcactcatgttcatgtccaatgtgtgttagcaaggagatactgtctctcacagtcatgcaagaccccttgctggggaagctgcacctncatatatgcttctaccatcaccagggcagaggagagggagcatggtggatcatcactggctcttaagactttacttgngngacatatgtnacctntactcatggntnatnnggccaaccaattacatgggcatagnctnactttaaaaagggcaggagaagtgcaaacttatcatgggccccaaggagaagagaatcanagtatttctgaacagntttaatttttggccagaccttgaaagtncttaagaaattagcttccaaaaaatattatggaatatttttcaattcttccaaagccagcctggtantttnggattcaccaaccgggaaaggtccctggnaacttcttaaaacttggcnaggggaggccttttaccttggaatggtncaannaaatttanctcnattnaaantttcaaaccaaggggtcaaaaattccaaccgaatgttnanccaantggggncnccaaacctttgaaaccccngnngnncccnctttnacttaagcttacttgnnnnaccngaactgggnnnaaaanntnntcccn

SEQ ID NO: 4466 - DNA, 874 bp, Homo sapiens
  misc_feature 2, 3, 4, 5, 6, 7, 8, 9, 10, 16, 17, 18, 19, 20, 21, 28, 145,191, 212, 230, 239, 264, 272, 286, 296, 299, 331, 332, 336,353, 356, 359, 361, 407, 428, 443, 493, 509, 511, 514, 519,522, 537, 542, 545, 550, 560, 565, 568, 569, 575: n = A,T,C or G
  misc_feature 583, 594, 598, 600, 601, 605, 606, 607, 611, 652, 671, 672,684, 692, 696, 701, 717, 730, 742, 746, 747, 770, 775, 796,797, 805, 808, 813, 818, 819, 823, 826, 827, 832, 839, 844,846, 858, 870: n = A,T,C or G
tnnnnnnnnnaagagnnnnnntttgaanctaatgctgggctacttgttctttttgcaggatcccatcgattcgaattcggcacgaggcggctggcggcaaaacctctcgatgagcccctgcccgatgccgcgggggagaggccgngacgggaccgagaagtgggctgggagcagaggtcgcggatgtggcnagcgaggccggggcccatgcngggaccggaaggggcccnggagtggcnggcacgccagggtcagggtgccggncgaggganggggcccggggttngggaaggggnccnggtgagggaggttaaacagccttgcaggcctnngggnaccgatgttggacggcnccngcngnatgtgcgagggcccgtcccgcatctcggggcccatccccacatacngacgctctgtcctgacaactncatgctgccgactcngctcaagggcgcctcgatggaaaccgctgaactggacttgctgacttccnacgggccctggacacnancgntgccnctnggcccctggcattangtccnggnggccngaaaaggatnctggnagnnccggtncagcgccngcctttcgggngacntnncttnnntgcnaacttcgagggggggatcttaaccttaaggttccctggggngcccttttttttaaaagannggaaaagggacncccttaangggnccccnttgaaaaaaagggatntaaacccttgganggcccggggttncaanngggaaagaaattttcaaaaaaancctcnttttttaaaaaaaaaaacccnngggaaacnctntttanccccnngggnaanncctanggggggnccaantnccccaaaagggnccccccctttgnaaaa

SEQ ID NO: 4467 - DNA, 749 bp, Homo sapiens
  misc_feature 5, 6, 9, 10, 12, 22, 37, 50, 82, 83, 96, 97, 102, 103, 113,115, 116, 123, 126, 127, 138, 485, 602, 623, 630, 688, 706,709, 719, 724, 748: n = A,T,C or G
agagnnttnntntttgactttnatgcttggtctactngttctttttgcangatcccatcgattcgaattcggcacgcaggtnngatcctgcactcnntttanngagcccttgncnnaatgccntgnnggagaggccgngagcgggaccgagaagtgggctgggagcagaggtcgcggaggtggcgagcgaggccggggcccaggcggggaccggcaggggcccgggagtggcgggcacgccagggtcagggtgccgggcgagggagggggcccggggttggggaagggggcccggggagggaggtaaacagccctgcaggcctcggggcaccgttgctgggcggcgccggcggcatgtgcgagggcccgtcccgcatctcggggcccatccccccagaccgacgctctgtcctgacaactacaggcggccgactcggctcaagggcgcctcgagggaaacgcgctgaactggacttgctgacttncgacgggccctggaaccacgtccccgtggcccctgcatcggtcccggtgccggagagatcctggagcgcggccacgcggccgtcggggacgtgctgttgcaactcaggggggatctncctaggtcctggggcctcttntcaagangaaggacccttaaggaccatgagaaggagaacctgagccggatcaagggagatttaanaaacctttaaaagaacanganccccaacccngggancaagggccaagccaaggccccttna

SEQ ID NO: 4468 - DNA, 740 bp, Homo sapiens
  misc_feature 5, 6, 7, 8, 9, 10, 16, 19, 27, 28, 35, 695, 734: n = A,T,C or G
agagnnnnnnttgtanctnatgctggnntagcgtnctttttgcaggatcccatcgattcgaattcggcacgaggcctcccgaccccccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaatgggacgttgccacaatgacaggagtatttaaattttgagaagagtagttcaatctctcgatatggagcctctcaagttgaagatatggggaatataattttagcaatgatttcagancttataatcacaggtttcagatccagagagagtggattncaagtt

SEQ ID NO: 4469 - DNA, 745 bp, Homo sapiens
  misc_feature 4, 5, 8, 9, 10, 12, 14, 28, 29, 42, 50, 228, 482, 486, 514,614, 642, 673, 677, 699, 712, 725, 735: n = A,T,C or G
agtnnttnnntnangaatccttgctggnnccgcgtggctttntgcaggtngcccatcgattcgaattcggcacgaggcctcccgaccccttttctccccctccccacctatcgtcatgacggcctctccggattacttggtggtgctttttgggatcactgctggggccaccggggccaagctaggctcggatgagaaggagttgatcctgctgttctggaaagtcgnggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggctnccangaagaatgtactattacctgaatgcttntattccttttttgacttcgaaaagaattcaagaaatgttgccctggttcacctgatattgacaaactgggacgtttgccacaatgacagagtatttaaantttgagaagagtagttcaatctctcganatggagcctttcaagttggaagatatggggnaatntaatttagcaatgatttcaganccttataatccanggtttcagatccngagagagtgnattacaagtt

SEQ ID NO: 4470 - DNA, 735 bp, Homo sapiens
  misc_feature 4, 5, 8, 9, 12, 19, 27, 28, 29, 88, 507, 579, 588, 618, 673,685, 689: n = A,T,C or G
agtnnttnnttntgactcnttgctggnnnagcgggctttttgcaggacccatcgattcgaattcggcacgagccccacccattagttntgtgggcctgcccaacaccttcctgggttcacatccggccagacaagaaagaagccaaaaaactttccgtctaccactgcgcctcctcatgcccaccccatcctattagcctaaaatggaacgggctaattagtttatttgtatagggaggggtttcagctgcctggacaaaaccaggagtccactgtccaagcttcttctgttttcctgagctcagaagaaaaaaagtgtgttagactaagataataccgccttttgaatatctcggcttcatatttgcctccatgagtgagagggccaagtgttatctgcaagttgaatcttctatattcaaaaatctccatcccttttttctgccagcgcattcccagatcagccgttcacttgctctaagcctctataatctatgattttctttnctctttaacctgctctttccattggccagtttattcatttctcagctacagcttcagaggggctcaccttcnggcttccgncccaagggcatctggaggcttcagttctgntttctctgctgagtcaggagccagcccacttgatttggctcccgtgtatctttgngtctctgctcantctnctgctagtgtgccttgggtgcctcatcaatctctttccatcctggg

SEQ ID NO: 4471 - DNA, 741 bp, Homo sapiens
  misc_feature 5, 6, 7, 8, 9, 10, 15, 17, 28, 29, 56, 624, 626, 681, 683,685, 693, 703, 711, 740: n = A,T,C or G
agagnnnnnnttttngnctaatgctggnntactcgggctttttgcaggtagcccancgattcgaattcggcacgagccccacccattagttaggtgggcctgcccaacaccttcctgggttcacatccggccagacaagaaagaagccaaaaaactttccgtctaccactgcgcctcctcatgcccaccccatcctattagcctaaaatggaacgggctaattagtttatttgtatagggaggggtttcagctgcctggacaaaaccaggagtccactgtccaagcttcttctgttttcctgagctcagaagaaaaaaagtgtgttagactaagataataccgccttttgaatatctcggcttcatatttgcctccatgagtgagagggccaagtgttatctgcaagttgaatcttctatattcaaaaatctccatcccttttttctgccagcgcattcccagatcaagccgttcacttgctctaagcctctataatttattgttttcttttctctttaacctgctctttccattggccagtttattcatttctcagctacagcttcagaggggctcaccttcgggcttcccgccccaagggcatctggaggcttcagttctgntntctctgctgagtcaggagccaggcccagcttgatttggctcccgtgtatctttgngncnctgctcantctctgctantgtgcctngggtgcctcatcaatctcttccatcctgng

SEQ ID NO: 4472 - DNA, 743 bp, Homo sapiens
  misc_feature 5, 6, 7, 8, 9, 12, 15, 26, 140, 325, 331, 332, 333, 334,335, 351, 357, 369, 396, 443, 492, 501, 508, 510, 525, 561,575, 578, 650, 669, 677, 688, 719, 725, 736: n = A,T,C or G
agagnnnnnttntanctaatgctggnatagctgggctttttgcaggatcccatcgattcgaattcggcacgagcttgattaggtctttaggggccgagggactagccagctgcacaggtgactggatgggggaggggcangtgaggtgggtctacagaggtggcttcgcctttgaccttcatgctggtctcggctgaggtgacacgctagtgacagcccaatagggggttacccttattgagtaaaatacttcagattgacagctcaatcttagtttgcctccagttaatcttttatgcttagggattaaatgtgtggttttttntttgtnnnnnttttttggagacggantctcgntctgtcacccangctggagtgcagtggcgcgatctcggntcactgcaacctctgcctcctgggttcaaacgattctcctgcctcancctcccaagtagctgggattataggcgcccaccaccatgcctggctagntttttattnttagtananatggggtttcacccntgttggccaggctggtctcgaactcctgacctgctngatctacccacctnggnctcccaagtgctgggattacaggcgtgagctaacatgcctggccaggggattaaaatattcaaacatgttgngtgtacccagatatgctgntaatttangaaaaacagtncaatttctatgaaatgggtggggactatttnctgtantcaatacattngggatat

SEQ ID NO: 4473 - DNA, 749 bp, Homo sapiens
  misc_feature 5, 6, 7, 8, 9, 10, 16, 28, 31, 37, 49, 336, 612: n = A,T,C or G
agagnnnnnnttgtanctaatgctggtntantctgtnctttttgcaggnatcccatcgattcgaattcggcacgagcttgattaggtctttaggggccgagggactagccagctgcacaggtgactggatgggggaggggcaggtgaggtgggtctacagaggtggcttcgcctttgaccttcatgctggtctcggctgaggtgacacgctagtgacagcccaatagggggttacccttattgagtaaaatacttcagattgacagctcaatcttagtttgcctccagttaatcttttatgcttagggattaaatgtgtggttttttttttgtttnttttttttggagacggagtctcgctctgtcacccaggctggagtgcagtggcgccgatctcggctcactgcaacctctgcctcctgggttcaaacgattctcctgcctcagcctcccaagtagctgggattataggcgcccaccaccatgcctggctagttttttatttttagtagaatggggtttcacccgtgttggccaggctggtctcgaactcctgacctcgtggatctacccacttggcctcccaatgctgggattacaggcgtgagctancatgcctggccagggattaaaaatattcaaacatgttgggtgtacccaaaatatgcctggtaatttaggaaaaacagtccaatttctatgaaatgggttgggactattttctgtagtcaataccaatggggatatct

SEQ ID NO: 4474 - DNA, 750 bp, Homo sapiens
  misc_feature 6, 7, 8, 750: n = A,T,C or G
agtgtnnnctttgaaaccttatgctcggtatagctgggctttttgcaggatcccatcgattcgaattcggcacgagagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcaatggttacggctgtgaaatttacaatttctgaccattcacaacctattgatccactgttaaagaactgcataggtgatttcctaaaaactttggaagacccagattggaatgtgagaagagtaacccttggtcacatttaattcn

SEQ ID NO: 4475 - DNA, 745 bp, Homo sapiens
  misc_feature 3, 5, 6, 7, 8, 9, 10, 16, 27, 33, 580, 676, 712, 745: n = A,T,C or G
agngnnnnnnttttanctaatgctggnctactngttctttttgcaggatcccatcgattcgaattcggcacgagagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcangctcatcatatgcccgaagctcaatggttacggctgtgaaatttacaatttctgaccattcacaacctattgatccactgttaaagaactgcatangtgatttcctaaaaactttggaagacccagatttgnatgtgagaagagtaccttggtcacatttaattn

SEQ ID NO: 4476 - DNA, 1304 bp, Homo sapiens
  misc_feature 2, 3, 11, 13, 17, 19, 27, 32, 35, 37, 48, 59, 60, 61, 62,71, 78, 137, 138, 166, 183, 199, 203, 217, 218, 222, 223,225, 232, 239, 249, 250, 252, 259, 262, 273, 277, 293, 294,295, 297, 315, 317, 330, 339, 342, 343, 353, 355, 376: n = A,T,C or G
  misc_feature 382, 387, 390, 392, 397, 400, 407, 410, 413, 415, 422, 426,429, 432, 437, 444, 449, 452, 455, 457, 464, 466, 469, 471,477, 478, 479, 480, 485, 486, 488, 490, 493, 495, 496, 498,506, 507, 508, 518, 521, 523, 524, 525, 526, 529, 531: n = A,T,C or G
  misc_feature 534, 537, 538, 549, 554, 558, 561, 566, 570, 573, 574, 582,583, 588, 592, 594, 595, 597, 601, 602, 605, 609, 611, 617,618, 635, 639, 645, 664, 666, 673, 676, 680, 684, 691, 700,705, 706, 707, 708, 715, 720, 724, 725, 727, 737, 740: n = A,T,C or G
  misc_feature 745, 747, 751, 752, 754, 756, 758, 761, 764, 770, 776, 777,781, 782, 783, 786, 787, 794, 795, 798, 799, 801, 807, 810,816, 820, 823, 827, 834, 840, 841, 845, 850, 855, 857, 859,865, 867, 869, 873, 875, 880, 885, 889, 891, 896, 902: n = A,T,C or G
  misc_feature 908, 914, 917, 918, 925, 926, 928, 932, 935, 944, 947, 949,950, 951, 952, 953, 954, 957, 958, 959, 963, 964, 966, 967,968, 971, 980, 999, 1003, 1007, 1024, 1025, 1027, 1034,1038, 1041, 1042, 1043, 1044, 1045, 1055, 1057, 1063, 1066: n = A,T,C or G
  misc_feature 1070, 1074, 1079, 1081, 1088, 1089, 1091, 1098, 1100, 1105,1113, 1117, 1119, 1120, 1133, 1134, 1135, 1137, 1141, 1144,1148, 1150, 1151, 1156, 1160, 1168, 1173, 1176, 1179, 1181,1183, 1185, 1187, 1189, 1192, 1196, 1197, 1203, 1207: n = A,T,C or G
gnnagcgttcncncttntnggaaaccntttcnaantngctggggaacnccgaaatcgcnnnnagggtcgcnatgcgantcgcaaagtcataccaaaacttcacttaagtagtccctatttttactccagtgcttatnncattatctagcagaatgtaccttcattngatccactatttaccantgattaaagtggagcngtcngtggagttatacgnnactnngnagacttntgtctancgaaatacannanacaaccncanaggaccataantttnatgcctatagaacatnnnangaaacaggagcaggatcntngtctataatatancaaacttgnttnnacatacctancnacaacctacaaatgctcttanaaccancctanctnantgctnccnagttttnctnggntnaactccnactnttnggngcaantgcaggntcacntanctncnattcccnantgnanaaactnnnnccccnnananctntnntntagctcannnctctttaacnacntnnnnatncnttntannatcagccaggncaccnacantanttcanttcnttnnccaatcannactgnaatntnncncttnnctntttncncttctnnctaacatcacggctatncgcntaaatnttctacactcacgggtgananactcggnctnacantctncgggagnctatacctntcgcnnnncacagtntgcgntatnncncaataagaanaanatctncnctcnnananantcnccnttcctnaaccannacannntgnntctcatnnacnntncgtaangcnagtacncgcntantcancatactnacatannagtntatcnaactntncncttctntnanctananacgtntcacncttncntatanaactcntattanactcanacnngctcctnngngatngtnctctctatnganannnnnncannnctanngnnnatnactccgacngtacacctatataatagantctntacncctctattcatcagatnnanttctcanaganttnnnnntaacattatncncactanacnatgntcanccctnanattcggnncnctacacntnctacnccatctcnagcntnntacttctcacaannnancctnctntacncnntacanatantatcacanatccncgnaantntntntncntcntagnngtacanactncantctatntctacnnataaatatntcctatcnnctcanatcncncntntantcngntacgnntntcgcanncnctcctcatcntntcngnacncnt

SEQ ID NO: 4477 - DNA, 732 bp, Homo sapiens
  misc_feature 2, 7, 27, 29, 437, 454, 500, 504, 516, 523, 555, 560, 568,596, 607, 612, 633, 634, 640, 655, 659, 660, 680, 706, 708: n = A,T,C or G
cnaaatncctgctacttttgatttccngnaggatcccatcgattcgccgatttacagattgaagcggtaaattagtggttttatggtatttctgtaaacagggataaagtggaccctgacaaattcaatattgtctgaagagacaatctattctggttctgttggacttcagggtatttttctttttttgtaaaatgaaaactacaaagaaacctgacttttcaattttttatacatgtaattttctagaaatctaggaagtcatttacacatccttatataccatgaggggcaaaagtaagctttcttcctcccaaagcaaaactctttttccttaaggagctggaatgccaccttgaaattctgagttttgagctttcagtcattttttggctggaataggtgggtgaaatttcctaagtctgctctgtgatgtncccctgaagggatgcancatgaaccattggtccctttatgcgatcatgtcccgggctgcactnacanggtttggggcanaaaaaanccaaacatttcacccacaggcaagcttgcttntcggnaacccccnaagctgggtcctgcgacagaatttggtnaaggacccttnaccgnttggtcactggctgcatttgnngccaanacccccccccgcctnattnngaggattttaaaatttggantgggttggctggccttgcacttccgnancttatgcctaaaaaaaattttcct

SEQ ID NO: 4478 - DNA, 1278 bp, Homo sapiens
  misc_feature 14, 20, 21, 28, 29, 32, 34, 36, 38, 42, 165, 166, 168, 171,178, 179, 182, 184, 187, 188, 192, 199, 201, 203, 209, 210,211, 223, 224, 225, 229, 230, 233, 234, 235, 236, 237, 238,241, 243, 246, 248, 250, 253, 256, 258, 262, 264, 265: n = A,T,C or G
  misc_feature 269, 270, 273, 277, 281, 283, 287, 290, 297, 298, 299, 300,303, 304, 305, 307, 308, 309, 311, 317, 322, 323, 325, 326,331, 333, 334, 337, 339, 344, 346, 349, 353, 355, 357, 360,365, 368, 373, 375, 376, 379, 382, 384, 389, 390, 394: n = A,T,C or G
  misc_feature 395, 401, 409, 411, 414, 416, 421, 422, 424, 425, 427, 428,434, 439, 440, 443, 448, 449, 459, 460, 466, 470, 473, 476,479, 483, 488, 490, 491, 495, 496, 499, 500, 502, 503, 507,509, 512, 513, 514, 515, 521, 523, 524, 525, 529, 530: n = A,T,C or G
  misc_feature 531, 533, 539, 541, 544, 545, 548, 549, 551, 554, 561, 566,569, 590, 596, 602, 613, 614, 619, 623, 624, 626, 631, 632,633, 635, 644, 645, 649, 652, 662, 669, 670, 671, 684, 685,691, 692, 693, 695, 697, 698, 703, 704, 709, 714, 715: n = A,T,C or G
  misc_feature 716, 717, 722, 724, 731, 733, 734, 736, 737, 739, 740, 741,744, 747, 748, 751, 753, 755, 760, 766, 767, 769, 770, 772,775, 776, 777, 779, 780, 781, 783, 786, 790, 792, 794, 802,803, 808, 812, 814, 816, 818, 825, 826, 828, 833, 836: n = A,T,C or G
  misc_feature 837, 839, 843, 854, 855, 858, 868, 869, 870, 871, 874, 878,879, 884, 888, 889, 893, 896, 899, 900, 904, 906, 907, 908,909, 912, 917, 918, 919, 920, 922, 935, 941, 942, 947, 948,950, 954, 966, 967, 968, 970, 976, 979, 982, 988, 989: n = A,T,C or G
ctaccgccttatgntatcgnnctttccnnaanananangctnggcgaattcggcacgaggatctatctcttctccctgcccattaaggaatcagagatcattgatttcttcctgggggcctctctcaaggatgaggttttgaagattatgccagtgcagaagtcnnanccnccccccnnccncntcnncacncccctcncncnttcctnnntcccccctcccnnntccnnccnnnnnnctnancancncnctnacncnctcncnnctcnnccncccnccancncccnacnccaaccnnnnccnnncnnncncaccanccctnntnnccccncnnatntnctccnanccntacncncnctnttccntcntctcncnntcnccncnccttnncacnnctctcntacctccncnctncntcccnncnncnncccccntctannacncctanncacccccccnnatacanctcnccnccnccnttcnccccncnntcanntcnntnntccncnctnnnncctccncnnntttnnnantccaancnacnnccnntnccntcttctntatcnctnccttaccctcctccctactcnctctcncctccncctctccctcnncctcntctnncntctcnnnanctctcctcnncccnccncactttccanccttctnnncacacccattccnntacacnnncncnnccctnncctcntcacnnnntctcncnctcctcncnnanncnnnctncannacncncnctccnctctannanncnccnnncnnncnccncctncncncatctctnnctctnctcntntncncatctcnntnttctntcnncncacncacttccactnntcnctcctcctannnncanctcnnttctncccnncacnatnatnnaccncnnnnctncatcnnnntnatcccctctctcnctctcnnttcanncncacnacttccctcccnnntnctatcncantcnttcacnncnctcttccnctntatatntnntacnctcncctctcaccttcacatcatnatacnacnacacntctatnnannctcncnctctancnctnnntacnnccannnncnnctncaccnncntcctttccncctntctctnctnncatctnnnntnantctntcanntctctntcntnctcttnnactctncncnnctnncacnactntctatncnnccacnaatcancatcnctcctctctnnccntctntctnnnctctntactnancacatntntcnctntctctcccct

SEQ ID NO: 4479 - DNA, 762 bp, Homo sapiens
  misc_feature 2, 3, 4, 7, 8, 10, 11, 14, 15, 16, 19, 25, 37, 118, 153,163, 169, 195, 207, 218, 229, 240, 279, 463, 514, 527, 534,535, 572, 755: n = A,T,C or G
gnnnttnnannccnnnttncaaatngctaggctactngttctttttgcaggatcccatcgattcgaattcggcacgaggctgtttcctcaagaaaatgaagagggaaggatggctcanggaaagttaatcagagggaaaatgtcactctgtanagagtaaaanatttangatgatgatacgatctgggaaaaaanggcatagtgaanaccacttaaanacaaactgaancctatgaaggngcatgctatttccccagagctgaaaagataagtgaaatngtgtatgaactcttaagtggaggtgaagcagaatttattagccaccaaccacataagtgattatgaagtaactgagaaacaggtaacattttttcccacatggacaaaactttctctttctagaatattaagtctctatgatgagaaatgaagtagcatctcaagcagtttataaatctaccanaatattagaatcacctgggacctttgaacgtactcatgcccaggtctactntattcatttattnttttgtnnagatggggacttcaactcctggtctcaaatgatcctnccacctcggcctcctaaagtgtgaggattacaggcgtgagccctgtggccagccctactaggtctgctttggaccaattaaatcaatctctgggggtggaacctgggctttaagtatttttaaaaattttcctaggtgggtctaattaatactcggattgagaaccctgctacacatggaatnttattcc

SEQ ID NO: 4480 - DNA, 770 bp, Homo sapiens
  misc_feature 2, 5, 11, 13, 23, 31, 34, 37, 38, 39, 44, 45, 733, 745, 757,770: n = A,T,C or G
tnacnaattantntgctctcgtnctttccgnaanaannnggcgnntcgttgagacggagtttcaccatgttggccaggatggtcttcaacttctaacttcgtgatccacgctgctgggattacaggtgtgagccaccgcgtgtggcctctgggcaccttttgaagctgaagcagagagagaaggcggcaggcatcagcgttttcttctatgaacttataagatcaaagactttaagactttcactatttcttctaccgctatctactacgaacttcaaagaggaaccaggagtacggaaggagcatgaaagtggacaaggaacgtgaccattgaagcaccacagggaggggttcaggcctccggatgactgcaggcaggcctgggtaacatccagcctcccacaagaagctggtggagcagagcgttccctgactcctccaaggaaaggagactccctttcccggtctgctcagtaacgggtgccttcccagacactggcgttaccgcttgaccaaggggccctcaagcggcccttatgcgggcatgacagaaggctcccctcttgccttctattcacttctcacaatgtcccttcagcacctgaccctatacctgccggttattcctaggttatattattaatgcaacagagtaatattaaaagctaatgattaataatgtttataataatgatggataattggttcatgatcatcgctgtatctaatttgnattatgactatncttattctattntctttatatactn

SEQ ID NO: 4481 - DNA, 770 bp, Homo sapiens; identical to SEQ ID NO: 4480
  misc_feature 2, 5, 11, 13, 23, 31, 34, 37, 38, 39, 44, 45, 733, 745, 757,770: n = A,T,C or G

SEQ ID NO: 4482 - DNA, 928 bp, Homo sapiens
  misc_feature 5, 6, 15, 16, 27, 30, 31, 35, 36, 39, 42, 43, 48, 57, 63,64, 68, 69, 80, 82, 84, 85, 86, 87, 98, 105, 125, 131, 142,144, 168, 172, 190, 208, 216, 231, 243, 262, 275, 281, 292,294, 297, 304, 307, 315, 323, 328, 337, 345, 354, 375: n = A,T,C or G
  misc_feature 379, 388, 392, 403, 408, 420, 421, 426, 427, 428, 434, 436,448, 454, 455, 458, 461, 463, 472, 474, 481, 482, 493, 508,515, 521, 528, 530, 535, 536, 542, 545, 546, 549, 553, 559,560, 563, 569, 573, 576, 580, 586, 588, 589, 592, 595: n = A,T,C or G
  misc_feature 596, 601, 602, 609, 616, 619, 625, 626, 631, 633, 639, 641,642, 645, 647, 649, 652, 657, 663, 665, 667, 668, 670, 676,684, 685, 690, 694, 695, 697, 700, 702, 711, 721, 726, 739,743, 746, 751, 752, 769, 774, 782, 786, 793, 794, 796: n = A,T,C or G
  misc_feature 797, 798, 805, 806, 812, 813, 815, 819, 820, 822, 823, 826,839, 848, 849, 851, 852, 855, 856, 858, 863, 866, 867, 871,872, 873, 874, 880, 882, 883, 885, 890, 891, 892, 895, 900,902, 908, 910, 922, 924: n = A,T,C or G
ctaannattaattanntagcctaaatngcnnaacnntgnttnngcttngggcccaancatggnncctnntaagtaagatntntnnnngggagctgganaatcagnactgtcccagccgatgggtngttccnactgggagcanangaagccttgaggacctactcacanatangaattgaagattatcttnaaaacaatcttccactanttctgacnatacttggagcctgntccacgtgcatnccaccttgggaagcctctncaaagagctttcngagctnacactgacagntncantttcccncanaacccacnatagcctngctgngtctgtctncccggcangagtccatnctcactgccgggacactcatnacantctccacgntctncctcttcccancctgnatggagcctccnnggctnnngaacgntncccaagtcaatnctcacnnatnccngnagctgcctntnagcactnntcttggcccanctccctccttgacanaatcatnacccancatgacncncactnngccatnccnntcnacantttttnntcntcattncatnttntctncccatngnnacntcnnaaccnnctagtanaccccancantctcgnnatctncncaaccngnncancnanacntttgntctttntncnntntgatcntccacctnntcttntctnncnatntncaataatcntaattcctanacatnctactcttaaacntccnttncttannttcccacacatctgttnatacntatccctncctncccatgnntnnnatctcanntccccnngncctnnannatnttactcagccctntcctttatnnanntcnntncaccncgnnagtnnnnccatancnnanatttnnncancacancnctctcntnttttcaaacctncncccg

SEQ ID NO: 4483 - DNA, 781 bp, Homo sapiens
  misc_feature 5, 11, 23, 25, 27, 28, 37, 49, 623, 661, 704, 732, 748, 769,770, 780, 781: n = A,T,C or G
gaacntatctntgtgtagctcgnantnncctaaatanaataggctgggngaattcggcacgagagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgnctcttcaaccatctggggtgccaacaagtggaccatcntcagaccaccatacacttactacctacagcttcaactacccgngaatgtaacacatcgtccagtaactcangtgacccacaagaatnccctgtaccaagagctccttnnaaaccaccann

SEQ ID NO: 4484 - DNA, 924 bp, Homo sapiens
  misc_feature 6, 12, 15, 17, 19, 26, 30, 37, 39, 41, 42, 531, 533, 535,537, 538, 539, 540, 542, 543, 547, 548, 550, 554, 562, 563,565, 567, 568, 575, 578, 583, 584, 585, 587, 589, 592, 603,604, 609, 614, 616, 617, 620, 627, 638, 643, 650, 653: n = A,T,C or G
  misc_feature 656, 657, 660, 661, 662, 670, 673, 679, 691, 693, 695, 699,702, 709, 710, 711, 712, 713, 719, 721, 723, 724, 726, 732,736, 740, 741, 745, 748, 749, 753, 754, 757, 759, 771, 773,774, 776, 779, 783, 792, 794, 798, 802, 803, 810, 814: n = A,T,C or G
  misc_feature 816, 817, 818, 820, 823, 827, 829, 831, 832, 833, 835, 842,844, 847, 850, 853, 855, 856, 858, 860, 861, 862, 865, 866,867, 869, 870, 871, 874, 875, 881, 882, 889, 894, 895, 896,900, 902, 903, 907, 908, 910, 911, 913, 917, 920, 921: n = A,T,C or G
ctaacnaattantgngnangctcgtncttnccgaacnanannggcgggggcgaattcggcacgagatttagtcactagctataatacatttagtgaacaaatgtagtcttgcactaaaattagagaatacctatccttttcaagaatacataaaataatgaccatatatataccacagagtaagctgcaaccaattctagataacttaaatacagaccatgtttggaaatttaagaaaaaaaaacacatttataacttgtggatcaaaaaagtcatagaacttagacaatacttggaactgaatgtaaatacaaatgctattaaaatttgtagtatgcagttaaacaggacttgtatacgcatttatatatctaaatgcatgtattagtaaagaaaaacaaatagaaaattaagtttccaactgaaaaagttagagaacaacagatccatcagaggaagtagacagaagttataaagagttataaaggtaaccaggcatggtggtgcacaccctatagccctagctactcngnangnnnngnnggtnncnaggnttgcttgnncncnngaatccnacngtccnnncngnccnattgatcggcnnctgcncaatngnnctncttctancctcacccctnggtcnaccatanggnganncannncatactcntcngcacancctatttcctcnananggtnggntcctccnnnnnatcttncncnncntctcanctancttnncatnttnnctanntcnantcctccatattncnncntcncccnactactcgntnacgnctcnnctttctncaanannngngancctntnannngncaacatncntcngtnccncnncntnnnctnnntnnnccnncttctnnctctctntttcnnngcanannccanntnngnctcntcnntct

SEQ ID NO: 4485 - DNA, 868 bp, Homo sapiens
  misc_feature 7, 13, 106, 210, 260, 378, 380, 425, 428, 431, 443, 467,496, 497, 501, 502, 510, 512, 526, 537, 540, 551, 557, 558,565, 566, 567, 580, 586, 591, 613, 614, 621, 628, 633, 634,636, 641, 643, 644, 646, 648, 649, 655, 656, 662, 674: n = A,T,C or G
  misc_feature 678, 680, 689, 691, 696, 700, 702, 703, 717, 718, 735, 742,743, 744, 753, 754, 757, 759, 763, 770, 772, 775, 776, 777,778, 783, 786, 791, 798, 799, 800, 807, 816, 817, 823, 824,825, 828, 831, 833, 842, 843, 845, 857, 865: n = A,T,C or G
ctaaaanaaggtngggggaattcggcacgaggtcaggctctgctggacactgcatgtccaaacgtcattttacccatgtgccagcgacaaggtagattcgcttgtnccaattttgcacataaggaaacagccttagagaggttaggttgcttgtgcaagcccagggtaggtggcacccagtctgccagtctgcaacgcactggtatcttncagccagtagaccttgctccctgggtgcccagttctggatctcaggaaangtggattaaggctcctagtggcgggacctgggtggggatttgctgccctctggtggcagaagggacatcaccctgggtgtgagacttgtgggcatctgtgaggcggtcttttcatccnanggaagccggacctcaaatctgacctcagccccaggaaggtgccancanganggtgccacctangagggtgccaccagggttccgccngggtctgctggggccctgctccatcttgnntganncacataancnctcaagctgtcacnagacccagggnttnactgtctgggntttganncctgtgnnngccccctgagccnatttgnctttntctcctctttggggcccctcanntttcccnttttcantttannanttctncnnantnnattaannctcccnggggccaaactntatncntaggaaacntncactncctnannaatttaaatttatnntctacacttcaactctnccatctnnnaactgcctnnacncnaatntatttcntnctnnnnctccnctntctanatcatcnnntctatcntcttatatnntcactnnnctnatnanaaaaactanncngtgcgtctttcnttagaacncct

SEQ ID NO: 4486 - DNA, 787 bp, Homo sapiens
  misc_feature 2, 3, 10, 12, 14, 38, 39, 40, 41, 42, 47, 83, 99, 107, 117,123, 131, 141, 143, 148, 154, 175, 208, 216, 229, 232, 242,254, 308, 337, 377, 400, 406, 411, 412, 430, 448, 457, 470,518, 535, 537, 546, 584, 598, 610, 613, 619, 620, 626: n = A,T,C or G
  misc_feature 646, 675, 687, 701, 725, 731, 754, 768, 779, 786: n = A,T,C or G
tnnacaattncncntgctactcgttctttccgcaatannnnntgctnttcgaattcggcacgaggccagtccctggacagctncgacgccatgaatatnttgcccangaagagctgncacgtncggaacanggacaatgtngnccgcntgcggngtgacgaggcccaggcccggnaggaggagaaggagcgtgagcggagggtgctgntggctcancaagaggcccgtncanaattcctacngaagaaagccanacatcagaactcactgcctgagcttgaagcagcagaggcgggagccccaggttntggccctgtggacctgtttcgggagctgntggaggaagggaaaggagtgatcataggcaataaagagtncgaggaagaaaagcgacaggatnaaaganaggcnngagaaagctctgggcatnctgacatacctgggccanagtgcatcngaggcacagactnaacccccttggtaccagcttcccccagggcgagggggccccccggccngtccagccccagatganangatcaagancctctggaccctctgcgggagatgcataagcatctggngaagaagagacagnacggcggtgatnaangcagtnncagctnaaaggaaaaggacgggtctnagaagcattacccaaggagccttcatacnttgaccagcttngaacttgaaccgtntgctgagggaaatcagctgtatangtctcnggcataagcccctgctggccccnggttccaaagcccnggcacttacanggagggnt

SEQ ID NO: 4487 - DNA, 787 bp, Homo sapiens; identical to SEQ ID NO: 4486
  misc_feature 2, 3, 10, 12, 14, 38, 39, 40, 41, 42, 47, 83, 99, 107, 117,123, 131, 141, 143, 148, 154, 175, 208, 216, 229, 232, 242,254, 308, 337, 377, 400, 406, 411, 412, 430, 448, 457, 470,518, 535, 537, 546, 584, 598, 610, 613, 619, 620, 626: n = A,T,C or G
  misc_feature 646, 675, 687, 701, 725, 731, 754, 768, 779, 786: n = A,T,C or G

SEQ ID NO: 4488 - DNA, 789 bp, Homo sapiens
  misc_feature 2, 4, 9, 11, 17, 24, 25, 32, 33, 35, 36, 634, 670, 689, 730,744, 783, 789: n = A,T,C or G
tnanctatngntgtgtnggctcgnnctttccnnannaaaagggctgtggcgaattcggcacgaggagtggatatgttcgtggagacactgtggaaagtctggaccgagctcttggatgttcttggacttgacgtctccaacctgtcccagtatttcagcccagcctcggtgtccagcagcccggcccgcgcgctcctgctggtcggcgtcgtcctcctggcctactggttcttgtccctgaccctgggcttcactttcagcgtcctgcacgtggtgttcggccgcttcttctggatcgtgcgggtcgtcctgttttccatgtcctgcgtgtacatcctgcacaagtacgagggcgagccggagaacgcggtgctgccgctgtgcttcgtggtggccgtctacttcatgaccgggcccatgggcttctactggcgaagcagtcccagcggccccagcaaccccagcaaccccagcgtggaggagaagctggagcacctggagaagcaggtcagactgctcaacatccgtctcaaccgggtgctcgagagcctggaccgctccaaggacaaagtgaaggtcaaccggccgggcgggtccacagttaccagcacgcttgtcttagaaaacgaaaacngaggaaaaaaaccccaaaaccccaaacaatcttaantaaacacgactgagcaaanaaaagttggccctgtgtaagggctattttcacccacccggnaagtttttaggacncatttccccagaagaaccggaaaagatcatttgaccctnggaacn

SEQ ID NO: 4489 - DNA, 1098 bp, Homo sapiens
  misc_feature 12, 21, 26, 31, 37, 38, 40, 43, 45, 46, 48, 52, 53, 58, 62,64, 68, 74, 75, 79, 106, 110, 111, 112, 117, 126, 129, 131,157, 165, 168, 175, 186, 202, 220, 223, 227, 236, 239, 245,248, 258, 259, 266, 272, 281, 282, 284, 289, 297, 298: n = A,T,C or G
  misc_feature 304, 306, 312, 325, 328, 331, 332, 344, 349, 353, 361, 363,369, 370, 375, 381, 383, 386, 388, 399, 402, 403, 406, 407,412, 414, 416, 417, 420, 423, 424, 429, 430, 438, 440, 446,451, 460, 463, 465, 466, 469, 472, 474, 475, 477, 478: n = A,T,C or G
  misc_feature 491, 498, 501, 503, 512, 517, 519, 522, 531, 534, 536, 539,541, 542, 543, 545, 548, 550, 552, 557, 565, 567, 569, 576,578, 580, 585, 586, 590, 592, 596, 598, 599, 604, 614, 619,624, 631, 633, 640, 643, 645, 647, 652, 655, 656, 657: n = A,T,C or G
  misc_feature 659, 679, 681, 684, 685, 692, 694, 701, 707, 715, 727, 733,739, 740, 746, 748, 749, 755, 756, 758, 771, 774, 777, 778,780, 782, 787, 797, 800, 803, 804, 805, 812, 813, 821, 822,829, 832, 835, 847, 853, 856, 859, 860, 863, 871, 879: n = A,T,C or G
  misc_feature 889, 893, 894, 895, 897, 898, 905, 907, 909, 913, 915, 920,925, 931, 939, 945, 947, 951, 956, 960, 965, 979, 980, 981,985, 987, 990, 991, 995, 1005, 1007, 1009, 1011, 1015, 1017,1021, 1022, 1030, 1031, 1034, 1037, 1039, 1055, 1056: n = A,T,C or G
  misc_feature 1061, 1066, 1073, 1092, 1093, 1096, 1098: n = A,T,C or G
ttacttttcctncatccaggnctaantagcnctaacnngnttnanntngggnnttcgntacnantcanctttcnnagtnaccataagagcaaggggaactcgtacnacgnnnacgtngcgctgcancangnggacactggaaactcttacctttgcnggtacttnaanattaaangccttactgangagtatctcacccctntacaactcttctttgaanganaacntaatcatcntanaacacnctnccttaactcnnaagtcgnatgcanatcaacatnntnatccnaaacaccnngggcancntttctngctcctttatcanccnccnnaatcatttaacntcacnatcnacattcgncnatcatnncagcnagacanantgnanacctacatctntanntanntgcantngnncantcnncttgnntcccctancncacctntccanaagatatcnttngnngcnttntnncnnccccactatactnacatccnccntnctcagcaantttantntcnaccctcccnctnangancnnncntancnanccttntcccaacnantntaacaancntnaccannccangntctntnnctctntccctcacantacanaaatntctcaananctccccnacncnanctcanctnnntngtacaatccactcaatctcngngcnncccaccnantctttanctgggnaacctttnctcacatactancgcaanacaatnntcgcgntnnttctcnnanacacatctctccncanctnncntnatacnactatcatcntcnatnnncacttanngaccaaanntacactnganacnactactcgccantttcantanctnntantatcgctngtccactngcatctctancatnnntnnacaaaancncntccncncctanaactntcactntcatctanctctananactntctcnactnacccntcttataccacaannncccnanctnntgcnctcctcatantntntntatncnttcnntactactnnatntananctactactccacctcnnacatngcttntcatatncatatcctcatccttctcnnctncn

SEQ ID NO: 4490 - DNA, 783 bp, Homo sapiens
  misc_feature 1, 5, 6, 7, 11, 13, 19, 20, 24, 27, 31, 33, 474, 504, 525,612, 622, 640, 643, 647, 656, 660, 663, 667, 671, 682, 683,685, 693, 697, 715, 725, 726, 743, 749, 752, 754, 757, 758,778: n = A,T,C or G
ntaannngtgngnggtcgnnctanccnaacnanataggctggggcgatgatgtaaagtctgaaatatacagctttggaatcgtcctctgggaaatcgccactggagatatcccgtttcaaggctgtaattctgagaagatccgcaagctggtggctgtgaagcggcagcaggagccactgggtgaagactgcccttcagagctgcgggagatcattgatgagtgccgggcccatgatccctctgtgcggccctctgtggatgaaatcttaaagaaactctccaccttttctaagtagtgtatcaaaatctaaaccaaggagtctctggacaagaagctgggagaggcacaaactggacatctctctctctcatatccttcggcattgggttatctatgggagcaaggagtgggcacgcttctctgttacaaatagaaaacgattccagtcatacaggacacatccactccaaangatatttccaaaaacatacctctgacagtnactttgatagatggtttggcnaatgtatcttctgggtatccacacctcttggccatgaaatttgcagctcctcccttccataaatgaaagtctctttcccccaccatnttgaaatctnggctggcactgcgacttngantcgnttcaatacnaatngtnggangaangtgactgtttnncntttcccancctnggttttcaagaggccttnttaaatgccnngttggaaccttaccccnccctgnccntngtnnactgaccatggctggaaaantgacc

SEQ ID NO: 4491 - DNA, 823 bp, Homo sapiens
  misc_feature 6, 8, 9, 21, 22, 25, 26, 29, 33, 35, 411, 444, 496, 497,510, 539, 544, 560, 581, 590, 595, 614, 615, 620, 629, 637,640, 642, 643, 655, 657, 667, 679, 688, 702, 703, 709, 711,713, 714, 715, 716, 719, 732, 736, 739, 746, 762, 765: n = A,T,C or G
  misc_feature 771, 775, 778, 780, 788, 792, 793, 797, 802, 806, 807, 809,810, 814, 818, 822: n = A,T,C or G
ctaatnanngtgggacctcgnnatnnccnaaananaataggctggggcgaattcggcacgagagtgtgatctgcagggagagaaccaattacagtatgcttggagagggtgacatttattctgctgaacctcttctctgcttcacataacgttggccacttcacctttcctgagatgtctctgaggatgggcatattttaaagacttgagcttacatcatcgcatcttgaaagaaccgagtataattgagttgctgatacaagtgggtacttgcaccaggtccgggtcacccacatctctatggaaacacatgtttgctttaaagcccagcaatcagaagcagatccttataggagccagcattgggtcacttttagaaaaaggcatttatttatattctcaagccagcanagacctatgaaatgaaataattttcaaattcantagaaaaaccatgccgtacgtgaatgctaataaaagcctgccgtgcgtcctnnctcccctgtgctngcactgcctcagatccgcctgcatttatntttanctgtcctttgctcttntgtgcccatttgcattctgcngctgtgacnaagtnggtttggcccttttatgcnnaaatnggttaatcnttcatttnatnanncattttgcccancnacctaaaaantggggaaaaatntcaaaagcntggggaactggccnntcaaancngnnnnttnctggcggttcctngctnttngccctcngttcccttgcaagccnttntcccanccanccntncccccaangccnncttngaacncttnncnngccnttancaanc

SEQ ID NO: 4492 - DNA, 783 bp, Homo sapiens
  misc_feature 1, 2, 8, 10, 12, 13, 23, 28, 29, 31, 50, 438, 518, 654, 699,718, 730, 765, 779, 780, 781: n = A,T,C or G
nnctaacngntnnttaaaggagntcganntngcctaacacaaataggctngggggaattcggcacgagtgagtacttatgaaaaattgtgagaaattcattgtgtgggattttcaccattactacatgtatttggaaataaaaattgtatgactatgtatatgaaacttgttcatgttctaaaaaataccctccatttataatatgtttttaaaatttgccactgagaagtacaaatttccttcttatttcatcttagttatcaacccagagtcactggaggcaatgcagtgtagtggttaagcgtgcagattctgaagttagacaagatttgggttggaatcctgactctgccacttactagctgggtattcttggaaaggtcagtttccccatccgtaaaatggggataggaatggtaccttcctcatatgattgntcttttttttaagatttaatgaataccttgatgtattcgtcacagtacttgggcatagtaagtgttcgataaatacgtantcccctgtgcccataactgtaatattttactagcactaaatttgtctactaattcttttggttagagaatctcccttgttaaatgactattttacagaatgttttgaactccaaatcaagcctaccacgattaatnatattaagaattttattttaactttataagggcttctaacagtangttaacccaattttaaaangtgaaattcaangtgttccctattaaaacccctattcctgaatgtanataatccattattnnnct

SEQ ID NO: 4493 - DNA, 827 bp, Homo sapiens
  misc_feature 6, 7, 8, 9, 14, 19, 30, 32, 33, 35, 39, 40, 41, 44, 45, 177,199, 439, 467, 469, 470, 479, 504, 542, 553, 564, 578, 581,594, 602, 607, 617, 637, 653, 663, 673, 701, 704, 708, 709,712, 715, 719, 722, 731, 743, 752, 755, 757, 760: n = A,T,C or G
  misc_feature 783, 786, 794, 804, 808, 810, 812, 822, 823: n = A,T,C or G
ctaatnnnnggtantctgngttctttccgnannanaacnnnctnnggcgaattcggcacgaggcttcctgctctttgtattttggctaaaggcggtgaagtgagaggcggagggggatttaaaaccagcagaaaaaggcttcttgttgggctgatggtgtttgtgcgagaagctgangtgggcagggaggagagcctangagagcggtagggctcatgggcaggccgttggtgtacgccttggccctgcctgtccccagtcccaccactgtggactccaggccatcctcagtccaggtggtcactgtggcctgggccacatgctggcgatgacggggatggccttccacatgcctgttctctggaagaggggctcgcgttgtgcccaactggggacgtcctgcccccaaccccccaaaacgctgctttcttctgccctnaagaggcccctcagaagagaggaggctngnntgaggggcnttgagataaaccccgaaaggccggnttcctggcttcgtgttttaaaactcagtgctgcttgcnaagtgctttgnctattgcattnataatgaccaacancgnttggttgaccacnttgatggnccganggggtgccangcacttgttcccaagggccncacttcgtgttggttntttggtccgnttaattcctncttgacaaacctatttacaccggtttcntcnttcnnctntcnagcnaanccccaattntgcaaccccggnggaaaactnaangnccncaccggattcaccaaaaatgccnacnaaccttgntatttccaancccntnancctctcctgnncccc

SEQ ID NO: 4494 - DNA, 776 bp, Homo sapiens
  misc_feature 1, 5, 6, 10, 12, 16, 17, 19, 20, 26, 27, 30, 34, 38, 41,43, 44, 50, 774: n = A,T,C or G
ntacnnatantntcgnngnnactcgnnctntccnaacncancnnggctgnggcgaattcggcacgaggtggcccaaggggcccacaataaataacacagtcactcctattggtacagcaatgccaagatttagaagttatttcataggagctgggacaaaggtcaaacctctctttgggcaagaccgtattctttattgcatagctttgaaaagagattttgtattacccaaacatttattttaaaaaggcacccccatatatccatcactcgaactgtacatttctaaatgtacattgacctttggtatattagtctagcaatccagattttgcctcttgttaagcgtatcagggtcctggcaggaagtagacgacacactgaaggataactgtcaaaagtttaatgaagagactatttacaaaggtgtgggcaaagttaaggggaacaacaagtaagagatggtgtagcatcttagacctagcaacagcagaaaataattgccactcctaactctgaagagataaggagagggaatacttagcagaacacagcaagattgattagtaaagcacagagctcctgacgaggagatgtgaccttcaggagaggaatactacccccaagctatggcccagcagggaaagagcataggtaatacattctctgactcccactttctgatttcctctagtagctccctttggccaaattcaactgattattagagagtaggaattccagttgctgcagtccatagaggttagtctcccnat

SEQ ID NO: 4495 - DNA, 776 bp, Homo sapiens
  misc_feature 11, 13, 17, 19, 25, 32, 33, 36, 39, 41, 42, 48, 691, 775,776: n = A,T,C or G
gtactaatatntnaagntnctcgtnctttccnnacncancnnggcggnggcgaattcggcacgagatgttttgggaaatagcttgtgagaggtaagaaggattgcaaagtttttccaaaatattttatgaagttagtgaagtcagttgaaatgtgtatttaaacatttgaagggatacagttaacatttttttaatgagaggaaaccattgtctgtagttcagaaataagatggagtgttttacttatttaaggggtaatttaaaaagtaaacaaaagcattggcctacaagagaaaggtgatgttggattataagtgctttttctaatcgttaatattaatcaacaggtgagtatattttccgtttccaagcagttattaatttacattttctcaaattataagtagcttcctgcttctccaaaagtgaggcttaagaggatggctatttcatcataaattagaaaaacgactacaaatatgaaatggttaattttttggtactaagataatgagaccatccagaattttatgatcaaaacatggcttttacccagggagtatctgtagttgagccactggctctataacattgttagttctttgtattttcccaatggaggttttacctcatggccataaaaataaaagagggttgaatgtgaaaataactgcattttgaacatctcanacccttcactcataaaaattacttaatgttcctcttccttgaattacatatttttccattgtaataaaattcctgttttgaaann

SEQ ID NO: 4496 - DNA, 846 bp, Homo sapiens
  misc_feature 1, 9, 14, 19, 21, 23, 24, 26, 34, 43, 438, 456, 518, 531,543, 590, 606, 611, 621, 625, 631, 633, 634, 641, 646, 647,649, 652, 655, 657, 660, 666, 667, 668, 673, 683, 685, 687,688, 701, 702, 703, 706, 712, 719, 722, 723, 726, 728: n = A,T,C or G
  misc_feature 736, 738, 744, 760, 761, 762, 771, 774, 778, 780, 782, 783,786, 787, 792, 793, 795, 799, 801, 803, 811, 813, 814, 819,820, 822, 825, 826, 830, 831, 833, 835: n = A,T,C or G
naactaatnaccangaccncnanntngcctaaanaaaaggctngggggattcggcacgagggggcttatttcatccctacagtctcgaccatagaagacagctacacccaagggggccattttagaggcccaccctcaggggcacattctctttctcagggatgttccttgctgagaaaaagaattcggcgatatttctcccatttgcttttgaaagaagagaaatatggctctgttccgcctggctcaccggcggtcagagtttaaggttatctctcttattccctgaacattgctgttatcctgttcttttttcaaggtgcctagatttcatattgtttaaacacacatgctctacaatttctgcacttaacacaattatcacagggtcctgaggcgacatacgtcctcctcggcttacgagatgacaggattaanagattaaaacaggcatangaaatcacaagggtattgattggggaagtgataagtgtccatgaaatcttcacaatttatgnttagagattgcantaaagacaggcntaagaaattataaaagtattaaatttggggaactaataaaatgtccntgaaatcttaaaaaanactantcacactccncccncaactnannccccacnctccnntnccntcncnccnaccctnnnactcnctcctctccncntnnaccccttcccccnnntcntccctncttctcntcnnctncnctctcctncnctcatncccctcactccttctnnncctttcatntcntcancnanntcnncctcnntnttcntncnctctaccntnnccatnncnatnnctcnntntnccttctctcct

SEQ ID NO: 4497 - DNA, 782 bp, Homo sapiens
  misc_feature 9, 11, 21, 22, 24, 25, 32, 34, 449, 507, 556, 615, 635, 654,661, 671, 672, 675, 676, 678, 683, 701, 710, 713, 715, 720,728, 732, 738, 739, 740, 741, 745, 746, 747, 749, 752, 753,755, 760, 764, 767, 776: n = A,T,C or G
acctattantntgatgtcganntnncctaaananataggctggggcgaattcggcacgaggcgggaccctgcctctactaaaaaattaaaaatagctatgcatggtagcacatgcctatagtcctagctactgaggaggctgaggtgggaggatcacttgagctcaagaattcaaggctgcagtgagctatgatggcactactgcactttagcctgggtgacagagtgagaccctatctcacaataaagtaaaataagaattaacacactcataataactatttagttaataggaaactctgtttaagcgatattgcttatatttctctctcatgcttttgtaggtctggactcatcctctcaattatccacagagtatattgttagtgttttgtttaagctaccttttacactcaattaaaactatttactggaagtaggctaaggtnatggggtgagaatagagatggtattatatcatgaaatctacggaagagtttgtagtcntagttcccctgcccccacagagcttattactcttgaagaagctttgacnaattctacatgacttattccccctactttaacaagacctgctatactaaaactataccncagtttttccaagagaatantgcttctaaattatattanctctggntcccatatannctnnancattnctccctttctcttattcnaaagttagnttntnattangactcttntgancatatnnnnttannntncgnncncccgnatantcnggttccctntgggct

SEQ ID NO: 4498 - DNA, 781 bp, Homo sapiens
  misc_feature 12, 25, 27, 29, 39, 48, 540, 635, 647, 659, 689, 694, 741,744, 746: n = A,T,C or G
gtacctatcgtntcgtgcatgtcgnantngcctaactanaattggttngggcggaagagctgaagagtaggaggtggcaggactaactaaaagtgggacagtcacttgttatagtgaaggtagaatggacagaattgggcaactaattaagagggagaaccctctaggagaacaggagaacgcatccaaacctggaaaaccaggaagagaagatccttggtgagaagcagtcaatgagtttgctttgggatatgttgagttcccaaactcatcatgaggtgaggcttccaggtagcaaatgaatcacttgagaccaggagttgaggagcagcctggacaacatagcaagaccccatctctacaaaaaaaaaagattttaaattagccaggtgtggtggtatgtgcctgtagcccaagctacttaggaggctgaggcaggaagatcacttgaacccagaaatttgaggctgcaggtgagctatgatcacaccatagcactccagcctggataacagggtaaaaccctgtctcttaaaacanacaaacaaacaaaaaaccaccaaaatccttatgtatctggtactatagttgtctttctcattttacatttgacactgagagacagagaggttgangagtttgggcangacacacagctnatacatggtagagtcaagccttgagttcangtctnctggccccttatttccaccccgaactttcaccattatcatattgtcnggnangcttggagactcttgaatccctttaactcacccct

SEQ ID NO: 4499 - DNA, 1017 bp, Homo sapiens
  misc_feature 9, 14, 16, 17, 18, 25, 27, 31, 35, 36, 38, 40, 42, 46, 51,56, 63, 65, 72, 85, 91, 92, 97, 118, 138, 152, 157, 169,180, 187, 204, 206, 208, 213, 226, 232, 236, 242, 262, 268,271, 278, 285, 293, 298, 301, 305, 312, 315, 318, 320: n = A,T,C or G
  misc_feature 321, 324, 329, 337, 340, 342, 344, 345, 348, 349, 356, 366,370, 375, 377, 378, 384, 385, 388, 395, 396, 400, 403, 406,408, 412, 417, 420, 432, 435, 446, 456, 473, 478, 482, 494,496, 497, 501, 504, 514, 519, 520, 522, 523, 524, 526: n = A,T,C or G
  misc_feature 531, 545, 563, 568, 570, 575, 579, 586, 591, 594, 609, 610,618, 624, 626, 631, 632, 636, 639, 640, 643, 644, 651, 652,653, 663, 666, 672, 673, 682, 683, 691, 698, 701, 707, 712,713, 714, 717, 725, 726, 729, 736, 741, 755, 761, 781: n = A,T,C or G
  misc_feature 785, 794, 803, 806, 808, 810, 818, 823, 825, 834, 835, 836,846, 849, 850, 852, 857, 863, 867, 869, 870, 874, 877, 884,892, 897, 911, 913, 918, 923, 926, 933, 935, 938, 952, 963,964, 971, 979, 987, 993, 1003, 1008, 1013: n = A,T,C or G
gaactaatncctcncnnngtctaantngccnaacnngntngngttnggggnattgngtaatanantggcagntaccaaagatggntgtctnnagttnctaaatgacatgttgatcggngtcatgatatctgcaaatantcttgtctttcttnacctnagaacaaatgtnaagcattgatnggagcanacacaacagttacgaantntnctgcntggcaactgactnaaagcnaatntactantcctcttaaacttccaaaanagtatncantactacnggatggntctctatncacangcncttngtctgtnacntcnannatntcacntatctaanaanananntcnnaatgatnaatctcaacnaccnccaanannaagttnncgnaccgtgnnagtngtncancntaanttgancgncacttgcctttnctntccccaggcanacgaatattnctccctttttaagcccntccanggcncaacggctcctncnntccncanatcgcaaagnttaannannncntcctnccctcttcaattantcactaccttcaaactcnctcancncattnccgnccctccntctcngcntcacctcgtcacccnntcttcctncaagtncnccctnntaanccnnacnntttcccnnnaacccctccncgnttcctnnactcactgnnctccattntctcccnctncccctncaaannnatnctccctcnntanttcccanctctnactccagccgctancacacntctcgctcacatctaatccnacgncattcactnctctccganatnancnatcgcgtntatangngaacctaannnctatctcacnctnnantctcnctaatnccancnntaanctntttgctncagcacanacacntctctctacactcncnatacnacttntanccatttncntantactccatctacanactctctcatnncaccacncatctctnatacaacncctctntctctctctngctancacancact

SEQ ID NO: 4500 - DNA, 908 bp, Homo sapiens
  misc_feature 1, 5, 7, 8, 17, 19, 22, 25, 35, 37, 39, 40, 44, 49, 59, 118,172, 209, 242, 268, 271, 304, 319, 345, 394, 411, 415, 416,426, 443, 449, 490, 495, 496, 498, 509, 510, 517, 535, 543,545, 549, 569, 571, 581, 586, 590, 598, 600, 610: n = A,T,C or G
  misc_feature 614, 617, 620, 622, 623, 624, 627, 630, 634, 637, 638, 643,644, 645, 650, 660, 662, 665, 672, 673, 678, 679, 681, 682,683, 685, 687, 691, 696, 697, 701, 702, 707, 711, 717, 718,724, 731, 734, 744, 745, 753, 758, 767, 769, 774, 778: n = A,T,C or G
  misc_feature 780, 784, 787, 788, 789, 791, 792, 801, 803, 811, 817, 819,826, 827, 831, 832, 835, 840, 846, 847, 848, 850, 863, 864,865, 879, 892, 894, 902, 903, 906: n = A,T,C or G
ntaangnntgtactcgngntanctngcctaaatanananngttnggggngctgggtgtnggtggattacacgcgtgagccattgcacccagccttaagggaccaggactttatctttntaccctgctgtaccatctttagctttttatctttttattctcatgcttttgttncttcatgatgttaggatggctgccataactccagggnatacaccaatcctctaaacaagaaacaaggggntgagacaaaacactctgagaaggttntcngggaacaaaagacctccaagctgactctgcttnataactcattggctnaaactgagctatatgcccatacttanagcaatcactgacaaaggggaatagcaccaaaacacctctggcttatcntagatcaacctcgattnattnntctgggtttngggttggggccttcttnacctgngaagcaaagaacctcttgccagcttgtccacggctactcangttcnntntacccaacaannggctatngggttagtgactaacttnccacagcncngcanatacatttcgtatagtaacntntttccaagancttcntaanttcacccntngaactatccngcancanatnannnctnttnctanttnnatcannntggtntcaaactcananggnttttcannccaanntnnntntntctnacatnncccnnccctncaantccccnnccgtcntcactcntcntccacccctnnaccccttntcaanacctctacntnttcangctncncttnccnnntnntccctcatnanctcactcntcactntnctctccnncccnncantaccntctctnnncngtcctcctctctnnntccctctctctcancatatcttccttncncatctgtnnccncc

SEQ ID NO: 4501 - DNA, 848 bp, Homo sapiens
  misc_feature 5, 7, 12, 14, 18, 20, 22, 30, 32, 216, 273, 297, 357, 359,367, 379, 392, 405, 411, 412, 421, 428, 434, 435, 441, 453,468, 482, 492, 504, 512, 515, 516, 517, 526, 531, 542, 555,562, 569, 571, 578, 582, 586, 597, 598, 603, 608, 615: n = A,T,C or G
  misc_feature 626, 627, 628, 629, 632, 641, 656, 663, 672, 676, 687, 688,696, 700, 701, 708, 715, 723, 724, 725, 727, 729, 730, 741,742, 757, 760, 765, 774, 775, 785, 787, 791, 792, 793, 794,799, 812, 815, 818, 819, 827, 832, 838, 845: n = A,T,C or G
aatcncngtacngngcgnantngcctaaananaaggttggggggccctctgcttcctggctgaccttggtgtggccctctgatggcactatgtgtcctcttctctgagctttctgaggatgacaagccgtcttttcaatgggactcccttccagacctgttggtctcaccatactggaatcatcataaagcctgtattgtaaaacatcattggtgnctaaagtttgcacaatgctatggcccccacattaagggagtctgggtgagatcactncattgcccctacttctctgaccanaaaacacaagagttcatgggagacaataataacaacaacaaaaacaatacaagaacacantngtacctcnttattggcacantaacttttcaaangctggcatgaatnaaaagnncccaagtcncaagacnaggtgnnctgganccactgctcagnactttccgacagccnacgaaagcacatcnaatgaacaangccttgcattantgggacgnttnnngatatacancccanggaatcatgcncctgttagtccanggggacnagccctntnccatgcncccnctantgctcaaaccnntcatnggcancttgctncatttcgtacnnnngtnggccccttnaatgaaatatcgaancaatttnttaaacccncccnggccttattgnnactttctnaaanncccatcncccttgncttcatannncntnnctcgcccttgnntgcaattctcccctngcnggacntctaatgcnntcaaaactcnancgcnnnnggtcncaacactttttanccntannacaggggnttagncccaanatttccnacc

SEQ ID NO: 4502 - DNA, 775 bp, Homo sapiens
  misc_feature 7, 9, 19, 24, 31, 32, 40, 43, 46, 48, 56, 710, 712, 713,714, 715, 716, 717, 718, 719, 720, 721, 722, 723, 724, 725,726, 728, 729, 730, 731, 732, 733, 734, 735, 736, 737, 738,739, 740, 741, 743, 744, 746, 747, 748, 749, 750, 751: n = A,T,C or G
  misc_feature 752, 753, 754, 755, 756, 757, 759, 760, 761, 763, 765, 766,767, 768, 769, 770, 771, 772, 773: n = A,T,C or G
caatgcncnaaccaattantaagntactcgnnctttccgnacncancnagtgcggnggcgaattcggcacgaggctgagtatttttttcaagtgtatcatttgcctgttaacttaaaattctattttccccctaattctatgtcccagttttggttagtgtgctctgggatttttgacccattccatagtaatagttattactactaccactacagtaaattcttacaagaactttccatgttttttgggaggaggaggaggagtagttacattcaggatcatatacataattgtttagcttcagttctgtatttatatatgtcacttgtaactgactgggatacgttctgagaaatacattctcaggtaatttttgtcattgtgccaatatcatagagtgtacttataaaaacccaggctatatattataacctattctgggcttcaaacctgtacagcatgttactttactgaatactgttggcagttgtaacacaatgataagtatttgtgtatctaaacataccaaaatatagaaaaggtacagtaaaaataagtttaaaaaaaaggtacaccaaaataatcttatgggaccactgtgtatgtggtttgatgtcattatgcagtgcatgactgtactataaatgcttatggccagccctttttttttttgaggcagagtcttgatgtctcgcccatgctgggagtncnnnnnnnnnnnnnnncnnnnnnnnnnnnnncnntnnnnnnnnnnnncnnncncnnnnnnnnncc

SEQ ID NO: 4503 - DNA, 778 bp, Homo sapiens
  misc_feature 3, 5, 8, 9, 17, 18, 20, 22, 24, 33, 36, 37, 43, 44, 47, 48,49, 52, 54, 748, 754: n = A,T,C or G
aantnctnnaacttatnntntntngacctcganctnncctaannagnnnggntngggcgaattcggcacgagataaaggcctagtttttgtatcccaatagatttttaccaagcttcccctgaagaaagtttagaatgagcatgatgggaaaagggagaaattgtatgctgcagatagagggaggaaaggccaactaggtccaacaagtaaaaagaggactagtctcaaactattaaatatatgatttacctagcaaaagctttaagtcacagctgaattacactggggaaacaattacagactttacaatggaaagaagcatcttcaatgttggctgcaatcactgacagcaggaatactcacttttgaaaaaaaaaattggctattgttttctgttttccacatcttagtttaatattatgttcctcaaacactatgaagttgagaactgaattgattacctgggaaattctggtgaaactgaggtgtttgtttcattaattatccatgtcatttatcttcttaacttaatcaacctaaatttagcctgaatattatttgttagggactgaagacttctagagagcagagagcacctttttttaattaaacaaattcctttgataatattttaatgtgactcaagaatccagcactatctatatatggacccctctgcatccatgaaaagaagtcctcatccaattctgtgaatatgagactaaaatacaattccaattatgaggnattttnttttaagtcctaatgcaggaagaa

SEQ ID NO: 4504 - DNA, 792 bp, Homo sapiens
  misc_feature 10, 12, 19, 25, 26, 28, 36, 38, 44, 46, 649, 727, 730, 750,791, 792: n = A,T,C or G
ctaacttatntntctaganctcganntngcctaaananctaggncngggcgaattcggcacgagcactacatgaagtccggggtttggttaaaatatctgtcttatttatgaaaggctgaaaagagaaaagagctattcactacccgagactataagttttagctgataaaaacacagcctcatcaatagctattgaatgaagccacttgctgagtcagtaactgaatgtctatgtatgatatttccagtatcatgattaaaatggagccccgaaatgtcattataaggcctagttgtggactgggggcccagatggccaagtgggagcaactctgaaaccattaaataggaggagagagagaaattaaaaaccttttctattcaaaagaaacctataacccaaattctaaaatttatagagacatataatattaatataacaaaatcagccaccaaaacattcatttctctggatgaaattaattttatggagcagttcaacaaagactttattttaaaaaataaattatgtatttatttttgactagtaatagatgcatgtagtacaaaattcaaaggtacaaaaagggtaaacagtgaaaagtaagtctatctccacctctttcacctagccacccagtttccctncccaaaggcaaccactgttacccatttcttgctatcccttcctaaggataaattggttgcattattccaaacattatntantatatacaccacaccacacnactcaccacatatggtaccatttttttattattcaaatggnn

SEQ ID NO: 4505 - DNA, 779 bp, Homo sapiens
  misc_feature 6, 10, 13, 17, 20, 22, 23, 33, 41, 44, 46, 48, 665: n = A,T,C or G
ctaatnctgnacnaatnggntnngctactcgtnctttccgnaanancnaggcggtgcgaattcggcacgaggtgggctctcccttaaagacacatggccacagacacctccttcgcatatgtaatatgccttcccctgcggccttccgtggtcacagcaacagggactgctcaccccctccagctggggcttttctaacaagcacagtcagaaatgcgcaggcctggggttggggatgaacagaagttgattagtgggcacagaaatacagttagatagaaggaatagttccagcattcgatattacagtagggagactgcatttaacaataattgattgtatatttgaaaacagctagaagaataagaatattcccaacacaaagaaaagataagcgaggtgaaggaaatcccagttaccctcattcagtccattacacattcgatacaggtatcaaaatatcataggcacctcaaagacatgtacaactcttaatttaacatttttgaaagaaaaaaaaaccggccagagcattaaaacaaataaaataagaaacacagaggccagtgttaggtgaagaactccgctgcttcagaaagagaatagcagcgctcgcttaccgtgggaacacggccagttaacaaaatgggttttggttttttgntttgttttgttttaccattggtaataagatagttaacataagtggtcagaacttcgcttgaatttgtataaagcatttgttaagcgtgtaaaagtccaaattaaaagtcttgaa

SEQ ID NO: 4506 - DNA, 805 bp, Homo sapiens
  misc_feature 4, 7, 26, 28, 29, 31, 39, 45, 50, 409, 411, 435, 451, 453,499, 509, 527, 533, 534, 557, 580, 582, 583, 585, 591, 596,597, 601, 606, 610, 620, 628, 629, 630, 631, 648, 667, 669,677, 687, 690, 695, 698, 710, 713, 730, 770, 773, 778: n = A,T,C or G
  misc_feature 781, 798, 802: n = A,T,C or G
aatnctnaacttattatctgacgtcnanntngcctaaanagaatnggttnggggaattcggcagctccctcaaagaaaggagaactaggaaaatgttttcgccatctcccaaagatgataggaaagttctgagcagggttctgggtatagccccttgtgagaaattcaaggcccaatcaatgccatagatgagttatatattccaaatttacactacttatgtaggtgtagtaacctccaaatcaataaattaatataaaattggcccaggactggtgaaacctagagtcctgtcagaagcaaatacaaagcagccctttaacaacagttttaaatttagggccttcaagacccccagctgaaaagaaagtctctactgaaagtgagctcacaatttaacaggagagananagaaagatacactgtgaaggatantcaaaagacattgcananaggaggactggtactgtcccccacccccactaagagcttaagatanaacagcctgnatgagactatgaaatatntttaanntgatgaaagaaaaatgtcacctntccttctttcccagtcaagacangnngnatcccntttgnntaancctanaaantacctgtgtnagatactnnnnttgatcgtgagacgccnatagtcaaacctcttggangnaaaactanacattcttcnatnctttnaanttcccccccccntcnggcccctgtcttcccanattcacctaacttccccttggttgccccccacttaattcnacngcccnttnttttttcactccaaacngggncct

SEQ ID NO: 4507 - DNA, 773 bp, Homo sapiens
  misc_feature 2, 3, 13, 15, 18, 24, 29, 30, 33, 37, 45, 49, 51, 773: n = A,T,C or G
tnnctaaccaatnantcnaggcanctcgnnctntccnaaataaanaggntntggcgaattcggcacgagaaatgctgaatattggtaacaagcaacaggggaaacaaggcagtctgagcacacagaactcaagtcctcctaatgggatcccagaatgcccatggaggaagcagcatgtgcactgtgctgagtgctgagcaggatttcaagagagcaaaggcagagatgctggacagggcagcacaggaggacgagtgtgcatggtcactctgagcagggctggttcctgggctggttggagcacagcatggggaactgaaaggcagacactggccaagaaagtccttgtgcagggcttcagaagtgagcctcacaagccatcctaggccacactgccatcaagccccagacctctacatgcccatttggtttctttccagctcatatagcttcctaagtattgtggctaacagttccctgacttgaattcctagtttctgttaacagttttctaactttcaggaaaaacaagccaatttctaaggaaagtggctgtgcttcagtcaggagtagtccgaggtagacatccaggacagtatgacgcaaagggtttggagcgcaacaaccccttgcgttatatagccatttaatgtaacctgtttgtgtgagttcatacctggctttgagccactattgtctgtgagtaatataactgcactgctgactctgtaggagagagaataaagccatgtccaacttgcctacagtcctcn

SEQ ID NO: 4508 - DNA, 777 bp, Homo sapiens
  misc_feature 8, 23, 121, 138, 158, 171, 177, 182, 185, 200, 202, 205,211, 255, 265, 268, 273, 276, 280, 288, 292, 298, 300, 301,306, 311, 312, 315, 316, 320, 321, 324, 327, 328, 331, 341,371, 372, 374, 396, 400, 403, 406, 408, 410, 413, 417: n = A,T,C or G
  misc_feature 418, 420, 422, 433, 434, 437, 441, 447, 466, 474, 479, 480,483, 490, 505, 509, 511, 517, 530, 532, 533, 547, 556, 558,578, 581, 596, 601, 603, 607, 625, 626, 627, 631, 636, 638,652, 660, 666, 671, 678, 682, 697, 701, 703, 707, 709: n = A,T,C or G
  misc_feature 719, 727, 729, 754, 756, 757, 759, 777: n = A,T,C or G
taatgctnggctctcgttctttntgcaggatccctcgattcgaattcggcacgagtatagatccagattctattcaaagtgccttattagcatcaggtcttggatcaaaacgacctagttnttcatctacaccagttntcttcacctgctcctaacangtacaccagctancagtcncaccnacngtaacagtggccttntnacnggtaangatgctgtgtgaaagggctcagcaagatgacgaaagacctgctngataagctcnagnaattngcngaanacctgccncctnataccntnnatgancttanngannaacnnggnggnnctnctaacgtggntgagatgactggccgctgggacggtgttgnnanctgcgatgatggacgcatgtancctnatncangntntgnactnnangngcctgtggaanntcncgangttacncgtgctcagggatattatngatggcgnttacnntantgctggnatccatcatgctggngaancnggtatnacattacatctgntnngagagcttgccatnataggcgangntttcatatgactttgggaantgnccttgatccgctacntagancngctntaacagttggggaccctnnntganatcancncaggttcctgtggnggagattncctacntgaanatgggcnctgncggagctaacggaanatcngngtancnttgctgctangccacttnanaggattgtgggcactttcacatggngnntnaacgcttggcaaacttcn

SEQ ID NO: 4509 - DNA, 815 bp, Homo sapiens
  misc_feature 11, 17, 25, 36, 38, 47, 417, 601, 672, 679, 692, 717, 732,737, 741, 743, 763, 767, 769, 770, 787, 790, 791, 795, 796,797, 806, 809, 810, 811: n = A,T,C or G
gtacttatttntaatgntggtcganttggcctaaananaataggttngggggaattcggcacgagggttgccagcatataactgctttggagcaaatctcttctgtttagagagatagaagttatgacatatgtaatacacatctgtgtacacagaaaccggcacctgccagacagagctggttctaagatttaatacagtgctttttttcctctttgaaatattttactttaataccagtgccttttcttgttgaacttcttggaaaagccaccaattctagatcttgatttgaattaatacacacaatatctgagacacttacacttttcaaaagatttgtgtatgcattgcctaattagagtagggggagaagggcaactattattatccctattttacaaaactgaggcttantgaggttcagccacatgcctagacttatatactagttagtggtgcagccagggagaggactcagatttcctggaggcaaagtctatctctgaaactccatgaagacttttgcagccagttcccaccaatatgcccccagacgtgagacaaacaaggactttttttttatatagagccatccatnaaaatcctaagccccttttattaatgtataaccaggaagaaacattttgtgccaaccggtttggacttttntatggcntgagaattcgggnaaggaagtgttgacccccaagccanggagaaggaaagaantggantttncntttgtcctttaagggttttntaangnncattggtttttaaatcncgnnatcnnngcccaaaanttnnnttct

SEQ ID NO: 4510 - DNA, 774 bp, Homo sapiens
  misc_feature 10, 658, 672, 771: n = A,T,C or G
ttcaaatccnagctcttgttcttttgcggatccctcgattcggaaggctacaagtgacaaggaaaattctgttccgaatatggccacagaaacaaaggatgaacaaatatctgggacagtgtcttctcagaaacaaccagccttgaaggctacaagtgacaagaaagattctgtttcgaatatacccacagaaataaaggatggacaacaatctggaacagtgtcttctcagaaacaactggcctggaaggctacaagtgtcaagaaagattctgtttcgaatatagccacagagataaaggatggacaaatacgtgggacagtgtcttctcagagacaaccagccttgaaggctacaggtgatgagaaagattctgtttcgaatatagccagagaaataaaggatggagaaaaatctgggacagtgtctcctcagaaacaatcggcccagaaggttatatttaaaaagaaagtttctcttttgaatattgccacaagaataacgggcggttggaaatctggaacagagtatcctgagaatctgcccaccttgaaggctacaattgaaaataaaaattctgttctgaatacagccaccaaaatgaaagatgtacaaacattcacaccagcagaacaagacttagaaatggcatcaganggagagcaaaagangcttgaagaatatgaaaataccagccacaggtgaaaaaccaaattcattctagggatgaccttgatgacataattcagtcatttcaacagtcttcagangat

SEQ ID NO: 4511 - DNA, 733 bp, Homo sapiens
  misc_feature 3, 9, 11, 59, 62, 64, 69, 73, 80, 82, 83, 93, 115, 120, 121,123, 127, 136, 146, 159, 161, 172, 177, 188, 194, 195, 199,241, 244, 246, 271, 282, 286, 288, 308, 313, 321, 323, 325,327, 335, 340, 342, 343, 359, 360, 363, 369, 371: n = A,T,C or G
  misc_feature 374, 375, 394, 395, 397, 399, 400, 408, 417, 422, 423, 433,440, 464, 486, 488, 496, 503, 507, 511, 513, 518, 520, 532,538, 559, 560, 627, 636, 648, 655, 658, 692, 693, 695, 700,702, 723, 726: n = A,T,C or G
ttnctaatncnagctcttgttctttttgcggatccctcgattcgaattcggcacgaggntgnanaaagnatcngctggcnanntctatcatgnatcagctaaggatttgccaacngaatnntnctcnatccttcantcatgacacntcacatgtcaagngnagaaggtacancgtgnaaatgctatanccggcnnaatntaggagttcttctctggctcggttgctaaagcagtgatctgngtnanccccagggccatcactgtgcatgtncccatgccctnaacngnattcgagcacatactgattnactanaaggaggngnangnccagcagnaacancnnacgatgacattggccnnganctaccncntgnncgatgggaaaatggtgaanntncnncgcatccngaatgcgcnagttnntgtaactcantaccaantgctcagcagcactctcttctctngctcgtggagcttcagcccatnantggaatanaacatcngctnagantncactngncttttggattgnattgtncaatccttggtgatcacaatnnctcagactggaataggctgccccccaaaactgtctgtggcaccctgaaaaagctggggctaaacagncaaggccgntcatccccttgnctgaccncgnattgtctgctgctgggttcggacgaggactactnngntgaantnctccttgttggcatgatgacnctngttaaga

SEQ ID NO: 4512 - DNA, 774 bp, Homo sapiens
  misc_feature 8, 51, 84, 105, 115, 146, 153, 157, 181, 190, 204, 306, 319,321, 360, 379, 432, 433, 464, 482, 483, 487, 490, 494, 520,580, 585, 586, 589, 641, 647, 648, 657, 668, 691, 694, 702,710, 714, 724, 737, 744, 748, 749, 765, 766, 772: n = A,T,C or G
ttctaatnctggctctcgttcttttgcggatccctcgattcgaatgcggcncgaggtgaaccttccccagtcctatcagagcanactttctggggttgcatcccntcagaaaccnatttggggcccaatctcaatgcacatatcantgcgcanagcnctaaaatttcaggcaacactttgnttgagagangccaaaattttggncaggccctgggacatctaaagtcaccaatgtaactacaccatacagattaaaccctcacatgatcatgtaagctatgcagttacccaagctgcatcatttanaaaacctgtcagntnttatggaaaccatccctagtcaaggacactttaaatatntagtctaaataccgttaangtaggcccactagctgtgttcacattatcccttggccaccttaccagggactnnaataacttgggaaagtgaaaacaacaagctnacccacatgttcaccatnnaaancanttangtcttgaaaaacatggactctttttnccgtgtgggaccagttcctacttatgtgttaccagccaattggactggaacctatacagntgggnnatntagcccccgaaattaatatagctcccaacaaccaatccttcattatactttnaactgnnaaccaccanacacaaatganccatccaactgataccactttcngtngaagctanggaatacncctngaagtctgantgagagtttcagnccttgcngctnncctatcctattaccannggttgnct

SEQ ID NO: 4513 - DNA, 779 bp, Homo sapiens
  misc_feature 3, 10, 12, 73, 743: n = A,T,C or G
ttnctaaatncnagctactcgttcttttgcaggatccctcgattcgaattcggcacgagatatgcacattgtnccaatggcagacttttggctttgatattgttctataattatgtaagatgttaccattatgggaaactggaggaagggcatatgggacttctttgtactgctttttctattccctgtgagtttataattattttataataaaagttcaaaaacacttattggatggacatcacagaacataatagaagaaagaatcagtgaattataggtctgtttaatagaaatgactcaaactgacacacaaagcaaaaagaatgaagaaaacagaacacagtgtctgagactttgtggaataatattatataaaattatctaacagtcacatgatttgaccctcagaaggagatgaaagaatgagatagaaggaatatttgaaggaataattgttgaaaatgtttccaaattgatgataatgtcagctcacattcccaagaatcacattgaaccctgaccaagataaaccaaagaggactacatctaggctcatcatagtcaaactgcttaaaatcaaaactaaagagaaaaatcctaaaagcaattagagaaatcctatatagtccatgttgggaaacagttacatcaatgtgtgctgacttctcatttgaaaccatagatgccattagacagtggaacaatatttttaaagtgttcaaaggaaaaaaattgctatnccagaattctggatttgcccaaaaatctcttcaaat

SEQ ID NO: 4514 - DNA, 814 bp, Homo sapiens
  misc_feature 3, 5, 14, 20, 113, 708, 750, 784, 794, 797, 807: n = A,T,C or G
ttncnaaatacctngctctnggttctttttgcaggatcccttcgattcgaattcggcacgaggcggatcaacctggcggaggacgtgctggcctgggagcacgagcgcttcgncatccgccgactgcccgccttcacgctgtcccacctggagagccaccgtgacggccagcgcagcagcatcatggacgtgcggtcccgggtggattctaagaccctgacccgtaacacgaggatcattgcagaggccctgactcgagtcatctacaacctgacagagaaggggacacccccagacatgccggtgttcacagagcagatgatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcgggacccagagtttgtcttctatgaccagctgaagcaagtgatgaatgcgtacagagtcaagccggccgtctttgacctgctcctggctgttggcattgctgcctacctcggcatggcctacgtggcttgtccagcactttcaacctcctctacaagaccgtccagaggctgctcgtgaaaggccaaagacacaagtgaccacaagccaacccccaacaagcccggnagccccccggccggtttcaacaagtccccttgggggcccgangcaccgaattgaaattgggacaacttggccccgnccgcggggcnggncccttgcaangggacca

SEQ ID NO: 4515 - DNA, 775 bp, Homo sapiens
  misc_feature 5, 47, 54, 56, 82, 702, 725: n = A,T,C or G
ttccnaataaccagctacttggtgctttttgcaggatcctttgaatnccctttncngcacccagagtcattgagagtctgtnccaaaagctacatgaaggccatgggaaaaacccgggtgccattttttctagtggggaacaaggcagatctctctccagagagagaggtacaggcagttgaaggaaagaagctggcagagtcctggggtgcgacatttatggagtcatctgctcgagagaatcagctgactcaaggcatcttcaccaaagtcatccaggagattgcccgtgtggagaattcctatgggcaagagcgtcgctgccatctcatgtgagcccttgggtgtggggtaactgccttgcttctgcccccggcacttgccatgttccagtggggggcagatcctcaggacttcacgggtatggttgccagctgtgttcctggcccctggacacacagtgtggcatcctcatgtttgcacactttccccaggctccagtggcctggatgtcaatgtttacaaaggggcaaggacctctcatggacactggcctctaccctctgtttttgtttgatgaattctgttataacctatggggtcaggatatgagtcctgggcattatttatccaggacccatcctcttgggtgggttttgggtgttggctgggtaaaggggagccggggacttctgaaataanctggcttcctggggtgacaatgnatatatgcaaataaattgagaaatcttttaaaaaaaaaaaaaaaaaaaaa

SEQ ID NO: 4516 - DNA, 769 bp, Homo sapiens
  misc_feature 5, 20, 21, 70, 84, 111, 116, 692, 701: n = A,T,C or G
ttccnaatgctggctctcgnncttttgcaggaccctcgattcgggaaaattccagtttatacctgtggtncctgtgtaattatnggtagcactccctttcactcttacaangtctnggtttggatgatatatggtgaagtttttgttgaaactaaattatgaagtctgatatatttggataaaaataaagaattgcttttcttctccttttgctgattttttgacacatcattctaagcaaaatcatctcagcttcgtatatttcagcctgaagtacttcttaccaaagttgtttcatgtaacatttgttcaatatgttcgtgacatgtctctcagtaatgaaaagttatgcattttattgaatgaataaaaacctaacctctgctatttccatttctggaagttgtaagagctcacattaaagacagtaaaagtcaatttaagccaagatcattttcagcccaccaatgtcatggctattggaaaggaaaacctaatgtgatcattgaactatcataacaagtggaaactagaacttttttatagcattttcatgatataggtcctgttatagtaagatatttcattctatttatcaaaatggtgtaaataaaagaaacacaattattttggtaatgcttatcttcagtttaaacatttattcttttcagaaatatgtaaataccctttgnaaatatatnccaaatgaaaaataagggatattttacccattaattatttctggaaagatcttatgctggtttaaatt

SEQ ID NO: 4517 - DNA, 785 bp, Homo sapiens
  misc_feature 3, 5, 8, 9, 10, 21, 665, 680, 729, 732, 740, 742: n = A,T,C or G
ttncnaannnccaggctactngttctttttgcaggatccctcgattcgaattcggcacgaggtcctggctactgaggaggctgatgcaggagaatcatttgaacccaggaggtcaaggctgcagtgagctatgattgcaccactgcaatccagcctggacaacacagtgagaccctgcctcacaaaaattatattctgattttctgagtccatgaacacattgtccaaatggatttttctagctcctccaagttacagatagttccacgcacacacagaactcaccactctcaaatattttccccactagtattactattaaatttttcaaacatgcaaaagatgaaagaattgctcagtgaacaccatgtacccaccacctagattctacaattaacattttaccctactttctttatcacatatatgtacctatccatctatccattcttccatgaatccatcaattcatctaattttttatatatttcaagttaagttgcagatatgtagcttatgtttcaccttaaatgtttctgcctggctattattaactggagtgcaatatgtttttggttcttctttatggtaaaatctatgttcagtgaaatgcacaagacttaggtatgccattaataggttttggacgaatagacaaaccttgngtctgaaactggaantaaaaaaaatcaaacactaaaaaaaaaaaaaaaaaaaacttcgagcctntanaactattngngagtcgtattaccgtagatcccagacatgataaggatccattg

SEQ ID NO: 4518 - DNA, 763 bp, Homo sapiens
  misc_feature 9, 263, 433, 446, 450, 471, 500, 501, 507, 522, 554, 569,587, 595, 611, 614, 618, 629, 632, 669, 674, 679, 693, 695,699, 709, 711, 715, 719, 728, 733, 737, 744, 749, 759, 762: n = A,T,C or G
ttcaaatcncagctcttgttctttttgcaggatccctcgattcgaattcggcacgaggtcattcccatacaatgcaacatccggaatgaggaggaggtgaataatttggtcaaatctaccttagatacttttggtaagatcaatttcttggtgaacaatggaggaggccagtttctttcccctgctgaacacatcagttctaagggatggcacgctgtgcttgagaccaacctgacgggtaccttctacatgtgcaaagcagnttacagctcctggatgaaagagcatggaggatctatcgtaatatcattgtccctactaaagctggatttccattagctgtgcattctggagctgcaagagcaggtgtttacaacctcaccaaatctttagctttggaatgggcctgcagtggaatacggatcaattgtgntgcccctggagtnattnattcccagactgctgtggatnaactatggttcctggggacaaacttcttnnaagggncttttcacaaaatcnccgattaacgaattggtgttcctgaggaggtntcctctgaggtctgnttcctactgtctactgcnccttcttnattctggacagtcagngcntgtngatgggggccnganctctatacccactcgtatgaggttccaaatcttgacnctgcnccaangttccaggggaccntnttgncggtgaaaananatgnaagnggacttttnaaggngaanagctaancttcnaacctctggnaant

SEQ ID NO: 4519 - DNA, 772 bp, Homo sapiens
  misc_feature 2, 3, 12, 92, 476, 490, 519, 526, 538, 539, 540, 545, 548,554, 561, 565, 568, 572, 573, 589, 590, 591, 592, 598, 611,622, 626, 628, 633, 638, 640, 641, 643, 653, 657, 666, 677,679, 709, 711, 715, 716, 721, 723, 724, 730, 736, 742: n = A,T,C or G
  misc_feature 745, 746, 751, 753, 757, 765, 771: n = A,T,C or G
annccagttctngttctttttgcaggatccctcgattcgaattcggcacgagacaggttcccatagctacagaggtgcttttcaaacttacncagggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagatgtcaaaatacctgtacaattttaaaatgtcacaattaaacatgagctggtttcccacacaaaanaaagactgaagatntgcattttaaggatgacaacataatgganaaaattngaaatagcatannnaaaanctnggcccnttaacanatgnggnttgnnttgcccgaaatcccgnnnnggttanaccccttggatantttgggcaacncccnanttgtntgccntnnanaaaaaagccntttnttttggaanaatttgggaancntttgggttttattttggacccccttttaancnccannaaaananntttaancccccnattggnttnnttttngntttnagggttangggggng

SEQ ID NO: 4520 - DNA, 775 bp, Homo sapiens
  misc_feature 3, 4, 5, 10, 14, 16, 26, 31, 109, 110, 130, 136, 148, 152,160, 161, 163, 182, 191, 256, 279, 314, 315, 327, 329, 332,336, 342, 343, 352, 356, 357, 384, 385, 410, 416, 418, 419,423, 432, 436, 437, 442, 453, 468, 471, 500, 503, 504: n = A,T,C or G
  misc_feature 510, 524, 536, 540, 548, 556, 559, 561, 575, 582, 592, 596,600, 608, 616, 625, 775: n = A,T,C or G
ggnnnttgcnaatncnatttgacccnttgcngcaggctccctcgattcgctcaagcaaagttcctgtagacaaagtaacaccaagtactcttccagaagatttctagannttgaaaaattccttcagcanacaggntggcgacaaggngccngggatgannangagcaccactaactccctnaggtgctanacacacataatgggaagccaacatttatggaagaagttctagaacaccttcctggaaaaacacangatgaagtcaacagcatgaaaantggtatcaaaagttctggctctagaagaaagaaanncagagtcaattnanatntggnaaactnnaaagcagcncaanngggaggaaatttccaagtcaaaggaannggctgacaacacacctgtgcttatntcatancnnacangaggattancaanngcaancagaggaacantgatgagactcaganatnggcatgttgaagctaggaagaaacagaanagnntagaantgtcaatgaaatgngcttccccattnaaanacgaagangagaaagngananaacatgacaaagancgccagngccagtttangttnaaantactactngaaagttntacccagcnacatgaaagaacaggaagaatttttgaggcttgaaaaggagataaagggaaaaggcagaaaaggcataaaaaaggaaaaagctgctgatgaaacttccagatttcaggaaagagttgaaaacaatgttagtcgagatccctctaggcttn

SEQ ID NO: 4521 - DNA, 759 bp, Homo sapiens
  misc_feature 6, 9, 15, 16, 25, 29, 38, 40, 43, 54, 595, 622, 628, 651,671, 702, 740, 741, 744, 745, 748, 749, 750, 751, 753, 754,755, 756: n = A,T,C or G
cagctnctngttctnnttgagaccnctcnatacgactncngcncgaggggattngaatgcccatgaaagacattttattttacttgaatatattcttgcttcactttaccctccataatatgttgtcattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtcttcaaaaagatttttaaataggtccggcacggtggctcatgcctgtaatcccagcactttgggaggctgaggcgggcgaatcacctgaggtcaggagttcgagatcagcctggccaacatggtgaaaccctgtctcaactaaaaatataaaaattagccgggcgtggtggcangcgcctgtaatcccagctactcgggangctgangcaggagaatcacttgacccaangggcagaagctgcagttagnccaagatcgcatcatttgcactccagcctangggacaaagacgcgagacttcatctcaaaaaaaaaaannttnnccnnnntnnnnaaa

SEQ ID NO: 4522 - DNA, 762 bp, Homo sapiens
  misc_feature 7, 717, 747: n = A,T,C or G
aaaaaancagctacttgttctttttgcaggatcccatcgattcgaattcggcacgagctggaaggggcagagcccaggacagggctccatgtccacaggacggcgaggagcgaagaccatggggactgagtacacagatgaagacacagaagcatagagaggataagtaatcactagcaagtggaagaaccgggattcagatccagaacaggctgactccagagtcactggctgtcatgtagtttcctcaactactgcctcagctctacaatcccagagtaaagctcttctccaaatgaagagccaggaagaggtagaggtggcaggaattaaactttgtaaagccatgtccctgggttcagtgactttcacagatgtggccatagacttttcccaagatgaatgggagtggctgaatcttgctcagagaagtttgtacaagaaggtgatgttagaaaactacaggaacctagtttcagtgggtctttgcatttctaaaccagatgtgatctccttactggagcaagagaaagacccttgggtgataaaaggagggatgaacagaggcctgtgcccagatatcctgaaaatgcccatcagtaagttgaacaagaagaacgggagctttaagaacaagattcaagatgaaacaacacaagtgttgaatattttataaatagctaaaggcagaaaacgttgccaattatctcagacttncagaagtgaaaacaaacaaacaaacaactnaagtcttaattgaat

SEQ ID NO: 4523 - DNA, 788 bp, Homo sapiens
  misc_feature 4, 5, 8, 16, 24, 641, 715, 738, 747, 755, 781, 783, 787: n = A,T,C or G
aaannccnggctactngttctttntgcaggatccctccaaatgcttggggcacgagggttcagagaaaagtaggcagagaaaggcagtttaggaggtgacacaagagggaagcctaaggagagagaactggatggagcttcccaggtgatgacagggttgaactccagggctatacccagctgagcaaggagagctttgcctcttcaggagactggaagttggggaagactccaacaggcttgtggtcagaagctcaggagactgggaaggaaaagtgaatttctgaggagtcctagttcatttcattaatttgttcaattctttaacgtatgtttattatggacctactatgttgccagacgctgtgctagctgttagggacacaatgatgaacaaaataggcatagttttttaccccatgagagttagagggtggtggggagagtcattaatcaaatggcacaaacacatgtaaaattaccataaagcgggtgatacagaaaggcgactggtgttaggatagctaaaaaagagggatttcacctggtcaggtgggtcagggaaagcttcttagagaaagagggactttgggcttgatgaatgaaaggtgaatttccaggcaaagaagaaaagggaggangcttctaggcagaaggaacttcctgtgccatgatctctgagaaatgaaagattaacaaaggccaattgtaagtngaaccagaattgaacccaggaangccccaaanttgagaanaaaaaggcccagggcaagggccattncntggnt

SEQ ID NO: 4524 - DNA, 763 bp, Homo sapiens
  misc_feature 4, 19, 136, 180, 204, 209, 220, 223, 228, 233, 236, 237,239, 319, 328, 334, 339, 340, 347, 434, 440, 547, 556, 573,602, 627, 644, 650, 651, 653, 668, 670, 692, 698, 699, 707,743, 749, 754: n = A,T,C or G
ttcnaatgctagttctcgnctttctgcaggatccctcgattcgcacctaacattaggtggcacttaatagtgatgataatcacttatggagtctactaagatgttttgaatcccttctcccattcaaaaatcttgncaaccctgtgagacagatatgctcaccttactgatgagtacggnggcttggcaaagtaggtatgttgnacatnttacacagctngtnactgnaagantcnntntcatatactcccagattcagaactttaaataaccccatgctaccttctagggaaagcttctgctatgtgtttggagggtnaggtgaganaaaggngaatnntaatctnccaacatgctcactcctttttcctgctctgtgggggatgtaagtgaataaccccagtgctgtggtgcactcgttaatcttgtagcantgacangtggaatgtgggtctgcaggtggccttggtatggtggggataactatgtgccttcacctgtccctacacaggcatacctaccagcttgcgtttgctttcgacatgtntgggcaagngtgaattgcctctgctnctctggagagatgggccctgtggctgctntgggaagaacatcaaattttgcgtncatttacatatggcatnctgtgnntntggaatctatgcatntngtgttccctggcttcaaagttngtaacnnatgtggtnagagccaaaacccctacttgtgtaccaaaggaaggngcttanggaanaatggcttt

SEQ ID NO: 4525 - DNA, 770 bp, Homo sapiens
  misc_feature 20, 24, 429, 436, 437, 439, 441, 446, 447, 452, 460, 463,465, 466, 475, 478, 482, 484, 492, 502, 503, 504, 506, 513,522, 524, 526, 529, 531, 545, 548, 549, 562, 563, 569, 572,574, 581, 583, 584, 586, 589, 592, 593, 604, 620, 622: n = A,T,C or G
  misc_feature 626, 629, 637, 639, 658, 662, 676, 682, 683, 687, 693, 696,698, 712, 714, 732, 738, 742, 744, 748, 751, 753, 754, 756,760: n = A,T,C or G
ttctaatgcttggctctcgntctntctgcaggatcccatcgattcgaattcggcacgagagagaactagtctcgagtttttgacagataatagccaccctaggaggtgtgaagtggtatctcattgtggttttccatttttctgatgactgagaatgttgagcatctttccctgcgtgttgtccatttgtgtatcttctttagagaaatatctgcttacgtcctttgcccagttttaattggattgtctttctgttgctgagttgtcggaattggttgtacatcctccatactgagtcctcatcagatacctgatttgcgaatattttcttccataccatgagttatcttttcactttcttaatggtatcctttaaagccccaaagtttttaattttgataaagtccaatttatctaaaaaaaaaaaantaaaacnnananaaatnnaaaanaaaaaaanctngnncctttaaanctntagngngtcgtttncgtaaatccnnncntgataanatccatggntnanttngnacaaaccacaattnganngcagggaaaaaanngctttnttngngaaattngnnanctnttnncttaatttganccatttataagctgcnantaancangttaccancnccaattgctttcatttaangttnaaggttcaaggggnaggttnnggangttttnaantncggggccgagggcncnaaatgcattgggcccggncccaantttngncccnttnanngngggntaaattgccg

SEQ ID NO: 4526 - DNA, 775 bp, Homo sapiens
  misc_feature 3, 4, 6, 11, 16, 25, 622, 642: n = A,T,C or G
ccnngntttcnaaatnccagctctngttctttttgcaggatcccatcgattcgaattcggcacgagaggtgttgaaattacagaagggaccatttctggcaacacagcagaccagatatcctataaaagtcttccattacagaacacctacacatcaggagctcaaaaacagatatattctttaaatgtctagccaacattttggaaaagtgtgggaaatccctcagggccaaaaccagagggagttggacaccagagtgataagcagacactgaaggcaaggccaacctcagggcttggctcaatattctagaactttacccttgttctcaagtctccgtgtggacaggggatgagggttacctggtttctgctcctttgactatggcatagactctgtagatgtctgtaattgaccgggaggtatgtagatgactgtatcaagttatcctcctgaccgggcgcagtggttcatgcctgtaatcccagcactttgggaggtcaagacaaggaaggaggtgagctgacagatgtgctggaagagcacaaggaacccaccagtcaggcatgatctcggagagggcgcttgtttgggggttactcagtgagacctgggaagganagaagggaccttttctgcangacggtggcctggagaagaagctctttttccactgaaacaggaggaatggcggggaaggatgaatggatatgtgtattaattatctattgctgcatgacaaatacggatcactcaagtccaggagtttgagat

SEQ ID NO: 4527 - DNA, 774 bp, Homo sapiens
  misc_feature 16, 18, 24, 88, 97, 159, 164, 177, 190, 195, 215, 221, 226,228, 229, 238, 239, 242, 247, 248, 263, 321, 346, 349, 355,357, 359, 365, 367, 370, 377, 379, 384, 385, 389, 390, 394,400, 402, 408, 410, 416, 419, 422, 424, 433, 452, 544: n = A,T,C or G
  misc_feature 602, 615, 628, 632, 634, 641, 664, 671, 711, 713, 714, 715,716, 717, 743, 745, 746, 754, 756, 762, 764, 765, 770, 771,773: n = A,T,C or G
ttccaaataccatttnangccttnttgcaggctcccatcgattcgaattcggcacgaggccatgttggccaggttggtcttgaacttntgacctcanttgatctgcctgcttcggcctcccagagtgctgggattacaggtgtaaactactgctcctgncctgnaatccattttatnatgggaagcacanttacntagctaatacttgggggcangagctnaagtnannattgcatcnncantaatnnttagaatgaatatanattgaagtcttggggtatcccggcatgattatgtcagatgaaattatgtgatatgcanaaggaaggcctcctgcacttcatgnctncagctnantnctacananggncaagggncnatgannaatnnggangagggntncttgantngaatanatnatntntcactcagnttaaagcctgtaatcccancactttgggaaggccgaggcaggaggatcacctgaggtcaggagtttgagaccagcttggccaacatggcgaaaccatctctactaaaagtncaaaaattatctgggtgtggtggtgggcacctgtaatcacagctactcaagtactgangcagaagaatcanttgaacccaggangcanangttgcantgaacccgagatcacaccactgnactccancctgggtgaccaagaatgaaactcccgtctcaaaaaaaanannnnnaaaaaacttcgaaccttttagaactntnnttgagtcntntttccntnnaaccnnanc

SEQ ID NO: 4528 - DNA, 755 bp, Homo sapiens
  misc_feature 5, 8, 105, 619, 661, 695: n = A,T,C or G
atccnagntactcgctctttttgcaggatcccatcgattcgaattcggcacgagggaagctccaggcctggcgtgctggagtcacgagatgagctgtccaggctncatggcatcgtgagtgaactccgaccgtggcaggtgaggcttctgcacttagctggctgtcttcatgtgggccgattctgtggttagtgattctgatttctcatctgaaaagtggtgcatcacttagcccctcccacacttggagggttctactagtgtgcctgcgtggctgggttctgcacactcagctactttagtttctttagtctatccttaaaaagattcctaggtgtgttcctgattttgaggttccgtttggtcattatgctctttcagagttcatcttttaaaatcagtctgtggacattttttttttcctcttagcacagtttatggtctcatgcaggtcaacaaattgggactctgaatgtgagtgtgtgtgtccacacaccactagggcttattaccttattgtcaatgttatcttaagaaaaagtggaggctgggtgcagtggctcatgcctgtaatcccagcactctcagaggctgagatggaaggatgcttgagcccagnagtttgagaccagcctgagcaacaaagcaagactcctgcctntacaaaaaaaaaaaaaaaaaactcgagcctttanactatagtgagtcggatttacgtagaatccagacatgatagatccattgatgagtttggg

SEQ ID NO: 4529 - DNA, 889 bp, Homo sapiens
  misc_feature 368, 370, 416, 420, 432, 439, 452, 467, 476, 478, 482, 483,488, 489, 490, 502, 512, 514, 524, 531, 553, 555, 556, 558,563, 564, 566, 574, 576, 581, 584, 585, 586, 588, 590, 592,593, 594, 598, 600, 604, 610, 613, 615, 616, 617, 627: n = A,T,C or G
  misc_feature 631, 637, 638, 645, 650, 655, 659, 663, 673, 675, 683, 684,691, 696, 699, 703, 704, 707, 709, 714, 715, 716, 720, 721,723, 728, 729, 737, 740, 741, 742, 747, 752, 754, 766, 767,771, 772, 773, 778, 779, 782, 786, 790, 795, 810, 811: n = A,T,C or G
  misc_feature 813, 842, 843, 853, 855, 856, 858, 859, 860, 875, 876, 886: n = A,T,C or G
gctgggctacttgttctttttgcaggatcccatcgattcgaattcggcacgaggtttaatctctttaactatcaaattgcaattttttttttgccttgcaaataaacaaattacaattgtcatttactggtgagacaatgagaaaaagacaccctcaaacactgttggtagaacacaaattgttaaaatctttctaggagtcattttcaaattatgtatcaatgacctaaaaatatttatgtctcctgttcttatacttccagaaatctattctacagtaataaccggagataaaaacctttacatataaacatgatttattatactgaaaagtcaaaacaacataaatattaaaaataggaggtggnanatttcacctttaaatgctatgtaggagaatacttaagggattggtnaagnccaatagttttngtattangtggaaaatgccngaatggcatgaatgntgtacaaananagcnntcatnnnttgccactcttngtcataaccncntcgctcttcnatgcatnccccattattacaaactgttcncnnanactcnncnttcaccangnctccngcnnntncnannncgancntctncctccncancnnncccccgctcnctcnttctcnncaacctngctcnccccncacncccnactccccccncnttactttnncccaccnatccncgncacnnctntncttcnnncatnntnccccnncctactcnccnnntagcnctccncnttcccacacttnnctcnnntctgnnccntccnttcntctcncttactacataaccnncnctcttctcatctctctcttctctctcacnnaccccatccncnncnnnctcttcctctcttannctctcactancct

SEQ ID NO: 4530 - DNA, 763 bp, Homo sapiens
  misc_feature 17, 30, 32, 48, 680, 687, 693, 717, 723, 724, 726, 740, 747: n = A,T,C or G
gaccaattatatgacanttaccagcgaacnanaaggctgggcgaaaanatcaaaccatcctttgctggcattaaatattcaagttgaagatccttcaccttcctttaatcctatattagagtctataggtgtgtctttcttatagcaatcctgcactcacataaaaactgtattttcaatataagatcaaaatgtatttcacaaaaaatgcatctttatatttgtttacatttctcctgactgaatggtgccatgtacagtctgtgtaagttatagaaaacgtttgccaactcgtagtctaccattttgttatttgttttctatttgtttcgtctgttctttactgctttgttttccctttcctgccttcttctggattaattgagtattttggtaatcctttttaatctcctcttttggattttttagctatacttacctgtttttgtttttgttttttaaggcgttggtaggaaataatgtatgcatccttaccttattaaagtctattttgaaatactgttacactgcttcatgtaacttacaatatgaacctcacaacagtatagttcattttcccatcccagtatattttacttctttgttataaaccccatctctactaaaaatacaaaaattaactgggtgccagtggtgcgcatgcctgtagtcccactacnttgggangctgangcaggagaattgcttgaaccctgngaggcnnangttgcagtgagtcnagacgcnccactgcactccaccc

SEQ ID NO: 4531 - DNA, 829 bp, Homo sapiens
  misc_feature 3, 9, 14, 22, 34, 36, 57, 339, 462, 464, 490, 494, 495, 524,537, 554, 574, 576, 594, 597, 599, 603, 618, 624, 628, 638,642, 643, 645, 646, 658, 659, 683, 686, 694, 707, 710, 718,721, 727, 728, 730, 733, 735, 742, 745, 748, 750: n = A,T,C or G
  misc_feature 754, 756, 764, 770, 771, 776, 783, 788, 793, 805, 821, 827: n = A,T,C or G
gcntattantgtgncttattantgtggcctaaananataggctggggcgaattcggnacgagcttaacataacctatgagagtggacaggtgtatgtaaatgacttacctgtaaatagtggtgtaacccgaataagctgtcagactttgatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagttcagcaaaaggatgtcactgaaattgatattntagttaagaaccggggagtactcagacattcaaactataccctccctttggaagaaagcatgctctactctatttctcgagacagtgacattttatttacccttcctaacctctccaaaaaananagtgttagttcactgcaaaccactanccannatcttatcacgaatgtggaaaccactgtngatgaagatgttntacctggcaagttaccngaaacctcctctcagagcananccgccatcttcatataangcnangtgntaattggatgggaanaagctncaanaagatcctgngttnngnnctggagcaaccnntttacccccgcatttcctttctanttnttagaacntccatcggttggnttnggcaattnccncggaanncngcntnttgcggncanctnancccntntttaaaangttgtnnttctncccccanttttncttgnaaatccctacanggctaattccttcaangcttcnct

SEQ ID NO: 4532 - DNA, 767 bp, Homo sapiens
  misc_feature 2, 18, 34, 679: n = A,T,C or G
tnctaatgctgggcttgntggcttgccgcagganccctcgattcgaattcggcacgagatagagaggaacaaagataagaatgacagcagatgtgtggtcagaaattattcaaggcagaagacagtagaactgaaaaagaaagtaggtcaatctagaattctatacccaacacaaatatccttcaaaaatgaaggtgaaataaacactttttgatggacaaactgaagttgagagaattcgtaaccagcagacctgtagtacaaaaaatgttgaggcaagttttttaggcagaagaaaaatgatactagatagaaatttgggctgcacaaaggagtgaagaggcttccaaatggtaaattatatggaaacatatgaaagttatcttttctcatttttaatctctttgagaaactgcttaaagcaaaaatataaacaaggtactttggagtttagaacatacatagaagcaaaatgtatgacaaaaaatactaaagttagccaggagtagtggtgtgtgcctgtagtcccagctgtttgtgaggctgagatgggaggatcatttgagcgagcctgagaggtcgaagctgcagtgagctgtgatggtgtcactcactccagcctgggcgacagagtgagaccttgtcttgaaaaaaaaaaaaaaaaaaactcggcctctanactatagtgagtcgtattacgtagatccagacatgataagatcattgatgagtttggacaaacccactggaatgcagtgaaaaaatgc

SEQ ID NO: 4533 - DNA, 986 bp, Homo sapiens
  misc_feature 8, 13, 18, 22, 24, 38, 56, 60, 64, 70, 75, 87, 106, 120,124, 125, 128, 142, 143, 147, 151, 153, 164, 165, 177, 178,179, 193, 198, 214, 220, 226, 230, 236, 248, 261, 269, 273,274, 278, 279, 282, 283, 288, 292, 300, 301, 302, 307: n = A,T,C or G
  misc_feature 310, 314, 315, 324, 325, 333, 335, 342, 345, 346, 348, 350,352, 361, 368, 369, 375, 378, 383, 385, 394, 396, 400, 401,403, 405, 408, 410, 419, 420, 422, 427, 428, 431, 439, 443,460, 461, 462, 463, 464, 477, 479, 481, 482, 486, 487: n = A,T,C or G
  misc_feature 489, 490, 497, 499, 501, 505, 506, 508, 509, 517, 520, 524,527, 531, 532, 536, 545, 553, 554, 559, 562, 563, 568, 570,571, 572, 576, 581, 582, 588, 590, 596, 601, 604, 606, 607,609, 612, 615, 619, 621, 622, 634, 641, 647, 650, 651: n = A,T,C or G
  misc_feature 653, 663, 664, 668, 669, 670, 674, 675, 684, 688, 690, 696,698, 699, 701, 704, 707, 716, 723, 734, 739, 745, 748, 751,752, 757, 763, 772, 773, 774, 775, 778, 780, 788, 789, 793,801, 809, 811, 813, 814, 820, 835, 837, 839, 842, 844: n = A,T,C or G
  misc_feature 857, 867, 868, 871, 873, 876, 880, 881, 882, 886, 892, 900,905, 908, 910, 913, 922, 927, 930, 931, 939, 954, 960, 971,984, 985: n = A,T,C or G
acttattntgggnctaantggngngccaaaaaaaaggntggggagcatggcttagntggnatcntgagantaatnatgagatctacnctgaaatgacttaacctanaattaatgtgtggncagnntgnaatatgtgaaattnnggcnttancnctcttttggcnntataaaaatctnnnattaaaaaacatgncattngaattgaacatgtgcntaaccnctgaantatntctganaaaccctaggtnccgtggcatatgngatgaatnccanngacnnatnnaaccncatnttacatannntcacngcntatnnaacatcaannatgcttgngnaaagggntannantncncaacgactnttgtttnngagcanctntcttngntagaccttntnaccnncnanggntnctcttaacnngntgatnnttnactcatcnttcnctttctttcctattctnnnnntccaaagtttccncncnnaagnnannatgaatnantngtgnncnnccaccctnatnattntanatanncgcnattgaaatntaatacanntcccnctnncctcnannnaatnccatnncatctnantaaaantatancantnncnttnctnaccncnnaaagattcaaanttcgctncccttnttnncnatatactctnnatannnatannccgaaattntcancnttctantnntnacntancaaaactcnctatagnaccctcacatncctcngacacnatnatnnccaanaacctntaatcggannnnacntntctgaatnnctcncactcctnttataccntntnntcattntaactctatcatctngnantangnccatctccctcanatctaaacannttntngcnctcnnntagnggagantgtctctntacgnctnanaanggcttctcngatcntcnnaatactcntatagagactatacnctcatnattgctcacantatctacaacacnng

SEQ ID NO: 4534 - DNA, 847 bp, Homo sapiens
  misc_feature 2, 3, 8, 9, 31, 33, 41, 45, 60, 71, 72, 77, 79, 83, 93, 97,103, 104, 111, 118, 120, 121, 125, 140, 148, 170, 175, 184,185, 200, 202, 209, 213, 214, 215, 224, 228, 230, 231, 235,238, 241, 242, 243, 244, 246, 249, 253, 254, 256, 260: n = A,T,C or G
  misc_feature 265, 266, 269, 273, 276, 278, 286, 288, 295, 304, 307, 312,315, 316, 317, 319, 322, 330, 331, 337, 341, 343, 349, 360,361, 365, 368, 372, 374, 376, 379, 381, 391, 392, 393, 395,408, 410, 411, 425, 426, 432, 434, 435, 451, 453, 454: n = A,T,C or G
  misc_feature 455, 462, 464, 468, 470, 477, 495, 503, 518, 524, 525, 529,530, 531, 533, 534, 535, 537, 538, 548, 554, 555, 558, 562,564, 567, 569, 570, 571, 580, 582, 583, 587, 588, 590, 593,594, 605, 614, 619, 621, 625, 626, 627, 635, 636, 644: n = A,T,C or G
  misc_feature 656, 662, 663, 666, 667, 668, 669, 672, 673, 674, 676, 678,685, 689, 691, 692, 694, 695, 697, 705, 707, 709, 710, 711,719, 720, 722, 725, 727, 730, 734, 735, 745, 748, 749, 750,754, 760, 762, 763, 766, 768, 770, 775, 776, 777, 779: n = A,T,C or G
  misc_feature 780, 784, 785, 787, 791, 793, 797, 802, 814, 819, 822, 824,827, 828, 833, 837, 840, 841, 844: n = A,T,C or G
cnnattanngtagctggatgctggcctaaananaaggctgnggcnaattcggcacgaggnagcttgtgggnnagacnancaanggtgcatgangaanaaaacnnaattcantaagccngnnaggnacagcccatagtctnctcgattngtacaatcaaggcggacatttnctggntatgtggannagaggttaattggcngnctatgantggnnnagcctaaanttgngnntacntgnatnnnntnatntgcnnanaaangcatnnganttanagntnccaaaagntntgaaccnaaggactanagnaacanacnnntnatngcctggtnntcagtnatancnacaccncacaggggacnngatnttncccngnanttntnacaggtctcnnnanctgggactcaagncnncccatcatgcaatnncttcanannaacttgtgacttgcantnnnatactanancttnantcccttnttacattcctcaaatgcncaactccncttttcttaattccnattatnnactnnntnnncnngcttattggnccactnntancatncnggnannnccaactaancnnattnntngannttgatattggngccttaacnaacanancgtnnntatcgctnngtcaccantctcactcattnatcaannacnnnngcnnnantnattctcnatcnanncnnantttgctanantnnnctttcccnncnttnanttnctannaaaccccctntcnnnggcnccaatngnnaantngnacccnnncnntctnnangggntnactnggccncatacctcctgngcaanctntnaannggcanactnctnntcncct

SEQ ID NO: 4535 - DNA, 775 bp, Homo sapiens
  misc_feature 6, 17, 19, 20, 25, 26, 31, 38, 696, 705, 707, 728, 754: n = A,T,C or G
ctaatngctgggctctngnnctttnngcaanatcccancgattcgctgcaaaatggactgtgattcaggacctcctccttacctacgagcaccctgggagggactgactaatggcccagggacacacagtcatcctctgcaggcaacagtcaggcttctacttgctgaagccgtcaagggcttgactgtcacactcagtgttctggaaaacaaatcagtaaagcaatttagaggatcttttgcaaatcagagaaaaagaatcaatacaaggcgaaagaattctgatcagcactttaaaacgtgcttatcagaaacttttcttctctcttttaagctttggttctaactgagaaatgcactggataataggtaaccctccccagaagaacatggacttcatcatttcaccagattcacttgttccctttaaggcccagccaataaaagtatatggtatcttcaagctctgatttcctaatatcagagataaaaagccatgggaacgcagagacttggtgaatttgtaaaaatccaaaaagaaaggccagtcatgacggctcacgcctgtaatcccggcactttgggagggcaaggcagaaggatcacttgagcccaggaattttgagaccagcttgagcaacatggtgaaaccccatcttttaccaaaaagataaattatctggacatggtggtgcnagcctgtantnccagcaacttgggaaggtgangtaggaggatcacttgagcctgggangtggaaggtcccggtgagccc

SEQ ID NO: 4536 - DNA, 785 bp, Homo sapiens
  misc_feature 3, 4, 5, 14, 15, 16, 29, 37, 480, 484, 488, 489, 491, 494,496, 501, 502, 503, 509, 510, 516, 519, 521, 524, 533, 537,540, 541, 546, 549, 567, 568, 570, 571, 573, 577, 581, 586,587, 588, 596, 597, 598, 600, 601, 604, 605, 609, 612: n = A,T,C or G
  misc_feature 622, 623, 632, 635, 638, 644, 645, 648, 651, 655, 657, 659,662, 668, 669, 671, 684, 685, 686, 692, 695, 698, 709, 718,720, 728, 729, 730, 731, 742, 743, 744, 748, 750, 752, 753,761, 762, 770, 771, 774, 779, 780, 784, 785: n = A,T,C or G
agnnnttctaatcnnntttcaaatcgctnggctactngttctttttgcaggatcccatcgattcgaattcggcacgagggccaaactagggcctgctctgacatccgcaatgtacgtccactagcagtgcgcaagacctcccgcgagacaggtgttgtttttaatgcccatctcacagatgaggaaaagatctcaaagtaccttgattatttacccaaagttcccgacccaggcctttaaaactttttatgcatgcaccgcctcttgaccacatcagacaatcaccacaaaacgatgggctgacagttactagagggttagtaacttatctttaaaagggccaggtagtaaatattttaggctttgtggccaaaagtctctaccacacctactcaactctgtcacgctagcacaaaacagccacacacaaaaaccaaattgggcagctgaaaaaaaaaaaataataattacttaatgaanaaanaaannanacnanttgannnttcttnntttttnatncnatnatcccctcntgtnatnnatccnttnatgtagcttgtgacaagnncnntncttnaaancatcnnnataaaaannncnnctnntttnttnaaaaaccttnnatcctcttncanttntttggnnganatntttnancngtntaaaannanttttttcaaaaannnattttnaanaantataagtcccngtttttttngntttcgggnnnngggtttttaannngggncntnngtcccaannctttgggnnccnaaccnntttnn

SEQ ID NO: 4537 - DNA, 753 bp, Homo sapiens
  misc_feature 5, 7, 32, 33, 198, 275, 281, 282, 292, 301, 304, 306, 315,338, 367, 373, 374, 376, 390, 395, 416, 419, 440, 446, 474,478, 481, 537, 554, 559, 560, 563, 572, 573, 574, 589, 599,605, 613, 619, 638, 641, 643, 673, 684, 688, 710, 745: n = A,T,C or G
aaatncnagctactcgttcttttggaaggccnncatcgattcgaattcggcacgagattttcatccgaggcattgtctaatgatgtcccactgcgaaggataaagatgtagttttctttgactctgccacctcccactactcagctcactcatacttcctgccatctttcatcttcccaataagtatatcattatggntacattagtatcagggtttacattattatgaccatgtaaatgctatttctaactgagccatgtagtatactctgatnactttnnctttcttgcncaactttgnctntnctatggatngctacttatccatattgcttatntgctaagctttctgtatacttatcattgnctatgnntntgatctccaaattntcctncaggtgcctgaatttcctctnggnatgtccagacctatctaaatnttatantaatttaaccttcttggtgacatccatnctgnagnctttgttcacgacaatgctgtcatgctgagattaactgtcatcattatgggtatcnactttgcctacatctgngtctnnttnggatctctnnnttgtcagaccccttnctttcactcncttggnctgcactnaaattnggtggagcacatgcaatantangntcctgaggtatggtgaatgggaggcacatnattgaggtctngcanactgaaaatggtttacaggagnggcaaaccatgacccatagatgaaatgtacctggnacctggtt

SEQ ID NO: 4538 - DNA, 799 bp, Homo sapiens
  misc_feature 7, 384, 395, 398, 437, 463, 466, 492, 528, 569, 660, 677,701, 708, 732, 733, 750: n = A,T,C or G
caaatcnctaggctactcgttctttttgcaggatcccatcgattcgaattcggcacgaggcatagagaccatcatggcatgctccccgtgtgaaggcctctacttttttgagtttgtgagctgcagtgcgtttgtggtgactggcgtcttgctgattatgttcagtctcaacctgcacatgaggatcccccagatcaactggaatctgacagatttggtcaacactggactcagcgctttccttttctttattgcttcaatcgtactggctgctttaaaccatagagcccggagcagaaattgctgcccgtgatatttggcttcttggcgactgcggcatatgcagtgaacacattcctggcagtgcagaaatggagagtcaanccgtccgccancanaagcaccaatgactacattcgagcccgcacggagtccanggatgtggacaagtccgcctgagatncancgcctggacacgctttttctggtaangaccgctgggattgaacagaacttccggtaaataanggccccgtcggcaagacagcatactgctgtcacaaagtgcnaacacctggaaaagaaagacaagtgtcactggcctaaccatggtccccacttctgtcattcacacaagttttaagtgggtcttgccaccanaaatcctcttttgctanggtactccggaattgcttccctgnggctttnatcttaaatacttaaccatgggannaagactttcaagaagantcaatctttaattccttccctcaattggctaaaatttttcttaaaaaaa

SEQ ID NO: 4539 - DNA, 876 bp, Homo sapiens
  misc_feature 2, 3, 4, 5, 6, 7, 8, 9, 10, 14, 15, 21, 27, 29, 37, 710,711, 712, 718, 720, 721, 722, 723, 724, 725, 726, 727, 728,729, 730, 731, 732, 733, 734, 735, 736, 737, 738, 752, 791,793, 796, 818, 851, 870, 875: n = A,T,C or G
gnnnnnnnnntttnnaacttnctaatncnggctactngttctttttgcaggatccctcgattcgaattcggcacgaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaagtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaagagaaagaagatggaaaaaaaggtgaagacggaaaaggaaatggagaagatgggaaaaannnaaaaanannnnnnnnnnnnnnnnnnnaaaaaaaaagcctnttagaacttttaggggagtccgtatttccgtagaatccngnacntggataaggatcccttggatgnagttttggacaaaaccccaacttggaaatgccnttgaaaaaaaatgcttttnttttnt

SEQ ID NO: 4540 - DNA, 876 bp, Homo sapiens; identical to SEQ ID NO: 4539
  misc_feature 2, 3, 4, 5, 6, 7, 8, 9, 10, 14, 15, 21, 27, 29, 37, 710,711, 712, 718, 720, 721, 722, 723, 724, 725, 726, 727, 728,729, 730, 731, 732, 733, 734, 735, 736, 737, 738, 752, 791,793, 796, 818, 851, 870, 875: n = A,T,C or G

SEQ ID NO: 4541 - DNA, 1151 bp, Homo sapiens
  misc_feature 19, 27, 38, 41, 125, 182, 210, 228, 249, 270, 271, 291, 314,336, 338, 350, 354, 356, 363, 364, 367, 371, 385, 392, 393,416, 417, 419, 420, 425, 433, 434, 439, 443, 453, 460, 466,468, 471, 472, 474, 479, 484, 486, 492, 497, 498: n = A,T,C or G
  misc_feature 502, 517, 525, 530, 535, 540, 544, 558, 560, 563, 580, 586,587, 601, 602, 613, 625, 627, 632, 634, 635, 637, 662, 679,692, 698, 703, 704, 713, 725, 729, 735, 755, 775, 776, 780,790, 792, 793, 795, 799, 810, 812, 821, 831, 837, 847: n = A,T,C or G
  misc_feature 864, 874, 879, 890, 906, 910, 925, 926, 937, 938, 939, 940,948, 949, 954, 974, 980, 994, 1001, 1005, 1008, 1030, 1033,1034, 1036, 1041, 1048, 1049, 1117, 1124, 1132, 1139, 1144: n = A,T,C or G
ttctaaatactaggctatngttctttntgcaggatccntcnattcgcgccgcaagctgctgaatgccttgggactagctggtgattacctcgcccagggcctgaactcaccctggccaggtccanacctttctgctgtggggagcaagggccctggtcgtctactggctgctggctctgctnctcggcttggtcttggccttgctgggcngatcctgtggggctgaancttgtcattttacttggccgntttcttggccctgatgaagtnngtgccccgaaacctttttancccgggccctggttaattctggncctttggttgaatcctcttaanancactgcttatancccngntttaaannggntttnccaaaacctctttngggggtnnaaaaattttataggccaaaatgnntnncaaanggcttttnnaaacncccnctttggtaanggaaacntttagncnttnngnccccntaaangnccaaantcggnnccanaaagggggggccccnccaaaaanttggnaatgnaaagnaaanttaaaaccccgatntngcncccaaaaaaaaaccggnccaatnngtttcattaacccnnaaaaaaaaacntttaaaacctgngnttttntnngnggccccaattttctaaaaacccttntcctttgcccaaaaacnccccccttggggncccttnttttnnaattttggncccccttggggncttntttttngaaaaaaccttttttaaagnaaaaacaaattttgggaatnncctnttttgccccngnnanaaantcccccccaanantttttaggncccccaaggnaagggnaaaaaacccnctccgggaaaaaagggnaacccccaanttttnccccccccctntgggcctttgggttancccntttttgccggggggnnccccttggggnnnntttttttnntaaangggggtttccttctttgggnccctcnggggggggtttttnggggctntttnttntttttaaaaacccccctttttnatnntntgggngttttcnncaaaaacctttggggccctttaaacccaagggggaaaaaggttttttgaaaaaggggggcccttatcnctttttngggctttntttgggnaaaanatgggcg

SEQ ID NO: 4542 - DNA, 764 bp, Homo sapiens
  misc_feature 282, 340, 343, 345, 353, 357, 365, 390, 407, 467, 469, 512,596, 609, 614, 620, 622, 675, 701, 724, 734, 741, 742: n = A,T,C or G
atacagctcttgttctttttgcggatccctcgattcgtggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagcccgcccctgccaagggcaagaagaacaaggtatccacgagcccgtcagacctgggtggctaccaacaccctgagcaaggcggccttcctgttgacagtgctaantgagcgttcagagcaccacaacctggccttccgagttggcatgtttgccttggagctncanangccttcancttntacaaggncttggaagtgaaacttgcattccangaatctgaagtggctgncctgctcaaagaagatccctctgggtccaaatgagatgagtaccatgccgtgccgggcanangaacttcgggaggggacacttctgtgactatcggctgtgttgnctctcatgctggccagttcatctttgacgtctctgtgctccaagtatgatgcctgaccctacagtaagtggggaactggggtangggtagctttctnttaanaaagancnaagaccccaagtttctgaatcacctttaggaccatcagcaacttcatgggttnccggccccaagtcgcaactggaacancgagacaccttggggataagaancttggatttnaacacannttgcttgccttgggcatgaaaa

SEQ ID NO: 4543 - DNA, 867 bp, Homo sapiens
  misc_feature 12, 22, 28, 39, 238, 269, 362, 363, 385, 391, 393, 400, 401,405, 409, 412, 417, 426, 434, 444, 447, 448, 452, 477, 487,520, 529, 539, 579, 596, 601, 602, 605, 610, 612, 635, 658,660, 679, 694, 709, 720, 726, 734, 743, 751, 769: n = A,T,C or G
  misc_feature 775, 785, 788, 803, 827, 843, 848: n = A,T,C or G
ttcctaatgctnggctactcgntctttntgcaggatccntcgattcgaattcggcacgagaatgaaggttggggagaaaagaaagcaatttaggagactctatagggaggaaaggatgagatgcatttcagaaacaaaatattaacgtaaacagaaaaaagagaaagcaatcatgacaaagcctaagagggctagtggaatgctagaatgaactcatttaccttcctttgatatttangggctctattgcctgctaatttcatcactgntatttttcttacctcttatctttttccctgtagttattatcagcctaatattcattcattcattcatttaccttgagtttttaagcttgtgcnnaaaccaacaaggttggggcccnagtttncnagaatgnngttncccnacnttggnaagtaaacntgggttangggaaaaaangtnnccancttggccctttttaaagacaccaangttttacccncattccatggggttcaatggggaaggaaaaacnaaaggggantttattttgnaaaaaactgttgccaagattcccgaaaggggagccccctngaaagcttttaaacctnccaannaanccttncnagacccttttggccttttaaatnccctttttaaaaaggccccccantnagggaaaaaattcccagantgaatggggttaccnggtcttgacctttanggaacatgtangcttgncttgcccnatgttcccncaacattnggtccccttttacaatgnccttantacattaatnggngggcccctcattttnaaattttaaaaaatttcattttanccttttaaaaaattcnttttngcccaagaaaatgttttct

SEQ ID NO: 4544 - DNA, 935 bp, Homo sapiens
  misc_feature 2, 4, 8, 16, 94, 314, 340, 342, 366, 403, 408, 411, 434,547, 552, 559, 566, 635, 675, 682, 690, 709, 738, 752, 777,788, 814, 831, 855, 856, 881, 916, 924, 925: n = A,T,C or G
tncntatnctttgaantcctttttgcggatccctcgattcgctttttttagtgatcacttttgaattgtgttcagatatgcagtttcaggtgtnatcatcagagctggttagtcaggcattccagatagtggttcttttcagaacctttttaaaagggttgggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcanaggcttgtaagacttcctcatgaccntnattacaggccttgcttttggccgnattttggggctgaaaaagcacccttgcttcttcaganattgnagntatttggatgtataatagtttanccagatggtacttttggtaagacatcagatgttcaaaaaagtgcattccaacttgtctaaatactgcagtgtcccctttataaaaaggtcagacctaaaactggccaatttgntacanccggaanccctggncattttgggatatttttggaaaggtttttttccattaaaattcatttgggaaaatttaggtaattattngggcttggtaaaggttttaaacccttttttttaaggggtnaaaaaangggtattnggttttccaattttaagtnggccattttccttttcccttggcttgggnattccacctgggtnaaaaaccattggttgggaaaatccnaagcctttttncccaaattttccctttaatggcccangggttccaattggaatnaaacctttgggtaaaaaaggtttnnaagtttcccaaattccatttttggnggccttaatggggtttttttaaaaatttttccttnaaaagccnncccctttggt

SEQ ID NO: 4545 - DNA, 977 bp, Homo sapiens
  misc_feature 3, 7, 15, 21, 199, 300, 312, 315, 324, 337, 342, 369, 393,400, 412, 424, 429, 433, 438, 453, 454, 466, 473, 480, 485,486, 495, 512, 515, 517, 586, 631, 648, 663, 699, 725, 734,780, 797, 836, 848, 891, 903, 911, 927, 934, 942, 951: n = A,T,C or G
  misc_feature 956, 969, 976: n = A,T,C or G
atnccanctacttgntctttntgcaggatcccatcgattcgaattcggcacgaggttttaagtattctcatccgtcaactgggattggtaatagtacagggctgttaggatgattgcatgagatgaaatacatttagcacttggtaagcactctataaatatggcaatatgatagtccctgactcatcttcctctctgntgccctttaaacaggtgagcacctagccttgttggttttatgtgctcaacagcagttggacttcccctgggctcctctacccatgctactgcgtagtcaanccctccataaanctnctctctggnctctggttcccanatggnctttggcctttcctttttccttcccancttaacgtttttaaccatgccccngggaatnttttttgaaaangggaaactgganccttnggtnccccnggctttaaaaaaccnnccaataaatttnttacccncattagnagggnntaaaaaaancctaacttttttggggnggnantacctgggactttttctttccgaactttttcctggcccttcaaacttttccaaccctctttccccggtncattggggatccctattacccgggaggaacattacccaaaaattncctttaaaattttcttnccaaaacattggaanccttttttcccgggctttctttttcaataatggtancaatggttcccaaaaggccaaatttnattcttggncctttggaaacctttttggggaaaccaagaacttcaactttccatngggccccagtttttttnccaattcaagggaaggttttttgggcttggtaaaagggntaccccaacaanttggccaagggaaaaaaaaaagaagcccaccttgggggccttnaaacctggggtngggggaanaaacccctggggggtnccccttngggttttncctgggggnccttncccaaccttaagnccccacna

SEQ ID NO: 4546 - DNA, 932 bp, Homo sapiens
  misc_feature 1, 161, 229, 271, 281, 288, 326, 338, 339, 342, 346, 350,351, 357, 361, 362, 364, 383, 385, 403, 424, 435, 441, 442,449, 469, 483, 495, 497, 498, 524, 546, 566, 575, 601, 609,614, 637, 641, 649, 652, 657, 677, 684, 700, 704, 713: n = A,T,C or G
  misc_feature 727, 736, 740, 747, 750, 761, 773, 792, 801, 804, 806, 812,817, 836, 855, 858, 863, 865, 866, 883, 891, 901, 927: n = A,T,C or G
naatcccagctacttgttctttttgcaggatccctcgttcggaccctcatgccccgcttctgctccagcctttcttactcattaggctctagtctcacttcttattttttaaattgtgagtaattttcatgcttggtagttgatttcttttccatctctgnatgcatacttcctgcacctagtaggcacttgatttttttttctttgaatacacagcagatgccatgtnaactcattagtacttgcctcaaaacactgaattcttacctgngttaaatgcntgaatcntttaaactttttaagtttacctagaaagtgtataaagngggaactaatcnnttntgantggnnataccncccnngntttgaaaactacctttgancntttttttcctttttaatnaagctcttaaaaccggttaancagccccccgnggatannaaagaancttttaagctggggggaacnccttcattttcccnggaaaaaaaacngnnccaagggcttggggaaaaaaatgccnctaagggattgttttccagccnttccagaaatttttgggccnaacctggangaagcttcaaaattccaaggaaattntggtaaanggggntttttatgaggccaaattaaatngggncctttagnaanccccntttaggaccaattttaaatnggtttgnaaaaggcccagccttnggtnaacctgggncccctttggctttngcttttttngggnccattcnttnatacctgggcnaaaatttaaggnaaatttacctccaggtttnaaaaaaatnggncncctttnttggnaaaaaagtttcccttgggngggttttaaagggaaaaanaanaaaangnnaaaaaaaaacttcgagncctttttnaaaccttttngtggaggtccggatttaccgttagantcccc

SEQ ID NO: 4547 - DNA, 789 bp, Homo sapiens
  misc_feature 2, 6, 18, 389, 453, 495, 496, 505, 511, 512, 534, 535, 544,560, 564, 573, 578, 582, 585, 603, 608, 613, 614, 615, 616,619, 664, 670, 674, 683, 685, 688, 690, 691, 693, 695, 701,725, 730, 733, 736, 738, 743, 745, 748, 750, 751, 752: n = A,T,C or G
  misc_feature 753, 757, 758, 768, 771, 777, 778, 779, 784, 788: n = A,T,C or G
cnaatngctaggctactngttctttttgcaggatcccatcgattcgaattcggcacgagcactcttttatattagggacttgagcatctggagagtgtggtatctgagggagttcctggaactaatgtgcagatgccaagggacaactgtactattgtacttggaagtactcatggggtcatattgcattgtttctttgagtcctaattctgccaacatggcctggtgcttgcattaatcagctttctaatctctgagtaacaaggcacagtaacaaggagcagtaacaaggcacagggctggcacctgagagtggaggtacccaggaggcagacaccataaggcgggaaatggacatatgtacagaatcatggctgcatgtcctgaancctggcttaagccatcaacggctgctgggcaagggccaaagccctgttatccctttcgcccttnctgatggctctgtctctgccttcactgggtgtgggcaagccnnacccacccnaggctnnagccctttacccacagtgttannaaatgcaancttcaataggattgtncttnaggcccttncccanaaanccnggattttgacagggggcnatganttcannnnccngcttttaatggattggcctatcggttttaaaaataatgaccaatnggggcnttgngcctggccnanaancnntnancattcnattttcctgccaatttttgggtcnaaatnccngcngnttttncnctngnnnngttnnaatgaactgnaanaaaatnnntttgnttgng

SEQ ID NO: 4548 - DNA, 805 bp, Homo sapiens
  misc_feature 4, 21, 34, 149, 151, 176, 185, 192, 199, 210, 213, 221, 223,230, 259, 266, 279, 283, 299, 312, 316, 318, 321, 355, 393,397, 400, 416, 431, 434, 458, 467, 469, 470, 478, 520, 532,541, 548, 569, 571, 575, 576, 587, 605, 623, 626: n = A,T,C or G
  misc_feature 630, 644, 647, 655, 656, 659, 664, 674, 680, 693, 695, 705,714, 719, 720, 722, 725, 734, 739, 746, 754, 764, 773, 779,782, 790, 792, 793, 801, 803: n = A,T,C or G
ttcnaatgcttggctactcgntctttctgcaggnatcccatcgattcgttcaaatctgccactcccagagcccgtggaactctggcccaaggctctctgactgactccttcttggcttagcggctgaagactgacactgcccgatcgcntnagaaacaccgtaaaccatcacggangccgagctntacttanctttcanagtggaggaangcnggaatgtnangcctctnaacccaagccaagccatcacattccctgngacttgnacgtatgcacgtntgcncctaaatggcctgaanttactgaataatnacanangangtgaaaaggccctgtcccgccttaactgatgacntttccaccattgggatttgttcctgccccaccttaacngagnganttaccctgtgaatttncttctcctgggtcanaanctcccccactgatcagcttggganccccgttcntnncaccatanaacaaaccccctttgactgaaattttcccattaccttcccanatcctataaaangggccccanccttatntcccttcgctgactcttttcngncttnnggcccatctgnccctggcgaaataaacanccatgtagttcacataanaanatcntttaaaaaaccttngancccttttnnaantatantggaggcccnttttangggaaattcccgnantttggataangataccatntgtannanttntgggccaanacccncaaactntgaaatgnccatttgaanaaaaaaaangccttntantttttggncnnaaaattgngngg

SEQ ID NO: 4549 - DNA, 868 bp, Homo sapiens
  misc_feature 1, 19, 41, 227, 247, 289, 310, 322, 344, 345, 353, 368, 396,401, 413, 414, 415, 427, 428, 430, 435, 436, 438, 440, 441,442, 458, 467, 469, 475, 477, 494, 536, 552, 568, 579, 581,583, 587, 611, 614, 617, 639, 640, 642, 654, 659: n = A,T,C or G
  misc_feature 663, 667, 669, 671, 676, 685, 695, 701, 708, 710, 714, 719,720, 729, 736, 737, 739, 744, 745, 746, 753, 755, 756, 759,765, 767, 770, 781, 782, 783, 785, 789, 798, 800, 801, 805,808, 809, 813, 822, 825, 829, 831, 833, 836, 837, 838: n = A,T,C or G
  misc_feature 842, 850, 851, 852, 860, 864: n = A,T,C or G
naaatccctggctactcgntctttttgcaggatcccttcgnttcgaattcggcacgagccagcctggccaacatggcaaaacactgtgtacactacaaatagaaaaattggccgggcatcatggtgtgtgcccgtagtcccacctactcaggaggctgatgcaggagaatcgcttgagcctggagggcggaggttgcagtgagacgataccgtccactgcacttcancctgggcaacagcaagactncgtcttcaaaaaaaaaaattttaaaaagatttttcttatggngggtttcaaaaaatggttgtnttggcaacgctnggtgccaatgggttacccctgnntaatcccnccactttttaaaagncccaaaccgggtggggatcaccctctanggtcnggaaattttgtnnnacctttggggtnnanaattnngngnnnccccccatttttttcnttataaaangnaccccncnaaaaaattctatttccncggaatttgggtgggcaccgttgcccttggtaaattcccaanctttctttgggggaangctttaaggcccaggnaaaaaattggncntnaaancttctgggggcttcaaagccgaancanttnccaaccttcaaccttccatatnnanttggggactacnagggngccncccnancnttttnctggctaanatttactgantttcangtagagnanccanctttnnttatttttncccaaanncntgctnnnaaattcntnnctnttatgnanccnaccaatatctnnntncccnaaaattctngnnaccnttnntctnagaaacctnatngccncnantannncctngggttcannntttccccntccntttc

SEQ ID NO: 4550 - DNA, 855 bp, Homo sapiens
  misc_feature 9, 13, 17, 25, 346, 359, 377, 378, 390, 400, 406, 420, 428,437, 441, 462, 539, 549, 566, 601, 631, 645, 649, 663, 714,757, 766, 777, 798, 853: n = A,T,C or G
cctagttcnaatngctnggctactngttctttttgcaggatccctcgattcgaattcggcacgaggtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcctattttgtacactttgnggttgaattcctnggaaaacctggcttctgnnaaaaaccttttncttaggaatntgtttngccatctcttaacnttacaccntgccctgtncttntccactggattgaaaggcccnataaaggaaggggagggaagggaaattgatttcaaaggccccaaatgggccacattttaggaaagaataccctcacnatggaataancccatttggttaatgtngtggtgccaaatttttatttaaacaagtgcctggngtaatggtgggtggggaccaaagtttattntggaaaatatcctnagtnctttcttagaatanttttgggaaaatgccttggatggtattttaaaaagtggtaagtagaaatanaccccttttggaaaataagcctttttaaaaaacctgattgggnaaattcctngttttggaaanttggaaattggttggaaccancctgggaaggtgggaaggggaagaaaatgccaatgggggttttggccattggttnta

SEQ ID NO: 4551 - DNA, 778 bp, Homo sapiens
  misc_feature 2, 3, 4, 5, 8, 9, 13, 14, 15, 18, 21, 25, 26, 28, 29, 41,44, 46, 48, 53, 55, 56, 59, 62, 64, 111, 115, 116, 130,137, 138, 139, 364, 365, 373, 374, 506, 535, 561, 577, 592,607, 710, 712, 715, 720, 730, 733, 738, 741, 747, 752, 771: n = A,T,C or G
  misc_feature 778: n = A,T,C or G
gnnnnttnnaaannnccnggnttcnngnngcccttgtttgnccnananaaacncnntgnaancnccggctcgcttctcctcttccattgcgatttgccttctttatccagncttnnggaatgctgatttnaaatgtnnntggcacaaggcaggcgtgaaaacataaagttaataaaaatcgaatgcataagctagagcagattatccacagattcttccatctccatatagattatcaccattgcctgcacctgttttccttctccagcctatctgatggaatggtgcttccatgacatgtggtatttggaaggctcttagctctgatgtaatcagggtttgacccatagtcacctgaaatagnncttctggnnctctttggtctatgaactgaagggtctcagaagcccgtgttatgcaaatacccttccatccccttccctctccccttgcctctatccatgttccctcagcctcagggtgcttgcaggctaagaggattgggnctctggcatcctggagctgaacagctcgngtcaggaattccccaggcccttgagnctctggggtgagttgnaggggtgtgtagggngctggggattaaganctgctgagtaggggcttaccagaggtatactgaaggacctgaagacagatcatcttcacataatcagcatgaccataatctgggatggcactgagcttctttnantcnggagncaaggaatgngcncaagnaangcaaantaatnccttttaagcccgaggatnagggaan

SEQ ID NO: 4552 - DNA, 788 bp, Homo sapiens
  misc_feature 3, 4, 7, 8, 9, 12, 13, 14, 23, 26, 35, 103, 596, 645, 683,702, 704, 709, 717, 722, 760, 767, 781: n = A,T,C or G
ttnnaannnccnnntttcaaatngcnaggctactngttctttttgcaggatcccatcgattcgagtgattaagtctcactaggaataggcttttctaaattgntttatctcatcctcattagaacttcaccacatgtgggaaatcatgtggcaaaactgtctctcttaaaaaaaaagtcaccaaggaaacctccttctgcaatttaagaaataaaatcccagtgacattgatttggatgctccaaacatgtccataatggaagagcttttccaggttttggtttgggccccccagaccaaagctttgacacataatacaagctctgtaagtctgttttcctgtctgtaatttgggattgtcatctttgtagggtgtcatggagattaagttattcactgtagacaatgcccctttcatgtaatagattctgtcagtattagatctttttctttctcttcaagtttcaaacatagattaggcaaaattttaatggctatttcacaaaatcagcttgattcttgtttatgacatcaagtgttgtttttccaggttgtctgttaaagggctacttttttttttctaaaagtgcttttanaaattccagtgttagtatgtatgcatcatttaagctaagaatgaagatntaaagatcacccaacagtttaaagctggattcttttancaggtcaaaggagaattgngntttgnctagctgncttanccgtgtcggacttcttggactcaagtgatcccacctgnccttaanctcccaaagtgccnggaggtt

SEQ ID NO: 4553 - DNA, 750 bp, Homo sapiens
  misc_feature 2, 3, 5, 11, 18, 21, 25, 34, 39, 597, 666, 673, 725, 730,743, 747: n = A,T,C or G
gnncngccttnagttccncangcgnactctttgnacgancttatgaacagatatggaggccagagctcatttgggtaaacttactcctgctgagttagcattttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaaagtattgnagcatttggttggatccatgaaaaaatgtattcagtgggcttttaaaatttccatttgcagaatttggnctctcangctgtttggggagctcttttttttaccattttttctcctttgcacctatttnatggnggttaaagtaaanggtnact

SEQ ID NO: 4554 - DNA, 895 bp, Homo sapiens
  misc_feature 3, 7, 8, 9, 12, 16, 25, 360, 361, 467, 481, 513, 515, 566,661, 699, 706, 712, 728, 740, 741, 755, 776, 780, 787, 811,828, 831, 834, 847, 888: n = A,T,C or G
aanagcnnntcnaatngctaggttntcgctctttttgcggatccctcgattcgaattcggcacgagattattataagactaacattctgataagccatggtataattaacattattaaaatgtttacatataatccttcttaaagtatactcttttaaaaatccattggcataaccttacttttagtttagtgatccagaatttccccagagcttaagccactgcagtaaattaggtaccgtaggatattcagtcgctactagccacaaggagtctccttattttaatgtacctccctcagtactttattcctgcagagcgcctcagagtgggggagagaaatgagcaatcctggctcanntggattatttcagcattttattttctaaaatctgtagtgtgatcccgaaaatatttaaaattaaaaaaaatacttttaccagaagagaggcctacctaatcaatgngctttagagaaacnaaactaccctttaccattcaatttaacaaccnanaaaaaggtttacccgaaattttaacaaaacattttttctttatctgaattntggggaggaaaatacttaatgctgacaccgtttaataaatttaggaaaaaggatccattcccaggaatctttatgggaaaaaattgggggttttnaaatttccaagccaggtttggctctttggaagaacatngggtaantcctcnttaaatggtaaacttncttaaaagggannaggggtaggaattnggaaaaagggaatctttgggnattnttacccnttaaattaatgggtcccaggaatnggggtttcaagggattnttncanaaattaaaaattngggtttttgggttgggaaaaaaatggaaatacccttttttnggggggg

SEQ ID NO: 4555 - DNA, 765 bp, Homo sapiens
  misc_feature 1, 5, 14, 16, 22, 29, 401, 419, 599, 604, 645, 668, 684,691, 702, 728, 729, 733, 743, 751: n = A,T,C or G
naatngctaggttnanacgctnggctctngttctttttgcagggatcccatcgattcggtcgtgactcctgtacaagggaaaataggcttggagaagattggtgtcaaaattaatgagaagagtggaaaaatacctgtaaatgatgtggaacagaccaatgtgccatatgtctatgctgttggtgatattttggaggataagccagagctcactcctgtcgccatacagtcaggcaagctgctagctcagagactttttggggcctctttagaaaagatatatcatactttgttctggcctcttgaatggacagtagctggcagagagaacaacacttgttacgcaaagataatctgcaataaattcgaccatgatcgggtgataggatttcatattcttnggaccaaacgccggtgangttacccaaggatttgcagctgcaatgaaatgtgggctcacaaaacagctacttgatgacaccattggaattcaccccacatgtggggaggtgttcacgactttggaaatcacaaagtcgtcaggactagacatcactcagaaaggctgctgaggctagcctgctgctggttaagttctncttgncatattctcatttctctcaaagataagaatgctctcggatnaaatgagcctgtgctcatgacanctgctctggtacttanggaccantgcaaggcttncttaccacacttagatgagaaagttnncaanggaaaaaggncaccaatngggcattttgcctt

SEQ ID NO: 4556 - DNA, 807 bp, Homo sapiens
  misc_feature 3, 4, 18, 19, 27, 31, 34, 38, 395, 413, 440, 527, 535, 544,558, 565, 571, 572, 616, 629, 664, 694, 710, 730, 733, 737,739, 750, 751, 755, 762, 769, 788, 790, 791, 794, 797, 799,806: n = A,T,C or G
agnnctttcttacgcctnntgaacttnttgnaantccntttttgcaggacccatcgattcgaattcggcacgaggaaaggacccatgatgtaaggatgtcttttttggggggtgcttgtggctccttaactggctctggaaagagcctacttcccatagtgaaccctgtgaggtccaattctgttcctccccttggagctccaagagaaggtcattgccttgtagcagcaggtgcccccccaagctgggttctcactgcaggtgccagcgggctctcagtaggtatgacctggatgtgagtggtgaaccaggattgaggcactcagcaccttcgaccacacttccactctccctggggttcaagtcaggctatggaaaagtgtcaccctgtttgncatataactggatgggtngtaaacagaacgcctctggcaaaggtngaccttgaaggcaaaactgagttgagggttgttaggacggaaataattactgctgggcatgcaacacttcccaaccgttcttgtgangcaagcantgttattgncagtttggcacaanggcacangtgtannaacaacgtaagtgccctggggcccgtgcttacaccacccactgnggtttgaacttanaatgtgaacccaaggccctttttgaattcccaaantccctcaatcccttcaatcctaaacaagcnttgcctgccgggttanccaaaaaagggggacctccnggnaatntngctcttggcanntttntttaaanctggatntattaatggggaaaaccananntanaantntttggtnt

SEQ ID NO: 4557 - DNA, 909 bp, Homo sapiens
  misc_feature 5, 311, 322, 338, 349, 359, 363, 364, 386, 394, 396, 403,408, 409, 415, 421, 431, 438, 443, 451, 469, 474, 475, 482,486, 490, 505, 524, 549, 622, 627, 648, 649, 689, 715, 739,741, 748, 778, 779, 786, 814, 818, 822, 824, 825, 826: n = A,T,C or G
  misc_feature 827, 828, 840, 844, 845, 846, 848, 856, 858, 860, 872, 885,892, 894, 898, 902, 904, 909: n = A,T,C or G
ttgcnaatcgctaggctctcgttctttttgcaggatccctcgattcgttttttactatgtaccataatgtcccattcatgagaacctagcaagtagtttttctcattagcgaatgctagaattttattttttttcacatagtgaaaaggtgaaattggtctgtcttcctctttactttagctgctagtaaggttgaaacaacgatggtgcccaaatttaacagttaggtgacatcttcttctacgtgtgctaagattacccagacttcactttacccttatttcccactgactttgatcccttttacttgnttttattctgnaagtatgtatttttgncatctttcagnactctttggnatcnnaataaaattaaattcccctagnctttaaanangataatngggtnncttggnttaaanattaaaaatnaaaagtnatttngggctttnatataataattaagccantaagnnatttttnggcnaaantccttttcttgccanaagggggcccagaacgggnttaaatattttttaagggtggtttnccaagggccaaggtggaatcctcttgggttggcaaacttaaccttcaagccttcttggccggttccgttaaantgganggaaaaaggccaggccccttnnggacccaatgggccatttaaaggcccaaaatggggggttngttggaacttggggggttttcccaanttaaaaaacctttttaattttttncnaaaaaanccaatggggcttaccattttggactttttnngtggttngtaattttggccttacccccccaaaaanaaanaaanannnnncttcctatattnactnnnanactttcantnancaaaaaaaaacntgggcccttttanaactttngngggncctntncctan

SEQ ID NO: 4558 - DNA, 752 bp, Homo sapiens
  misc_feature 5, 6, 7, 575, 584, 618, 649, 673, 693, 715, 726: n = A,T,C or G
aaatnnnagctacttgttctttttgcaggatccctcgattcgaattcggcacgaggagccatggcagaaaatcagtgatgtcattgaggactctgtagttgaagattataattcagtggataaaactaccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatgctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcagggatttcctgtaaggaatgtccggcctgtacaaaatgcaatgaatcaggttgggattgtgctgaacgtacagcaaggccaaacggttagaccaattacactagttncagccccangtacccagtttgttaaacccgacagttggagttncacaagtgttcttccagatgacccctgtgangccaggcttcacaatgcctgtganggccaccaccaaacaccttnaccaccgtcattcccggcactnttaccattcgnaagcaaccgtcccaaagtcccagtct

SEQ ID NO: 4559 - DNA, 960 bp, Homo sapiens
  misc_feature 13, 348, 378, 381, 395, 398, 399, 406, 414, 418, 431, 442,448, 456, 457, 491, 492, 515, 533, 560, 575, 582, 595, 604,615, 634, 638, 642, 650, 659, 669, 707, 730, 735, 744, 765,803, 832, 834, 839, 847, 907, 913: n = A,T,C or G
tttcaaatcgctnggctactcgttctttttgcaggatccctcgattcgaattcggcacgaggtctcgagtttgttgttttttgtaatccgttttagagtgaattaaactcagacatccctggattgtatgctgtctgtagaatgttgattttcaggcacggggatgtagctgtagaatgtggcttggtcattcttcctgataagaaattgatctcctgaatggattggccatttggtaatttcttagtgaaaggctgactcttgaatatggctggtataatataaattcttaccaacataaaagtaagggcttatttggggcttgggtaaaactgtcatgccttggangatatatagcttataaaattggcttaaccntgnattttatgacctanctnncccctgntgccaacntttnacttgccaaaaancctgggattcntgtttnccaagggnngaccttattatttgtggaagaaaaatttggattnnccaaggttaacctatttttcaanggcttcttggctttttgnaatttttcttcaatttcaccatggccntcctttttattcctnttttttnccccttcccaaanggggttccnggggaatttancctggtttcccgggaaagnaaangaangggatttnttccaccanttaaggccanccccaaatttttttaccccacctttccaaaaaccccangggaagccttaccttacctgggngggtnaaaaattanggggtttaaccaccccccaanatttgggaaaaatcctttttggccaaaaaagggttccngggttcctaatttcaaaccggaaaccagngnacttntttagccnaaaaaaggaaaggaatccgtttccccattatttgggaaccgccccccattttaaaatttncccagnggttttcctttaaatgggaacctttgccaaaagggaaatatttggcc

SEQ ID NO: 4560 - DNA, 769 bp, Homo sapiens
  misc_feature 3, 7, 11, 12, 15, 17, 22, 23, 370, 395, 402, 410, 428, 440,447, 450, 465, 468, 497, 521, 529, 595, 665, 722, 729, 731,737, 761, 766: n = A,T,C or G
ttnaaancccnnttncnaatcnncagctacttgttctttttgcagggatcccatcgattcgcaaagcttgatctattaatatattgatcagagttccatgatccttttctaaaatggtggctttattttgccagaataattctgcagggtgttttttttgggacggagtctcactctgttgcccaggatagaatgcagagtggcacaatcttggctcactgcagctcttgcctcccagtttcaggagaattgtgtgaacctggaaggcggaggttgcagtgagccgagatcaatcaccactgcacttcacctgagcaacagggcaagacttcatcttaaaaaaattttttttggatttatatttactganaaggtctgttactaaagggtttaanatttggntgggtttnaccgctaaatgtttgtanagtctgaatctntggcctnggnaaagaataattacangcnttcaccaagttgtgaaaccttctgggttnggatgaaaagaaactttcaagctnagaggaanaatgttctgaaatatttggggaagtttggcagactcctttctcaaggggtatgttcatttgggccngtgattctggaaccccctttgcagatatcttaagtgtgtcatgaaagtttaccaagaacattgtgagtanttgcaattaccaaagggaaccaatgttcatattactttccattatccggtctcaagnattcttncngagatnctttaccctgtgtaaagtgaatcncttcntct

SEQ ID NO: 4561 - DNA, 756 bp, Homo sapiens
  misc_feature 1, 395, 592, 594, 605, 633, 664, 730, 742, 752, 755: n = A,T,C or G
naatcgctaggctactcgttctttttgcagggatccctcgattcgcagagctggggcatggcatgtctcaggaagccatgcttgtcacagaggaatcactccgaggctaaaggaacatctgggcaatcctacttgtgtactcattggattcattcagtgaccttgttattatccttctagctaaatgctctgggtcttaattcacgactccaaggttgctcttgattttaaggaacattttggcagaatagagagaagttgagcaaatattaacagatgtccaaaggggcagtgtgatttattatgtcaagagaatcagttttatgtcgagggaagaattttggtagaaatcactgtattttttggaaaatatcatatttgggttttttcattgnataagtaatacatggatacatgcttatataaagaaaaattcataatatagaaacataaggaggaaaaatgagtcatttttctcccatagttcactcctttcccctccctttcagtaaccagtgctacacgggtgtgtctttccagacgttaaaagcagtcatacatatctctaaagggaaagtttgcgtttgcttgntntttcttcctgnattaataggatttgggtatatatatacncaccccgtaatatattttggatctggatatntaggagcatatttctggggtgcgctttttaaaattttatggccaaatcctacagcttcttcatgtnacttgcttattngatgtttccncant

SEQ ID NO: 4562 - DNA, 766 bp, Homo sapiens
  misc_feature 4, 8, 395, 406, 609, 634, 678, 679, 686, 709, 712, 717, 764: n = A,T,C or G
ttcnaatngcttgctctcgttctttttgcaggatccctcgattcgaattcggcacgagcccgaaagtgacttagagagtgactcccaggacgaaagtgaggaggaggaggagggagacgtagaaaaggaaaagaaggcgcaggaagcagaagcgcagagcgaggacgacgacgaggatacagaagaggaacagggggaagaaaaggaaaagggagcgcaggagaaaaggagggggaagagagtccgttttgcagaagatgaagaaaagagtgaaaattcctcggaggacggtgacataacggataagagtctttgtggaagtggtgaaaagtacatcccacctcatgtgaggcaagctgaggagacagtggacttcaagaaaaaggaagaactanaaaggctgaanaaacatgtaaaaggtctacttaacaggttgagtgaacccaacatggcttccatcagtgggcagctggaggaactgtacatggcccacagcagaaaggacatgaatgacaccctgacctccgctctcatgggtgcctgcgttcactgcctcggccatgcccaacagactgatgatggagcatgttctcttagtcagcatccttnaccacacagtttggaatcgaggtcngtgcccactttcttggaggcattggtgaggaaagttcgatgccnntcttttnaataccggaagccaaagggaaanganttgtnacaacctgttcaccgtcattggccattttatacaacttcccgtggtnct

SEQ ID NO: 4563 - DNA, 755 bp, Homo sapiens
  misc_feature 3, 5, 399, 700: n = A,T,C or G
ttncnaatcgctaggctctcgttctttttgcagggatcccatcgattcgaattcggcacgagggacaaaccatctccagagccttaatcgcatctgtaaagtcccttttaccatgtaaattaatattcatagtttctgaagatcaggatctggatttcttttggggcaattattcagctaaccacatattataatgaggaagcacttcttgggaggcatcataatgcttgttttttcttttcctaaatagagtatcacttttacccaaatggaataactcgctgggttattttactgagctcttgatgctcatttctttggtcttctctgtgatgaattaatgtttctatatggacatcatgcacaatttctttattcctgaagaatattttaaaatgntgttattttatgttgtagttggtgtaatacggtgcccagtatgcccgccaagaatgcagacagatagaccttgtggataattattttgtgaaagacacatctgaagctcctagcagttctgatgaaaaatcagaacaggtatgcttctcaatttttctttatattcctatcttgatatcaaactgtaagtataagaaaaacatgtttggatagttaagtcatttaaggtggttctgctatggattcctggttcaaatagaaagttaaagatagctttcttatatactctcaaacttagttnaatgagactaaagctattacttaaaatgtcaaaatttgggccagcattgggggct

SEQ ID NO: 4564 - DNA, 753 bp, Homo sapiens
  misc_feature 3, 5, 9, 20, 472, 552, 627, 635, 704, 718, 720: n = A,T,C or G
ttncnaatnctaggctactngttctttttgcaggatcccatcgattcggtcggtgttacacacattcacacttgcaggcgtgcaggtcggtggtgttacacacattcacactgttgcaggcgtgcaggtcccgtggtgttacacacatgctgttgcaggcgtgcaggtcggtggtgttacattcacactgttgcaggtgtgcaggttggtgttacacacattcacactgttgcaggcttgcaggtcggtggtgttacacacattcacacttgcaggcgtgcaggtcagtggtgttacacacattcatgctgttgcaggcatgcaggtcggtagtgttacacattcatgctgttgcaggcgtgcaggtcggtggtgttgcacattcatgctgttgcaggcatgcaggtcggtggtgttacattcacgctgttgcaggagtacaggtcagtggtgttacacacattcatgctgntgtgcagctatcacttccatcttcagagccctttcatcttaaaactgaagctctccatcacacaagtgacccttcatgtnccttcccagtccctgaaaaacactgttcaaggtttttcttcctgggacctcattgtgtggagtttctcgtgtganttgcagtnacacacgattggccttttttttttcgttgttgagacaaatcttattctgccttcaatctggggtgtcanaatgagaccccatntnaaaaaaaaaaaaaaaaaaaaaacttgagccttt

SEQ ID NO: 4565 - DNA, 775 bp, Homo sapiens
  misc_feature 12, 485, 523, 555, 623, 636, 641, 684, 687, 691, 704, 707,714, 729, 744, 754: n = A,T,C or G
ttccaaatcgcnaggctactcgttctttttgcagggatcccatcgattcgaattcggcacgaggcaggtcccctcccacatctaatccaccactaaggcctgcttcttaatagctcttgttcggctttggttgagacagggttttgctctgccgcctaggctggagtgcagtggcgtgatcactgcagcctccaactcctgggatcaagcagtcctcctgccttggccttccaaagtgctgggattacaggcgtgagccactgtgcctagcctgaatagctcttaaatctatccacttttcttcctctgcacacctgacaccctagtcctgctgccctcttctccacctggacaacctcgcccacccccaagttggtttcccctcatctactcttgcttcctttcagtctatcttctgtcctgaggtcagaataatttgttaaaaatataaatggggtcaagaatgagttggggatggagctganctagagatgggttgggttggggttgggacttggataangcatggaattggggttcaactgatgtaaaagntaagaataggattgggatgatgatgaaggttgaactggggatggcttgggggttgggggatgggcaanggcttgcctactnaccanaatttgccctggttgcacaaagttttaacccacacccaacctncgntaanggctgggggaacnttnaagccantccgaatagcttaangggccctgttgggcntttcttgaanggggtaccagttttttttcct

SEQ ID NO: 4566 - DNA, 761 bp, Homo sapiens
  misc_feature 2, 4, 5, 6, 9, 573, 675, 694, 726: n = A,T,C or G
cngnnnctngttctttttgcaggatccctcgattcgtttttttttagaacgtggtcttgtctctatcctctggacactgcagcgtacgagtaacaacaggtcttgcaggctaaataacttataaacaaaatttccttcctgaggagctaggtattccgatgtatcttcaacatagtcctgaagttcatatggcaatcgtccttttggcttctgaaatgcagaaggccatccagatttcggccaactagaggagtctgaaggaccagacaattgctcagaaacagaaggctgtttagaattttctaaattcattaagggcaattctggtacttttctggaaattggctttaagagctcatcctgcatttttaaaatctctccaactggatcaaattttttatatactcgtttgataggtttttttaaaacacatgactcttcaggactacaagcagtattagtctggtttcctacagaagcctgtcctgaggaagaatttggactagctggtctggaacttaagttagaacccacaacagctgtctttccatcactattatttttacattctgnatcaatgattaaacactcctcatctgtatcactgctgcagagaactgtatcttcagtttttgctgcttctgatccaacagtcttttcctttgagttggctanggtttctagaacattaggnctttcaccatcagcatgtaatatatctatagncatatcattttattagaagttcaatttcttgaaat

SEQ ID NO: 4567 - DNA, 780 bp, Homo sapiens
  misc_feature 8, 9, 19, 23, 24, 26, 78, 432, 446, 543, 691, 695, 699, 708,719: n = A,T,C or G
ttgcaaannccctgtttcnaatnncnaggctactcgttctttttgcagggatcccatcgattcgtctaaattcatggnttatatttatatatgtccttaatcctcactcacattggccctacaggtagattcattgctcactgtcagttctcttgctgaagttttcctatttttctcttgatttgctgaaattccttctccagtagtttaatcaaaagggactaaatgaaaaaaaaaatattcagttgttgcaagttcaaaaaggtttttagtctttgtgtttgattgacagctttccagcatataaaattcttaggccacactttctttccttgagaacttcacagatgtcacttctggctctagagttaaatgcccctgtgggaaaaacttgagctaacttctattttggtaccctttatgaattgatgntttcacttgactgnccaaagtcttttttatttaactggttccccctttcttttatattttaagtctagttacttttcatagaaattacccttggtattgacagatttttgncatttttccccaaagacatggtgtgccctttcagttcgtagatttatcttcttttacttcaagaaaattttcttggaatgatatctttaaatatttatgttcccctatttgagttttctattctggggatatatgatgggtcccttgnagancttncaaatctgnaatttctctgnaatctctttacaccggtcatttcaatttcctttgctcactttcctcatcttggtctcaggg

SEQ ID NO: 4568 - DNA, 768 bp, Homo sapiens
  misc_feature 4, 5, 7, 8, 9, 10, 11, 12, 16, 17, 18, 20, 35, 37, 40, 109,110, 721, 728, 762, 765: n = A,T,C or G
gtgnntnnnnnntttnnncnaaggaactctttgcnanttnccctttttgcaggatcccatcgattcgaattcggcacgagcctagttaaatcacaacaagttagtaatnnataaatgatgtgtcctgtttctctttagtagaaattatatttttggctaccagttaagaaacttgtctcctttgtcccttatgttactataaactcaagatgatgagttttgtggtatttgacttcataggcaaaatcaaaatttttactttgttgctattctgttttatgaaataaacttctgtctatgcatttgaactaagtttcagcaaattcaatctaaattgaataattccagctcccagttttatcctatgttgctcataaaacagttccaagtatactgcattatcttgagatttgaagatatggtgcccacggggattatactaggcaaatgcgttaagcagctctggcctaggtgttgtgtattttaagagactctatcttaggagagcttaagtgattgggctgcaggaagaagacattgtaacccaggaattaaaaatggattcagattgcctgattttaacactttagtttcaccataggctaattatgtgacattgggcaagagacataattcttctgtccttagttctacatttggaaaatagagatgatttgggaacttattaataagatttttgtgagagataaataaacaaatncttttgnaaaaaaaaaaaaaaaaactcgagccttagaactntgnggg

SEQ ID NO: 4569 - DNA, 793 bp, Homo sapiens
  misc_feature 3, 5, 8, 9, 13, 16, 18, 19, 23, 35, 37, 43, 45, 615, 622,645, 656, 659, 698, 714, 718, 725, 746, 756, 757, 758, 765,766, 792: n = A,T,C or G
gtncnatnngtgntantnngcgncttggcctaaananataggntngggcgtgattctggaacagagtgcacaccaggagaatctaagaatttgggtcaaaaagaaaatggcaattacatcatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtaagtgttctagaggctccactgctggcatctgtccagtgaagagtgtggaagctatccaagaggccttctgaattcctctgacatatatttgagaaagggcttggactgtgaaaagaaatgtggcccctttccatcttcaagagagatggaattaatgatggatggaccctggagggaatctccccagcccgactttcactgggctgacagactttgctgaccacaggggaacnatgttcntttcttttcttcatgatcagacntaaacctagcntcnttaatggaagaaaaatgaagggggaacttcaattatganttattcaacgaccaantttntattacncccctccttttatgaccaagntgaccatttnnnatgttanngttaaaaaacctttcccttgcccttnt

SEQ ID NO: 4570 - DNA, 760 bp, Homo sapiens
  misc_feature 2, 3, 4, 5, 8, 9, 10, 11, 12, 13, 14, 15, 16, 17, 18, 19,24, 26, 27, 691: n = A,T,C or G
gnnnnttnnnnnnnnnnnnttttnannatacagctcttgttctttttgcaggatcccatcgattcgctgacaagtctgaaatacatattggagcctggtagactgaaaactcaagcaagagttgatgttaaagtcttcagtctgaaatttgtagggcaggagattaggctggaaactcaggcagaatttctgtgttacaatcttgaggcataattcttctccaaaaaaatctccatttttttctcttaaagccttggatgagccttggatgattggatgaggactacccacattatctagggtaatctcctttgcttaaagtaaactcactgtgttaatcacatcaacaaaataccttcacagctacatgtagtgtttgaccaaacaactaggcaccatagcctagccacataaaattactatcattatactttttcttatcacatacttctaccttggaagggatatttcccagttggtatagctacaaaacagaggcagatcatttagcctgcatttgatttgtagtgaaaaataagcctttggtgtgtttaaccactgaaatgttgcggtttattagtatagcacaacttatcctatactggccaacatagatgctttcggttgcaagtaacagatccccttacagtttacaaaaaaaaaaaaaaaaactcgagccttagactatagnagtcgattcgtagatccagacatgatagatcatgatgagtttggacaaccacacttgatgcagtgaaaa

SEQ ID NO: 4571 - DNA, 780 bp, Homo sapiens
  misc_feature 11, 12, 13, 14, 15, 17, 18, 19, 20, 21, 29, 38, 44, 50, 246,253, 335, 439, 584, 669, 715, 742, 776: n = A,T,C or G
aaacgcttggnnnnncnnnnncctttttnggatacagnttctangacaanagctacttgttctttttgcaggatcccatcgattcgaattcggcacgagacttttttaacgaatgggggaagggatctatgagaaaggtggtatctaatttttttatggaccataaaggtttaaaagaaaataggggcacaggctgttgaggtttttatgttgttatagacctttttaaattatgttagagatgtntataggnatttaaaggtcactgggagcgtttctgattcccggccacactttgcatttcaacactcagcccggaaagatgctcgttcggntgttggacctctttcactccctgcgtgtaagaaggtgaatcacgtgggaaaaagtgatccttagcaacgtgccaggacacttcctgtgtgcctgcagttgtcanggaccatttgggatcccgaatctcattctctaaaactgctttcttgaaacatgttacttccttagtataatcaatgtatactcccttactggcctgaaacgttgtatagctacttattcagatactgaagaccaacggactgaanaaaagaacaaacattagctattttatgctgcaagaaccaggacacacaattcgccaatcatcccaccatataaccttcgattggngcttctcaactccaccccataatttcttccagagaccatctatcancttttccccaaagaagaaacaaaaccngttgcaccttaaaccatggatattttttcctcangggc

SEQ ID NO: 4572 - DNA, 774 bp, Homo sapiens
  misc_feature 2, 6, 7, 8, 9, 10, 12, 13, 14, 16, 17, 18, 19, 23, 24, 25,36, 48, 52, 53, 55, 121, 388, 420, 559, 563, 566, 590, 614,699, 720, 723, 727, 749, 762, 767, 772: n = A,T,C or G
tnggcnnnnngnnngnnnntttnnntatacagtacngaagctctttgnaatnncnctttttgcaggatcccatcgattcgaattcggcacgagatatgctgaggtcctggcctccagtacnttagaatgtgactgtatttggagatggagatacagccttcaaagaggtgagtaagttaaactgaggttgttaagatgggcccgcaaccaatctcaccggcatccttagaagaaaaggagttggagacacagagagagaggctagacacaggcacacgtgaagggacggtcaggggaagcggcagcgagagggtgctgtctacagccacagagaggcccctgaggagaccaacgctgccggcaccatgatactggactgacttaccgnctccagaactgtcgaaaagacatttctgttgnttaacaaaatagcagtctgtagtacttcgttctggcagcccaagcagactaatgtatagggcattagattgggcgtaagtaaaatataaaggaacttaagtattgaatagtgcaggtgctgtgaggagggatacattgngttntgntattggtcatacagagctagctgntacctgaggcttcacaatgtaggntctactctaatgctgctgcttaaaaaaccccaggccgggcatggggtggctcacgcctgtaatcccagcactttaggaagccgangcgggcggatcacgaggtcanganggcnagatcaacctggccaacatggngaaaccctgtctntactnaaaanac

SEQ ID NO: 4573 - DNA, 779 bp, Homo sapiens
  misc_feature 11, 12, 13, 14, 15, 16, 17, 18, 19, 20, 22, 23, 24, 27, 32,33, 48, 129, 134, 137, 145, 155, 159, 177, 180, 199, 202,206, 207, 210, 214, 225, 232, 257, 268, 274, 312, 317, 360,615, 624, 632, 662, 771, 779: n = A,T,C or G
taatgcttggnnnnnnnnnngnnnttnaaacnnagtttcaaatcgctnggctatcgcctttctgcagatcccatcgattcgcgaggccagttccaggcccactttttgccctgtgagccccctgcattnctggnttntccttttncaggctgctnctcngtggagcttctctatttnacntctactactgtatccatgnctntagnnggncctntcagtgatgtngcttatntccccaatgacactgatgggagctncttaagaacangctgtntacggacaaggatgtgaagtggtacaagggaaaagtangccgnttaggacctgtgggtgtgtcatgactgtgcttgtatctcttgntagctttgtggccttaggttcaatgctgaccctttctgaggctcaagtttccttatctttaaaataggtattaaaggaagtaatccggtccatacctgagcctgggtatgccctcctcccggacgttcctgttttctgatcgtcttcagcacagacatgagtaaagtgacaatgaccagtcctgtgacttactgagggcaaggtgttccaattcagattgtatactgataattacacagggaaataagagaaganacaagttanaagcctgnagattatagatgtttttgaagaatacattnttttgcattaataaatgtgaccagtttttaaaaagttttcagtattagaggaaatagccacccccatactacttctactactgcaattactatttagcaatttttattntttctttn

SEQ ID NO: 4574 - DNA, 757 bp, Homo sapiens
  misc_feature 2, 3, 7, 8, 11, 16, 25, 27, 29, 134, 178, 202, 625, 657: n = A,T,C or G
gnntttnnatnccccncttgcaaancntnggctacttgttctttttgcaggacccatcgattcgaattcggcacgagccggacagagagcgcaggagccgcggtaccccggcttcgtgctggggctggatgtgnggcagttctgtgatccgctgccacgtctatgaccgggcggcgcngggtctgcgggttccagcgtgcanaaggtagaaaatctttatcctcaaattggctgggtagaaattgatcctgatgttctttggattcaatttgttgccgtaataaaagaagcagtcaaagctgcaggaatacagatgaatcaaattgttggtcttggcatttcaacacagagagcaacttttattacgtggaacaagaaaacaggaaatcattttcacaactttataagttggcaagacttaagagctgttgaacttgtaaaatcttggaataattctcttcttatgaagtagagacagggtttcatcatgttggtcaggttggtcttgaactcctagcctcacgtgatccgccacctcagcctccaaaatgctggtattacaggttcatgcatccaggagcatatgcaagatactgaacagttccgcactacaaagatctcttgngttggtcttctgtaactatatctaccactctnctatacacctcctaccctctctcattcctagctcctggcaaccactaatctgtcctccatttaaaaaatgttctaatttgaaaaatgtatattcatagga

SEQ ID NO: 4575 - DNA, 798 bp, Homo sapiens
  misc_feature 3, 4, 5, 8, 9, 30, 41, 609, 637, 640, 651, 719, 721, 722,724, 725, 727, 728, 731, 745, 755, 761, 765, 767, 775, 776,794, 797, 798: n = A,T,C or G
ggnnnttnnattccccccctttgcaaatcnataggctactngttctttttgcaggaatcccatcgattcgtgtacatgttccagtgggatgggaagcagcagagaccaacagagtctgaagaagcaagcttctgagttatgaaagcctgggttcaggagactaacctatatgtaggttcctaggaaagtccagttaaagggcctactttgccactgctgcctccttcttaatgctgaacctcatctcccacaagggggcagtctcagcaggtgtcagctgagccatgtgtcatctgtccaggctaactgcccacacatccttctgcaaagggtacctcttggttatcagtgctcactgatccctatataatcagactctaatccctgtaaaaagattacttggtgctagccaagctagcacctttgggtcttcccaaacatacaccactaatccagactctaataacttcatttcctttaaattacaagatcagagctgaaataggccttagaaagctagtctgggctgggcgcaatggctcaagggaggcggaggttgcagtgagccaaagactgcgccactgcactccagcctgggcaacagagcangacttcatcttgcaaaaaaataaattanatnaattaaaaatntgaacctatatgggatttaacctcttcttctcaattaaaagttattttaaaaaaaatggcaaaaaaanannanngnnaanaaaaaaaaacttcngacccttttnaaactnttangnggggtccnnatttaccggtagaatccnagnn

SEQ ID NO: 4576 - DNA, 766 bp, Homo sapiens
  misc_feature 3, 4, 5, 9, 12, 13, 16, 18, 19, 31, 48, 82, 739, 765: n = A,T,C or G
ggnnntttnaannccntnnttgcaaatcgcnaggctactcgttctttntgcaggatcccatcgattcgaattcggcacgagnaatcaatatttttcaatagaagtattagaggttttttttattgatataaaaataacaattacagatcctgatatatagaagttattcaaaattatacagttttcaaaaaatcaagacaagtaggcccaatacaaactactgaatcatcttctaatttccctctaaaatatttatagaaatatgtaagtagaaaaacattcatcctttcctcgtctaattatgatcctgccatattccaggcacaagagaaagctctggggcttgagtcttaatagggctgatagtccaaccaggggacagggtatcataaagagataattcaaaactttaagattggagggtaggtgatggtagaaaattctgcggcaaacatttgttgatgctcatcatttgttgatgtcatcaaagatcaccagggcataattataatcaaaattagttttattgatgcttgctgcagcaagagagactgcacaccactggggtctatgggtgcttctcagtgggaaggtgtaaggaggggcttgctaagaatttgagcacatgtagctaattttaaggagggctcaagtgagccaagggtttcttctggattgagtgctgtccagaaagtggattgagtgctgcagaaagtgggagtgattttgcactggggancttaatttttatgttgtgggtgggang

SEQ ID NO: 4577 - DNA, 737 bp, Homo sapiens
  misc_feature 6, 7: n = A,T,C or G
aaatcnncagctacttgttctttttgcaggatcccatcgattcgaattcggcacgagggaaaactgctaaattaaaatactacattttacggaaactgtggagctgcctccttgatagaatgttaggtctgtttttgttgtcttctgcctatgtctcttgacttgtagtttcttttgtttcaaatcactctgccctcgtatatactttggttagactacttttggtgaagcactctccaatagaagaacataatgtggtgtcaattgtgtagggatcgcccaagcgttgtctagcatttctgctccccagcagaagccattttatccagccagagttgtccttcacagttctagcatagtctaaactcattttctcattgttcatattctttctctcccacccactctgtcttccctggcaattcaagttaaattccatctctcttctttgagttgctcccctgaagtaagatttctgtttcttctggcattttacctctaaatttatcaataacatgtttattctgctgttcttaatgtcgtgtgtgtgtgtgtgtgtgtgtgtgtgtgagtgattttaatcttctcttgaatttagaagatgagaatttagtctttctcctttccccattcctacattactcctaaattgaatctttaatataaaatcatttattttagtttccagtgtcatcataattttaccttttttctactcaggactataattcccagca

SEQ ID NO: 4578 - DNA, 743 bp, Homo sapiens
  misc_feature 6, 7, 8, 17, 62, 66, 67, 69, 76, 86, 90, 91, 95, 102, 105,118, 157, 165, 176, 177, 180, 196, 197, 198, 207, 218, 223,231, 256, 257, 273, 283, 287, 296, 301, 315, 327, 333, 343,357, 363, 365, 376, 387, 394, 396, 405, 412, 420, 422: n = A,T,C or G
  misc_feature 429, 431, 432, 438, 442, 446, 449, 450, 451, 455, 469, 505,515, 523, 536, 561, 588, 597, 603, 604, 606, 613, 614, 622,626, 627, 640, 643, 647, 661, 664, 678, 691, 701, 732, 734: n = A,T,C or G
aaatcnnnaggctactngttctttttgcaggatcccatcgattcgaattcggcacgagggtnaatnntngtttganatcatgcccngatnngacntcaagcnatnaaggaactgcctnaatttgccactggagaaaatcttcctcgagtggcagatntactaacncagcttttgcnnacnggtaagggatattatnnntaccttttnctctaaatatntatcntctttctnaaatgttgactctggatttaggttnnaaatggggtgcagganagctggaggncctncctctgatngagantaaatcccctactntcattcagacgntaaagngaaatgattnctggttatctaatncctggngntgttttggatntaataccctcntgaaggngnaatgactanattcttntgggcatntnagatgtntnntaattnttcncccnatnnnctgnagtatcataatcgnagcatcttaatgaaagttttcaggcatgccagatcnggatctcaancttacaangaacacgtatctntgtgggcttgagggaatggcttagntgataagcatcctgtcaatgtaacctngataaactnagtagnntnacgttgnnaaactgangcanntgatattcaaatnagnaacntattcattgtgccnctntttctttactccanatgactcttgcanaattgaaccnagtggacaacgccctattaagggtgtcccananggatgccaa

SEQ ID NO: 4579 - DNA, 743 bp, Homo sapiens
  misc_feature 2, 4, 10: n = A,T,C or G
ananctacangctacttgttctttttgcaggatcccatcgattcgaattcggcacgaggctcagtgttgtaattccctattctagcactctcaaaagtaccccatctgttacacatgcagaaactgcagcagcatctgaaatgtccacttcttgattcattctgaactcccttaagcccagtgtttgttagttctcgttcaagtctaggaactctgccgagtaacaggtatctcaattttgccatcctttctttctgcatagacaggagtgttcttaaatcttctcctgtaaagcaagtcatctctgatttccctgaggatcattgctcccgtatactgttgttggggtgagccttctggtagaggggaagagaatttggtactagggttgatagtcaagttactaaggttctttatcaacatctcagagcagaagttttgagaggcccctgaatcgtcctgggaattttcttcagtgagcatttttgaagactgggaccagggttggattaaacttttgtgatgggtccattgtgtctcaacacaacactgagcttctcctggatctttgaaacccagcagaaactgttgctggactctcaaattgccacaaggtagaccagaaagagcctgaaaacccgaactccaaccatctttttctttcctttttaatgcagacatggtgttgctatgttgcagtgagcccgagatcgcaccactacactccacctggcgacagagcg

SEQ ID NO: 4580 - DNA, 748 bp, Homo sapiens
  misc_feature 9, 688, 745: n = A,T,C or G
aaatcgctnggctactcgttctttttgcaggatcccatcgattcgaattcggcacgaggtaagcaatgtgggaaagccttcagatctgcctcaatccttcaaatgcatgctgggactcaccctgaagagaagccctacgagtgtaagcaatgtgggaaagccttcagatctgccccacaccttcgaatccatggtagaactcacactggagagaaaccctatgagtgtaaggaatgtgggaaagccttcagatctgccaagaaccttcgaattcatgaaaggacacaaacacacgtaagaatgcactctgtagaaagaccttataaatgtaagatatgtgggaaaggcttttattctgccaagtcatttcaaatacatgaaaaatcttacactggagagaaaccctatgagtgtaagcaatgtgggaaagcctttatttctttcacttcttttcgataacatgaaaggactcacactggagagaaaccctatgagtgtaagcaatgtggaaaaaccttcagatctacctcacaccttcgaaaacatggtaggactcacactggatagaaaccaaagcaggtgaatcacctgaggtcaggagttcaagactggcctgatcaatatgatgaaacccctgtctcttctaaaactacaaaaatttggccaggcgtggtggcctggcttctgnaatcctagctagttgggaaggctggcacaggagaatcgcttggatcttggggggcanagg

SEQ ID NO: 4581 - DNA, 768 bp, Homo sapiens
  misc_feature 3, 4, 12, 16, 17, 24, 26, 723, 724, 725, 726, 727, 728, 729,747, 751, 765: n = A,T,C or G
ggnntttcaaanccgnnttcaaancnagctcttgttctttttgcaggatccctcgattcgaattcggcacgaggttttttaaagaacttgataaatttaccttaaaatttaaataaagtatactgaataactaagtcaacttagaaaaaaaaaagtgttatctaagacaagttacaaagccatcaccaaagcccatgatccggcagacgactacaagcatagggtcagatccatctataaatgagagcctgacatacttcatctatagcaaacatgggagacaaatcagtggtaaaatgatacagtgtttgggaagtgttatttgaaagatgggcttatttaatgtatacagatgaactcaattcctctgtaatagaaacttgttctccagagagattatagatctaaatgcaatgaagaaaataccactataaatttagtactctttattgtaattatccccaatggttatttttactttctcacttcttagatgattttccaagtttgtctagtatctgagttaaaacaaaatttttaactttcttataaaacatagcgtgcccccattttagttcattttctacatagaaataaataaaacacttagataacagttcagaaatagttaattaaatatatcccagattccccacgatctggaaaaattatatcttcaaaatacttctgtctggtggatatgtgtcttctaaaaaaaaaaannnnnnnaaaaaaaaaaacttcggncctntagaactttagggngtc

SEQ ID NO: 4582 - DNA, 770 bp, Homo sapiens
  misc_feature 2, 3, 4, 5, 6, 7, 8, 9, 10, 14, 15, 16, 17, 18, 25, 37, 39,664, 702, 703, 704, 705, 706, 707, 708, 709, 710, 711, 712,713, 714, 715, 716, 717, 718, 719, 720, 721, 731, 745, 747,752, 755, 769, 770: n = A,T,C or G
gnnnnnnnnntttnnnnntttgaanccctttgctctngntctttttgcaggatcccatcgattcgtgacgagcgactgtagacgttgccagcatgtattgatcaggagcagcctgtgagtcaagactgacaacagatcaataaatggcttttaaaaagcaaaacccctcaagctgtttatctaggaagcctgacaaaccctgcccgcagtggtgtggccccatgtgtccccagggcctggggcccacctctgccccagaagtcctcttagtgtctgtagacaggtcccatttccaccaggtcaaccagggctgtggcagtggacctggatggcaggcagagcagaggaccgctgttctatttgttgaagcaacgaggcacagtgactgttctagcacagctggctgtgagaaatggcgatgatggatccactttagatccgaagtcttagcaaactcaggcctcttttccacagagaatgttgtgaagacctgggaatgagctgttgatgtgcatttttaggatgacagcataatggagaaaattggaagtagcatatgccaaagtatgaagtgttcacacagctcccttgggttggtgatttatgggaagcttttttctcctttatacttttatctactttctaaatctgtcaatatgcttgngtcttctatgaacaagaaagaaaagtttaaaaaaaaannnnnnnnnnnnnnnnnnnnaaaaaaactngagcctttaaactntnggggncgnttacctaaatccann

SEQ ID NO: 4583 - DNA, 783 bp, Homo sapiens
  misc_feature 3, 4, 5, 6, 7, 8, 9, 10, 11, 12, 15, 21, 23, 32, 35, 40,42, 48, 71, 76, 81, 95, 100, 101, 102, 104, 105, 107, 121,126, 129, 136, 142, 143, 144, 147, 154, 157, 164, 165, 170,174, 176, 191, 194, 197, 198, 207, 221, 225, 227, 228: n = A,T,C or G
  misc_feature 230, 234, 238, 244, 251, 260, 266, 267, 273, 274, 278, 279,285, 287, 293, 297, 303, 305, 310, 318, 322, 324, 328, 331,336, 345, 346, 349, 350, 352, 355, 358, 362, 365, 371, 374,375, 400, 405, 411, 412, 429, 442, 443, 447, 451, 452: n = A,T,C or G
  misc_feature 460, 464, 478, 479, 482, 492, 499, 500, 504, 507, 509, 514,524, 527, 529, 539, 540, 541, 542, 555, 563, 566, 570, 574,576, 580, 587, 593, 594, 595, 598, 606, 612, 617, 618, 619,620, 621, 622, 626, 629, 638, 641, 642, 654, 655, 659: n = A,T,C or G
  misc_feature 660, 670, 671, 672, 673, 677, 680, 686, 689, 690, 691, 692,700, 703, 707, 708, 718, 734, 740, 746, 747, 748, 751, 752,753, 754, 755, 763, 772, 773: n = A,T,C or G
ggnnnnnnnnnnttngggcananggaaacccntangcaancnactganagaacccttgggaaggaccccancgaancgaangcggcacgagacanacagnnnannanttacacaccggggntgggngangaataangaggannnaangagcccnctnccgaggnngcccnaagncngcagaagacaaaganccnggnnccaggccangaaaggactgaagnaaananngnaaanaagnacagcngaccctngaacaacanggaggnnaggggnncagnngaaaancngcatgnaagnggaccngngcagnccaaaccngagngnaacngcngaatnaaaggggcnnccnncngcncanaganagnacccanatnnacaaacatgctagagaaaagcaacnggggnaaaacnngcccccactagagaaanggacaggagggannaagncacnnggaaaganaganagcagaactaagcnnggnaaaagcccangaaaggnngganacnanaaagnagccaaaacnacncnagcaaagcannnnaaggcagaaaacnggggcaanagnaacnaacncngggngccaccnaaaaannncanaacagggnaagaancacannnnnnacancangcaaaccanccnnacagagggagcnnaccnngggaagagcnnnnaaanggnacaggncannnnagaagagnaanaccnncaggcaaaangggacccaagggacanagaaanacaaannnggnnnnncacacacngaaaaaaanngaagcaaaac

SEQ ID NO: 4584 - DNA, 756 bp, Homo sapiens
  misc_feature 6, 643, 652, 702: n = A,T,C or G
ttatanatacagctcttgttctttttgcaggatcccatcgattcgttttaacagtgtgcctttggggagggacccatgtccatggcttcgttgagggccatccatatgccagctgggggccagcccacagtggccatattggctgcagcaggaatggtgcccacctcggcgaattgaagggctaagagtcccagatagctaggccagagctggaagcagacagtaaggggaagagctgctcccacaggagagggagagattccagctcactgcgcagcctgggaggaggcgtggatcctggcacgctgagcctcaggcaccagcctccctgtgctcgacagcaaagtcttgactccttcctgctgagcactgtgctaccttcactgctccaaagccagactaacagctctccaagcccttggggtgactcggcttccaggagctgttggagaaatgaggatgtctgtccctgtctgcctgggcaggccagattcctccccagcagccgggtctctccagaccctgattcggtgcctttctgtttaccagctacttcaatcccaaagtttgaatctgcagataccttactcccagccactttgccttcttactgtgttgtgtgtttttcctggtgcttcaagancgtgtgcanggcaaagtgcccgtcactgggaactgcaccagatgctcagacttggttgncttatgtttaccaataaataaaagtagactttttctaaaaaaaaaaaaaaaaaa

SEQ ID NO: 4585 - DNA, 741 bp, Homo sapiens
  misc_feature 2, 166, 168, 173, 174, 175, 180, 182, 185, 190, 192, 193,196, 198, 200, 202, 209, 222, 224, 226, 227, 228, 229, 232,237, 243, 245, 247, 250, 254, 255, 257, 262, 264, 265, 267,269, 270, 272, 273, 275, 276, 277, 280, 281, 287, 293: n = A,T,C or G
  misc_feature 294, 300, 302, 303, 304, 309, 310, 315, 317, 318, 319, 322,324, 326, 327, 330, 332, 333, 335, 338, 339, 341, 345, 347,348, 349, 351, 352, 353, 355, 357, 358, 360, 362, 366, 369,372, 376, 380, 381, 383, 387, 389, 394, 397, 398, 400: n = A,T,C or G
  misc_feature 401, 402, 403, 404, 406, 409, 411, 412, 413, 414, 415, 417,418, 420, 421, 424, 426, 428, 434, 435, 437, 438, 443, 446,448, 449, 450, 454, 455, 456, 457, 459, 461, 469, 471, 477,480, 483, 484, 485, 488, 489, 491, 498, 499, 501, 502: n = A,T,C or G
  misc_feature 504, 505, 506, 509, 516, 518, 519, 521, 523, 525, 526, 528,530, 532, 534, 535, 536, 537, 539, 541, 544, 547, 550, 551,552, 555, 558, 559, 560, 561, 562, 564, 566, 567, 570, 571,572, 573, 576, 578, 579, 582, 583, 584, 586, 588, 589: n = A,T,C or G
  misc_feature 593, 594, 595, 596, 597, 598, 599, 600, 601, 602, 603, 604,606, 607, 608, 612, 613, 614, 615, 616, 617, 618, 619, 621,622, 623, 625, 628, 629, 630, 631, 633, 634, 635, 637, 638,639, 640, 641, 642, 643, 644, 645, 646, 647, 650, 651: n = A,T,C or G
  misc_feature 654, 656, 658, 659, 660, 661, 662, 665, 666, 667, 668, 674,675, 677, 678, 679, 680, 682, 683, 684, 685, 686, 687, 688,689, 690, 694, 695, 696, 697, 698, 699, 700, 702, 705, 706,707, 708, 711, 712, 714, 715, 716, 717, 718, 719, 721: n = A,T,C or G
tnaatatacagctcttgttctttttgcaggatccctcgattcgaattcggcacgagactctctctacaactgacagagtaaatagacaaaaaatgtatgggggatatggaatattttatcaacacaagtaaaaagcttgatctaacaggtgggtgggccattctancnaccannngaccngnatntaaancnnatnangntncatccanattcattgttgcntntnnnntantgatntctgtntnanttntcanntntacantnnancnntnntnnnacnnaacagncactannaggtcnannnagctnnaattnannnctntnannccntnncntcnntnattntnnntnnntntnncnanactnttncantatnatanngnatcntntactnttnntnnnnnantancnnnnnanngnnttntntntactanngnncctanttnannnatcnnnntntntacatctntnctactnatnatnnncanntnatatatnntnntnnnatnaaaggantnntntncnnantncntnnnnananatnctnatnnnccntannnnntnannttnnnnaanannatnnnancnnttannnnnnnnnnnnannnttannnnnnnntnnntnttnnnntnnntnnnnnnnnnnnaannggnanannnnnttnnnncaattnntnnnnannnnnnnnnttannnnnnnantannnnatnntnnnnnnantnannaantttnannttnan

SEQ ID NO: 4586 - DNA, 745 bp, Homo sapiens
  misc_feature 523, 585, 694, 723, 727: n = A,T,C or G
atacagctcttgttctttttgcaggatcccatcgattcgaattcggcacgaggaccacctacggaaaactgaggcccacataagctcgattggttgtacctccaacagatatttattaagcacctactaaatactgagcccattgcaagcaccagggaagcctctgtgaacagcacaaggtccctgctctggagattctgcttcagtggtggagacagaaaataaacagtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgnctttgccattattctcggggctttcatagcagctgggtctgaccttgcttttaacttagaangctatatttttggattcctgaatgatatcttcacagcagcaaatggagtttataccaaacagaaaatggccccaaggactagggaaatacgggtacttttctacaatgnctgcttcatgaatatccaactcttattantagngcttcactggagaactgc

SEQ ID NO: 4587 - DNA, 754 bp, Homo sapiens
  misc_feature 2, 639, 664, 744: n = A,T,C or G
tnagatcagctcttgttctttttgcaggatccctcgattcggtacaactcttaaagctttctacattttacatatacagtcatctctcagcatcccgaggaagattggttccaggatgggctcaaggtcctgatataaaattgcgtagtatttgtatataacctatgtacatcttctcgtattctttaatctctagattacttataatacctgatactatgtagatgctatgtaaataattgttatactgtattattttcaaattgttttattgctatttttattgcttttccctgaaatatttttaatccacagtaggcggatgcagaacctctttatacggagggtcgactgtgtaggagtgagctagtttcagttaaagcagcggtggttggtactcatctctcacctgcccccacgtagtgtagctagggcatcagggagtactgatctctggcatcatctgggatcaacaggattttcctgcctcacaggcctgtgagcacattagaaatacacctgctcagctcaagtcaaagtgagaagcttttgaatggagtgataaccgagtaggcagtatctaaataaagatgattggttcaagtctcagtggacaaatgtgtaccgttctattactgntgactgtgactttgaagtatatggngttcattaagcaaatccaatctgatcgtatgaaaagagcaccccaaaaaccaaaatgaaaccatttatcaggacttttgnagctatgaaa

SEQ ID NO: 4588 - DNA, 752 bp, Homo sapiens
  misc_feature 2, 611, 709, 710, 711, 712, 713, 732: n = A,T,C or G
tnagatcagctcttgttctttttgcaggatcccatcgattcgaattcggcacgagctttctctggcagtgattcctgaagggaaaatcatgaacaacacctactaccaggaatgcctcttctacctgcacaactatagcaccaacctggccatcatcagcttctacgtgaggcacagctgcctgcgggaagctcttctgcaccttctcaacaaggtgggacatggacacagctcaaaaaggcagtgcctgccttactcctctggcttggaccactcagccttaagcgggacaataaccccctgacacttaaccctgtgttgagctatggggccatctctagcagagtcaagtcaaaacaggggactctgcacaactgttattcagtgagtgtgaaaagtcttagcctagatcccaaatcactgccctcaccagcaaaggcatgtttcattccttctgccaaaacatgcagcagaatcggatagtggttaagagcatgtctctggaatgagatgctcagtgtgagtcttgtgtggccttgggcatattgcttagagtctgcttccacgcgcctccctacctggcctgggatggtgtccagcttctgacccanctgctggtccattcagagttgttactacaagggccaggaagtaaccatggtgcaaatcctatagttgaaccccaaatagatgatgaaagaagaaaaannnnnaaaaaaaaactcgagcctntaaaactatagtgagtcgtt

SEQ ID NO: 4589 - DNA, 770 bp, Homo sapiens
  misc_feature 2, 3, 4, 5, 6, 7, 8, 9, 10, 13, 15, 16, 17, 19, 27, 31, 35,117, 639, 648, 670, 761, 769, 770: n = A,T,C or G
gnnnnnnnnnttngnnntntgaagccnttantganttcccttttttgcaggatcccatcgattcgcagcatccacatgacaggcggcgccgaagggatcctgcccctgactttcatnagctgttgaaccatctggaattcacaggcctgtcatgagagacacgatgagaagtccttaaaggtagatcactgattcacaggggagcaggcggaggcaagggtgagtcagtgcttggaactcagtcatccagatttggctctggaaacttctgaagctgtagcctttggggatccctgactgcgagtacaggaagccaacgctatgtggtcttctggaaactcattatctttttcactggtgctatctgggaaaaacagatgaaaacctgaaggtgttctgtatgtgtgctttcaaaagcaaggatctggccggacgcagtggctcaggcctgtaatcccagcactttgggaggccgaggcaggaggatcacctgaggtcaggagtttgagaccagcttggccaacatggcgaaaccatctctactaaaagtcaaaaattatctgggtgtggtggtgggcacctgtaatcacagctactcaagtagctgaggcagaagaatcagttgaacccaggaggcanaggttgcantgagcagagatcacaccactgnacttcaacctgggtgacaagaatgaaactccgtctcaaaaaaaaaaaaaaaaaaactcgacctttaaactatagtgagtcgtattacgtanatccagann

SEQ ID NO: 4590 - DNA, 776 bp, Homo sapiens
  misc_feature 2, 3, 4, 5, 8, 9, 10, 11, 12, 13, 14, 15, 17, 18, 19, 24,30, 31, 700, 767: n = A,T,C or G
gnnnnttnnnnnnnncnnntttcnaatagnnagctacttgttctttttgcagggatcccatcgattcgaattcggcacgaggctatgtgttctgactttgttgattcaaataagtaagctaaatcaatttaagccattaataggtttataaagttatttgctatgtgttgttcttacatcattgattcatgtaagtagacttgtgtgacagctaattcttaaaaaattatgaagatgttagacttcttttgatatatatatgttgattgtatgaacagattgacatcaatatacttattcattataaaagatttgagtgggaactcaccaaatcccacaccaaaaaaatttaaaattttaccatagtaaaaaaaactaaaaagcaagatgaaattatacatagttcttggtgtagtatttttaatttttattatttatttttatagaaatggggtctcaccattttgccaggctgttctcaaactcctggcctcaggtgatccgcctgcctcgacctcccaaagagccaggattataggcatgagctaccatgcccggctagtgtagtatttttaaattttacttaatgctgagccattttcaaataacctcatcacattgattatgacctcatgcaagaaccatctggtctatctttcagtgtagttgtctttaatatcttagaactattgcattctgnccttttttgggaatggtttatgcttttacagtcttaaccattgcttcttaatatcactttccgcggnacaactggg

SEQ ID NO: 4591 - DNA, 960 bp, Homo sapiens
  misc_feature 3, 4, 5, 6, 7, 9, 10, 11, 12, 13, 14, 15, 16, 17, 18, 19,20, 21, 22, 23, 24, 25, 26, 27, 28, 30, 31, 32, 33, 35,36, 37, 38, 39, 41, 42, 45, 46, 47, 48, 52, 53, 55, 56,57, 58, 59, 62, 63, 64, 65, 66, 67, 68, 69, 70, 71, 72,73, 74: n = A,T,C or G
  misc_feature 75, 76, 77, 78, 79, 80, 81, 82, 83, 84, 85, 86, 89, 90, 91,92, 93, 94, 96, 97, 98, 99, 100, 101, 102, 104, 108, 109,111, 112, 113, 114, 116, 118, 119, 120, 121, 122, 123, 124,125, 127, 128, 130, 131, 133, 135, 137, 138, 140, 144: n = A,T,C or G
  misc_feature 156, 170, 179, 180, 195, 208, 212, 219, 228, 247, 250, 268,273, 281, 302, 327, 330, 335, 342, 351, 352, 403, 411, 413,417, 419, 428, 438, 443, 447, 458, 470, 472, 477, 487, 492,494, 497, 498, 499, 500, 503, 504, 508, 509, 510, 513: n = A,T,C or G
  misc_feature 528, 533, 610, 623, 625, 629, 636, 642, 662, 665, 670, 671,672, 677, 679, 688, 691, 695, 701, 707, 708, 719, 726, 727,739, 744, 765, 769, 778, 783, 797, 802, 820, 838, 842, 853,854, 858, 876, 879, 881, 883, 888, 892, 899, 900, 902: n = A,T,C or G
  misc_feature 906, 920, 921, 922, 936, 943, 955, 959, 960: n = A,T,C or G
tannnnncnnnnnnnnnnnnnnnnnnnnannnncnnnnncnnacnnnnaggnncnnnnntcnnnnnnnnnnnnnnnnnnnnnnnnntcnnnnnntnnnnnnnangtanntnnnntntnnnnnnnnannanngngngnnantttnccaaaatacccnagttttctaaaatnccttgggcnnaatccgcatctcgcngcaaggcgacccntcgnattccgnaattcggcnacgaggggcaaggagtatngantttcattcaggaattttnttcangcaatttnatcaatcttattcttgaattntattcaccaataatggctcgccatngangagtntaaagtnaggaaacanngctatccttattcacattttgcaaagttcctccatgggctactatgatgantaatcaangncaangnggaggtaanaagtgaactnggganactngttgaccaccncactcaatcccncngatantggcaccatntactnanggnnnnacnnatcnnnatnacattaagaggatgnttacncctgatatgttgactggcttgttggaaggacctatagctggaacatgcttccattgccaagaaaggagctacaggtnaagagacactagntnaccntatgatngccggnttccagcctggcataatggnganttgcnnntgacntnaatagcatntcntgcnacaatngaactnncaagatagaanaagcaanngcaagggaatcnttgcntgctttaacccttactcatcnaaanggcctctcntactncaaagaatttacanatccngcttaccatttatcaacnccaatgctgcttaccgtnggtnaaccacccaannttgnctttaaaataaccacaangtntncnaaaangccnaaactcnnancctntagaactataagtnnntcaagatccctatnatccatncttgataaatanacgnn

SEQ ID NO: 4592 - DNA, 758 bp, Homo sapiens
  misc_feature 3, 4, 5, 9, 10, 11, 14, 684, 685, 686, 687, 688, 689: n = A,T,C or G
ttnnnaatnnncantctcttgttctttttgcagggatcccatcgattcgaattcggcacgaggtgacacagagacagagaaacctcccccacccagggaagcagctctgcagagttggcaggatcaggggctagtctgaacccctagcacagaacactcacctcacggaagagtggccagaatgttttccacataggtcctggtcctcacttctcctcactgagcagggctgcccaacgtgggacttctgcacaaccatcctgcccctgcctgaccacttcaatcagaggcagcctggcagttaaaggaacacccacacacagaggtgaaaaagaaccaattcaagaactccagcaacacaaatgaccagaatgtcttatgtccttcaaatgattacactacttctccaacaaggttcttaatcaagttgagttggctaaaatgacagaaatagaattcagaatatggataggaacacagatgaccaagattcaggagaatggcaaaacccaatccaaggaaactaagaataataataaaatgatacagaagcagaaagacaaaatagcctatataaaaaataatataactgatctgatagagatgaaaaaccaagctgaggaaagaatcttggaactggaagactggctctgtgaaataagacaggaaaaaaaaaaaaagaannnnnnaaaaaaaaaactcgagcctttagaactatagtgagtcgtatacgtagatccagacatgataagatcctt

SEQ ID NO: 4593 - DNA, 771 bp, Homo sapiens
  misc_feature 2, 3, 4, 7, 8, 9, 10, 11, 12, 14, 15, 16, 17: n = A,T,C or G
gnnnttnnnnnngnnnntttaaaatacagctcttgttctttttgcaggatcccatcgattcgctgtagtcctattttgccatatgacatgattgaaatcaacacctcttagaaatagttttgctgcctcataattgattaccatcatgataacctgtagtcagtgtgaaatagagataaaaattaatgtacttagttaaatgcatatgaaggtctaatcttgttccagagttactcttactggattatttttagatttttattaacattactggtctctaactttactcagtctggataagaaaaagaataccatgcaattgttaactatttgatgtttactagattaactattaatatattgttgtggtccatatttaagagttactttgttactagagatttcattatagtggtgtttaatatagttttgggtatttttaactaaaaatcattgttatccttcaactgtagattctactatgaaatgaggaaaaatcagcaatagaattaattgggttcaaagtatataaataatgatgtgggaaagggaagtcagagggtatctctggaagaactgatttatctgaaggtaatactgagtgaaagaacctaagattgtagacaaagcatgctttatgcaattttgctggtcatagtagtagtagaggctctataaatgtgttgggtgtttttggttttaaagagacagtgtctcgctatattgccccaggagtttaaagctgcagtgccctgtggttgcacctgtgaa

SEQ ID NO: 4594 - DNA, 766 bp, Homo sapiens
  misc_feature 3, 4, 5, 11, 17, 18, 734, 741, 746, 751, 762: n = A,T,C or G
tgnnngtttcnaatagnnagctcttgttctttttgcagggatcccatcgattcgaattcggcacgaggtgaattcctcagcaccaagttgtttaacacagaagagaggtggaaacaaaaaatgcttggtttttactggctttcttttagcatttctgtctagtcgaaatgggggccaggcttgcacacatagacaactgaattaatgtaaccggacctattccatctaggctgacctcttgaaagataggaggggaagtctaaaacaggagaaaagttttagaaatcctttggattaggcttacccagattagtggtatgtaaaatattatgatattcttagtgtttcaggattatggattttagtaaaagcagaaaaaaataaattcttgtttaactgaatctataatggcaccagtggtttggaaacatttctgagttacttgattttatgtgaaaaaatctggaataacttttccttttttcctttagaccatttttcttttatttaacctaatccgagccactttataccaatttcaacaatatttctgaattcctgtgatcttttatttcctttttgctgctttcagctgtgtttctctccactctaagctcattaaagttaaaaaaaaaataggagattggacccatttttttttctgaggagtgtggccgtttaacaccctgtggtggctcaggatattttaagtagtattttcagctttctagaantggttgncttanttagnaaatagttatnggaa

SEQ ID NO: 4595 - DNA, 771 bp, Homo sapiens
  misc_feature 6, 11, 12, 13, 14, 18, 39, 61, 216, 581, 688, 713, 739: n = A,T,C or G
aggctncttgnnnnctantgaagcctttgctactagctnagctcttgttctttttgcaggnacccatcgattcgaattcggcacgaggcatagttggaagttaaggttgaaaagagagataggggaaaacaggtggaataatattgaaaattggatcaagaatataggtgtaggcgttagccattttatcctgggagaagggaggaaatgaaatanaaacaggaatagatagacgttttgaggcgaaaggaatgaatccagcatgctctgtttagtgatgtagatgagatcacctgggaaggcatgaatgggcgggcagagtggggtagtgacttcagaagagtaataagggttgaaaagcactgctgggtgagggggaaggaatgtccataacctgactccagcttcctttagaataattaacacacgttacactccttatttaaacagagatcccaagatcagataaatccataattacttatttgttgtacccacaaaatactataggggtctgcttactttctcttgaaagcatccccttggtaattattcttttatgtttctctaattgcatgctngagaaagcatctgttagatgcaactagtctttagaccctgaacacctgcagatcttgttgatgcatgcccaagttcagaaagctctgaaagaagttgctttaaagangataggccatggcttttcagatacngaccttgaatctgtagtggttcctangtttccaatcctaacattacccacttggtaag

SEQ ID NO: 4596 - DNA, 747 bp, Homo sapiens; identical to SEQ ID NO: 4402
  misc_feature 4, 5, 8, 9, 28, 91, 606, 698, 742: n = A,T,C or G

SEQ ID NO: 4597 - DNA, 683 bp, Homo sapiens
  misc_feature 60, 395, 409, 432, 460, 540, 558, 583, 599, 645, 650, 669,680, 682, 683: n = A,T,C or G
ggatgaacatggcatcatatgattagaaaaccaaaattcatttttgatggctgttgtggncagatcgtgtcctctaaaatttatgtgctggaaacttaatttctagtgttaacagtgccgagaggtaggggctttgggaaagtttaatggattaatgcccacatataagggcttgttggagggaatttgggctctttgttgccccttccatcctttctaccatgtgaggacgccacactcctcccctttggaagatgcagcaaacaaggtgccatcttggaagcaaagactaagctcttaccacacatcgaacctgttggtgccctgatcttggactcccagcctacagaactgtgaggaagttaagtttctgttatttataaaattaccaagtntcaggtattgtgtnatagcaccataaatggactaaanacaatgccaaaggtggcacttgccatanaactgctgccgatgatatcaactctttgctttccagagttaaagctttggattctgatggggttgattctcttttgtgtnggacccttgtactggttnctattataatagttcttttctaatntttaagccgggccccnatggctcatgcctttaatcccagcactttggggaaggccaaggccnggccnattcaccaggtccaggagntcaagaccatncnn

SEQ ID NO: 4598 - DNA, 752 bp, Homo sapiens
  misc_feature 17, 644, 681, 684, 700, 702: n = A,T,C or G
tcagctcttgttctttntgcaggatcccatcgattcggctgcacagtgggaagggcactgggctggaagccctacccatgtcagggaatgtctgggcctcagatttttattttctagaatgaagatacttaccccccaattgctgagatatttgaataaaagtatatgtgaaggattttgtaattatagaatgtcctacaaatatgagtagttcgtttgctacttttttggcgaagaaaaatattgggatgcatgaataatatctacctaaggtacctaaggttgtattcatcccatttattgaatgccaaggatataccagctactgctccagatgttgtattcagggaacagaagaagagtccctgtgcccatggagctaacagcattctaggggaggaaagatgggtcagctgactttcacgatctcaggtactgatgaagattgtgaagattattacatcaggtgaatgtaggggtgatttagagaaagctggtagctaggctgttcaaggaagggcctctgtgagaaaggggatggttggctgggtgtggtggttcacgcctataatcccagcactttgggaggttgggagtttgagaccacctgccagcatggagaaaccccgtctctactaaaaatncaaaattagcccggcatggtggcacatgcctgtaatncangctacctgggaggctnangccgggagaattgcttgaaccccgggaggcaaaggttgtaattgagccct

SEQ ID NO: 4599 - DNA, 760 bp, Homo sapiens
  misc_feature 1, 6, 22, 37, 672, 678, 697, 725, 755: n = A,T,C or G
naatancagctcttgttctttntgcaggatccctctnttcgaattcggcacgagtatcacagtttgtaaacgggtgtttttgtccttgttattgaagtatacaactctgcttagccaaacataccaagcaacagacagaagcgtcacttggagagaagaagaaagggttaactggcagagctactgtaaaagaaggatagaggagggtaagtttgaaagtggccatgggcaagaattttctccagatagctcttgattataatctctctcacctggattatttcccatctcctgacagtttgttctcacataactatcagcagtcctctcaacacagaatcagaccatgtctctcctctgctccaaccctctgaggctctccatctccctctggataacaccctgcatgacctggccctcctatcccactgctcctcaccgcgctcattccaactctcctgttctccttgctatttttcatatgggccaagcaagcacgtgcctcacaacttgtgctcttggcgtctgtctgcctgaaactttcttgcctcaggtagtctcatggtttatgccctctcctctttcaagacttggttcaagtgtcaccatctctgtgaggccttctcagatcacctagtcctgacacatactagccttctttcctactttctncactgnactcatcatctgctaatgngctactggttgcatattgcatttaatgnctgtcccgttggtcatgctggtttgggggnggggg

SEQ ID NO: 4600 - DNA, 756 bp, Homo sapiens
  misc_feature 3, 5, 8, 26, 40, 42, 46, 582, 675, 710, 711, 713, 721, 726: n = A,T,C or G
ttncnaanatcagctcttgttctttntgcggatccctttntncganttcggcacgagggaatgtcaggcctctgagcccaagccaagccatcgcatcccctgtgacttgcatgtatacgctcagatgggcctgaagtaactgaagaatcacaaaagaagtgaaaaggccctgccccgcttaactgatgacattccaccattgtgatttgttcctgccccaccttaactgagtgattaaccctgtgaatttccttctcctggctcagaagctcccccactgagcaccttgtgacccccgccctgcccaccagagaacaaccccctttgactaattttccattaccttcccaaatcctataagatggccccacccttatctcccttcgctgactctcttttcggactcagcccacctgcacccaggtgaaataaatagctttattgctcacacaaaaaaaaaaaaaaaaaaaaggataacaacctgcttggcaagtttgaactcacaggcatacctcctgcaccccgaggtgttcctcagattgaagtcacttttgacattgatgccaatggtatcctcaatgnctctgctgtggacaagagtacgggaaaagagaacaagattctatcactaatgacaagggccgttgacaaggaagacattgaacgtatggccangaagctgagaagtccaaagctgaagatgagaagcnnanggacaagngtatncaagaattacttggtctatgcttcaaaaga

SEQ ID NO: 4601 - DNA, 763 bp, Homo sapiens
  misc_feature 2, 3, 5, 6, 655, 704, 733: n = A,T,C or G
tnnannatcagctcttgttctttttgcggatccctctattcgctcagaaccactctgtcgtttttaagcagggtcacacactctagctcactgggtccattttaatttctattaaacattttttttttttgcaaatgatgtagtaggagatccaaggtgtttggttaatgatttattcactcattagtcattccacaaacttgtcttgagcacctgttatgtacccagcactgtgctggaatgctgaggagacaggagtgaagtaaaaagacatggttccggcaggaaacaggcaaggagagccttgacttgacggagtctggctatatcgccaggctggaatgcaatggcgcgatctctcctcactgcaacctccgcctcccgggttcaagcgattctcctgcctcagcacctcgagtagctgggactacaggcgcgcgccaccacgcccagatgagaaaactgaggcacagagaggtgaaataagtgagatgctacctacctatgcagagctggaaaagattttgcaacctgaaaacccaatcctttctgagatataaaagaacagaagagtctggaagtgatttcttcggagaaattcattttcttattccagagaagaaacttcaagctcagaatattggctactacctgngataaacatttaaattattgggaaccagagagtttttatactaaattgnaaagaacaatttttttatcaaagaccaancccgaaattcttgaccctcctgggatttca

SEQ ID NO: 4602 - DNA, 806 bp, Homo sapiens
  misc_feature 16, 39, 64, 101, 119, 124, 126, 137, 138, 139, 148, 149,150, 166, 167, 191, 192, 204, 205, 208, 214, 217, 230, 238,248, 249, 253, 257, 258, 259, 268, 277, 283, 313, 315, 324,332, 338, 339, 356, 357, 358, 359, 364, 394, 451, 457: n = A,T,C or G
  misc_feature 481, 488, 506, 512, 526, 538, 553, 570, 575, 576, 585, 589,598, 617, 619, 622, 623, 627, 632, 633, 635, 645, 649, 656,667, 670, 671, 675, 679, 686, 687, 692, 697, 699, 703, 707,711, 713, 714, 715, 717, 718, 722, 724, 726, 729, 732: n = A,T,C or G
  misc_feature 738, 742, 746, 752, 755, 758, 761, 770, 777, 781, 793, 796,801, 804: n = A,T,C or G
ttgaagccctgctctngttcttttgcaggatcccttttncgcttcggcacgaggtgtaggcccncatcgtccctcattactcgggtttcatattttgctgnttttgatggacatggaangaatncnagcctcaaaannngctgaacannnttggcatcaaaatttnntcagaaaatttcctaaaggagatnnaatcaagggccnnaanaccgcnaanagatgcctcttgnacactaancaagcatctnntgangagnnncttaaacangcttccagncagaancctgcctggaaagatgggtccactgccacntntgttctggntgtggacnccattnnttatattgccaacctcnnnnatagncgggcaaacttgtgtcgttataatgagganagtcagaaacatgcagccttaagcctcagcaaagagcataatccaactcagtatgangagcgntatgaggatacattaaggctggangaaacgntagggatgggcgtgttgncgggcngtgctatagggttnactctgcatagnggacgtcagaccagnactttcgatttaccctntgatnngccgacatnaganttctgcccngctgacacccaattgacangnttnntttncattnncnttgtatatanggcncttaaanggatttcctcntcnngatnatancctattnnccctnatacntnggtntatnctantnnntnntgcntnanttntcncttganctanctcntaaacnttnggnaantctttttanctctctngtangtcttattctcntantattnccncc

SEQ ID NO: 4603 - DNA, 802 bp, Homo sapiens
  misc_feature 11, 26, 41, 42, 177, 181, 231, 308, 350, 376, 401, 421, 434,436, 446, 486, 493, 498, 501, 535, 585, 590, 595, 627, 652,654, 673, 683, 689, 712, 722, 726, 742, 745, 746, 753, 763,766, 777, 781, 782, 783, 786, 787: n = A,T,C or G
ttcaaatcccnagcttctaagttctnttgcaggatcccatnnattcgaattcggcacgaggcttcgtgtgctactgcgaaggggaggaaagcggtgagggggaccgcggcggcttcaacctctacgtgaccgacgccgcggagctttggagcacctgcttcacgccggacagcctgncggncctcgtgggtaactgggcgggtctgggagccgtcacacccctccttgcantgcagatcgtctatggggcgacagacatctgggattccccagaaggctctgacaccctctgcccgccctgtagctgnagtcctcccattggctagggctcttggggtcgggcaggtttngggtgcccccagtgggcctcgggttncaggcagctcgtgacaagcccctgngctctctagaaagcccgttntggcctgagtgcngntgaggacatnaccccccggttcaggtgagacccaacagggaggaaggacngatgggnaggangangggtctgccacagctctcccgtaccttttctatnccagggcagcctgtgagcagcaagcctgtggctctgacttctgcacgaangacanaagcnattccttgacgcttttcaaggggggccctaancacttggcctttggacctcttcaangntaccaggccccaataggcnagcccccaangctgangggccgctttacactggggcctnggcaaaaacncgtnttggaaccttgtaacnggnnaactggnaagcttcacnaanaagacaatttnttannnccnngggaaaaagcccccc

SEQ ID NO: 4604 - DNA, 772 bp, Homo sapiens
  misc_feature 2, 3, 4, 8, 10, 11, 14, 102, 649, 650, 651, 652, 653, 654,655, 658, 659, 660, 661, 678, 690, 710, 724, 748, 763: n = A,T,C or G
gnnntttnanntancagtttgaaacccttggcggaccctcgattcgaattcggcacgaggtgtttcttctacctcccctgcacaacattgtttatatgcttnctaaaatgtaacttctttagattctgttgttacgtgcaacactgtatatctctccatagcacttaatcagagtttgtaattaggcatctttttgtgtgattatttggtaaatgtccatatcccctactagcctataagctccatgacttctaggtaccctgtctgactacgtgtatcactgtttctaccgcctaacattgcctagcacattcattgcttcacaggcatctgaatatggttttataaaatacattgctctagtgcacaggattttaagctaaggatttcatgaatgggatttggggtaggggcatctatgaaattcctgaaattgtgtagaattttgagaatatgtgttttcctggggatagagtatgtagtttctcagcaactcattacagtctgtcacatcatgccctaattctacttgcctgtagctaaacacctaataacattagaactgaaatgatagtgatatgcaagatagcacgtgtggtttccacatattctaagaggcatcttcaattagattccaaaaaaaaaaaannnnnnnaannnnaaaaaaactcgagcctntaaaactatagngagtccgattcgtagatccngacatgataagaancattgatgaagtttggacaaaccncaacttggaatgccntggaaaaaa

SEQ ID NO: 4605 - DNA, 771 bp, Homo sapiens
  misc_feature 8, 655, 675, 699, 714, 727, 729: n = A,T,C or G
tttaagancagctcttgttctttttgcggatccatcgattcgaattcggcacgagcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccttccctaaaccatcccgtagtcttctaatacagtctctcagacaaagtgtctctagatggatgtgaactncttaactcatcaagtaaggnggtacttcaagccatgctggcctncttacatcctttttnggaacagagcacngnataaataattaacttaataataatatgcccaaaaaaaaaaaa

SEQ ID NO: 4606 - DNA, 764 bp, Homo sapiens
  misc_feature 6, 8, 626, 757: n = A,T,C or G
cagctntngttctttttgcggatccctcgattcgggagagaaaccttatggatgcattgactgtggcaaggccttcagccagaagtcttgccttgtagcacatcagagatatcatacaggaaagactccctttgtatgtcctgaatgtgggcaaccctgttcacagaagtcaggactcattagacatcagaaaattcactcaggagagaaaccctataaatgcagtgactgtgggaaagccttccttacaaagacaatgctcattgtacatcacagaactcacacgggagagagaccctatggctgtgatgagtgtgagaaagcttacttctatatgtcttgccttgttaaacataagagaatacactcaagggagaaacggggggattcagtgaaggtggaaaatccttccacagcaagtcacagcttaagtcctagtgaacatgtgcaggggaaaagccctgttaatatggtaactgtggcaatggtggcagggcagtgtgagtttgcccacatcctgcattcatgataaacagtttgctgtttgatcatatagcctccaacggaatgctgagtttgtcatgtcccatgggccctttggctccctgcactaatatgtatagtangggtttacaagatatgaaaatatattttactttttttatatcttataaacctcactaccccttccacaatattggttttcatttactatcttgacatagagtttggcttggggaagggggcagttttaaangcttccc

SEQ ID NO: 4607 - DNA, 764 bp, Homo sapiens; identical to SEQ ID NO: 4606
  misc_feature 6, 8, 626, 757: n = A,T,C or G

SEQ ID NO: 4608 - DNA, 802 bp, Homo sapiens
  misc_feature 14, 512, 673, 711, 721, 739, 768, 769, 775, 778, 786, 799,800: n = A,T,C or G
ttctaatgcttggntctcgatctttggtcaggatccctcgattcgctgagaaaatcatagagatcctggagagcgggcatttgcggaagctggaccatatcagtgagagcgtgcctgtcttggagctcttctccaacatctggggagctgggaccaagactgcccagatgtggtaccaacagggcttccgaagtctggaagacatccgcagccaggcctccctgacaacccagcaggccatcggcctgaagcattacagtgacttcctggaacgtatgcccagggaggaggctacagagattgagcagacagtccagaaagcagcccaggcctttaactccgggctgctgtgtgtggcatgtggttcataccgacggggaaaggcgacctgtggtgatgtcgacgtgctcatcactcacccagatggctggtcccaccggggtatcttcagccgcctccttgacagtcttcggcaggaagggttcctcacaagatgactttggtgagcccanaggagaatggtcagcaacagaagtcttgggggtgtgcccggcttccaaggccatggcggcggaaccgggcgcctggacatcatcgtggtgccctataagcgagttttcctgtgccctgctctaacttacccggcttttgacacttcaaccgcttccatgcnaaccccttgcccaaaaaccaaagggccttgaagttttntcatgaacantgcccttcaaccacttgntgtgggtcccgggaacaacccatgggatnnaaaggnggnggccttgncccaaattgcttnncc

SEQ ID NO: 4609 - DNA, 744 bp, Homo sapiens
  misc_feature 110, 177, 192, 517, 581, 697, 720, 731, 744: n = A,T,C or G
atacagctcttgttctttttgcaggatccctcgattcgaattcggcacgaggcatatgcttgtctcaaagattaagccatgcatgtctaagtacgcagggcctgagtctntgccctcgtgggcgttgagtgacactgattctcgcgtgtctccggcctctccggcagggagtcctancgcagactttgcggntcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttataagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctgcaacttncagcgagagaatgaagccctgcggtgcggacagggcgccagcctgacccgtggtgaacagaacnccgacgtggccctgcagaacctccgggtggtcatgaacagtgcacagctttcatcaagcactggtttccggagctgagacctgaatcttgttgccaaatccttaaatctattgacngaatttctgaagttaaagaccangaggaagactnttgaggccctggn

SEQ ID NO: 4610 - DNA, 746 bp, Homo sapiens
  misc_feature 18, 20, 540, 551, 634, 642, 646, 671, 678, 680, 688, 716,734: n = A,T,C or G
atcagtttcttgcctttntncaggatccctcgattcgaattcggcacgaggtttccctggcttaccgtgatgacgcatttgctgagtggtctgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgnttggtgacatncgacagggcatcttctatgccatgcttctggccttctggatcatcttctgtggcgagcacatgatggatcagcacgaaccggnaccacatngcanggtattggaagccaagtcggcccantgccgtngntcttctgnctttcatatttgacatgtgttaaaaaangggtccaacttacgaatnccttttacagtt

SEQ ID NO: 4611 - DNA, 749 bp, Homo sapiens
  misc_feature 2, 715, 727: n = A,T,C or G
tnagatacagctcttgttctttttgcaggatccctcgattcgaattcggcacgaggttttatttataaaacaaaaatttatatttgcacaggaggagaattagcaggatgtaaaataaaaatgaaagaccccaatggggagaatattttaaatgtcttgcagggagtggaagaaagctttgcttaaaaatgtcaccatatgctaactatatacagcacttcaagtttatttattgttaaagcctcatgtaaatcacgtcattctgaaaatcatggaaactgcacatttgtgcattaaactatgtaaacaacaaaaactggtcatccgtccaattgttgcttcacttattttgaattatagtgcaattttgtggagggtgaaatggggattacacaatatagcgatttcctgttaacacctacatttttgctgatcaagcaaggtctgttggtgcgagagcttaacctttattttatttccaaatgtgttttttattccgagtcccgttggtgtctatggtttcacttttctccatgagccacatgttaaagcctgccctgactaaatgaaggagtgtaagcagtgggatagacattgcaggcaggcgaaactgggataagccccagaatcttttgaacctatcagtaatattactaacaggggagaaagtataaaagtgagcccttcaagtgctctagtgtacatgtcagaattnaagcacgagttncacgggatggctcacccccttc

SEQ ID NO: 4612 - DNA, 759 bp, Homo sapiens
  misc_feature 6, 8, 9, 23, 227, 440, 630, 638, 644, 666, 674, 690, 703,713, 715, 728, 735, 741, 759: n = A,T,C or G
caaatncnngctctcgttctttntgcaggatccctcgattcgaattcggcacgagggctgcagtgagctgtgatcgtgccactgcactccatcctgggtggcagagtgaggccctgtctcaaaataaataatccagtcccccccaagaaagggaatgaagtgctataatgagaaaaatcctagtacctaacatatagtagacagtggagagtggttctctttcgttnctcaggggcagacagattgggtgctggagtcctctatcaaagagtcagagctctatcccagatgtgtaatgaacgtggtcacagacatattgtccattaccatttaccttccctataaccactgtgcctccagccttgtagaatagacacataggagcgcagcaatacgtctaaaaataggagtgagagagggcagggcatgcccgttcttgnggtagaagaaaagaatgtcaaagaaagcagctgggactaatgaactttacattagccatattccattatttcagcttaagtcaaatgtcggtcctcatgaggcaactggctttgacaggagctacgctaattaccacttaccaacctttaatttctgggtaaaagcaaaagacaaaaactaatggatttntcattttncacagngacaagaattaaataatagtangtctgtcnaaaaaaaacaaaattnaaactcgagcctntagaactttngngagtcgtattacnttagatncagacntgatacgataccatggan

SEQ ID NO: 4613 - DNA, 754 bp, Homo sapiens
  misc_feature 5, 22, 86, 122, 134, 143, 169, 207, 208, 215, 216, 223, 233,234, 235, 236, 237, 244, 247, 248, 253, 256, 257, 264, 270,271, 273, 282, 286, 287, 289, 290, 301, 303, 304, 308, 312,317, 321, 327, 331, 337, 338, 347, 350, 357, 358: n = A,T,C or G
  misc_feature 359, 361, 362, 369, 371, 387, 394, 402, 409, 413, 414, 415,418, 439, 452, 476, 479, 483, 488, 508, 516, 530, 539, 545,551, 562, 565, 567, 577, 583, 589, 592, 600, 609, 614, 626,631, 640, 642, 645, 670, 679, 681, 693, 702, 704, 705: n = A,T,C or G
  misc_feature 716, 733, 737: n = A,T,C or G
ttgcnaatgctaggctactcgntctttttgcaggatcccatcgattcgaattcggcacgaggagccaccatgcctggcccatcgtntcatttgatccttgcaacaccctatgagaatatccngatcgaacgatntcacagatnatccatagtgatactcagctaacggntggtctgccaagacttgaacccaccattcttgttactnncttgatnnctttaanactggttatnnnnngccagtntgnnatggngcnnaaaatangatgtnngntttttggangtannanntgctacaggcntnnactntatnatctnagcnatagcnagtncaagtnngactgattnagnatacacnnngnngtgttantngctaaaatattgaaanaactttnattctggntggagcncgtnnngtntcccaaatatgaacaaccaanatctgaaatgctncaaagctggaaacttttagagtgnttntgantgccngccaacatgacatgcaaganaaacattnatttggagcatttnggattgtgnatattnagattngggatgctcantangnattaatgcanatattncaaaanccncgccttcngacccagcngaaanaaaaaccaaaancccanaatacttgngntcnccaagcattcatgaaaaaaatgatncttaacctngnaaatagctttgncccaacccncnnaagtttctttntctacttccctggccantttnaacattaggaaccccct

SEQ ID NO: 4614 - DNA, 752 bp, Homo sapiens; identical to SEQ ID NO: 4598
  misc_feature 17, 644, 681, 684, 700, 702: n = A,T,C or G

SEQ ID NO: 4615 - DNA, 761 bp, Homo sapiens
  misc_feature 6, 11, 13, 748: n = A,T,C or G
taaagnatcangntcttgttctttttgcaggatcccatcgattcgctggaccgggtcttggtgctttccagctcagggcgttggtccacttggttattcttggggaccaaaatccaagctaggatggggacagaggcctggagacaacctgctggcctccttccattaaagccattacagtgtcaccacaggattgtaagaattacaaatgcgttttccagagtccccagagaaaaaggagtctggcagttagaagagtaaagtgcatctgtcaacaaaagaaataccaaagatgagactacagcagcgacttgtcacctcttccgtgttgctactgcctgagaacagaggtttttagtttctttaaagggttgtaaacataaaaacaaagaaggatacaacatgcaaggcctaaaatgtttactttctggccttttacacaggcagttcgccagccccctaccctacagtatggaaaaaaggcatagaacagtcaaatcacgtaggatttcttggtttctccatgcaggctcatcgaatagcaaccatcctttcttagtttcttgaaacaagtaccttatttacattcagagaattatatgtggacaaacagctcataagcccgtacttttacatactcacttcctgaattgcatattgaaaaagagagttcatgtaaagcccgattattatttaatctaaagttatgttcacataggaagcactatgtagagaaatagggtctganggacaaggagcct

SEQ ID NO: 4616 - DNA, 761 bp, Homo sapiens; identical to SEQ ID NO: 4615
  misc_feature 6, 11, 13, 748: n = A,T,C or G

SEQ ID NO: 4617 - DNA, 834 bp, Homo sapiens
  misc_feature 3, 4, 5, 6, 10, 11, 12, 17, 19, 21, 22, 24, 25, 26, 28, 35,36, 39, 42, 51, 112, 114, 646, 657, 673, 681, 701, 706,731, 738, 753, 800, 817: n = A,T,C or G
ggnnnntttnnnatttngncnnannnanaactctnnagnaanccctttgtncaggcatcccatcgattcgaattcggcacgagcagcctgcggccaggctttttatttaatntnaatagtttttgtttgcctccgtggtttggtcaccgtgtgcatcgcaccgtgctgtaaatgtggcagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgcctacccaccttcaggcagcctatgggacgcagggccccatctgtccctcggtcgcccgtgtggccagantggggtcccgncgtccccaacactcgngcttcggnttcagaacacttttgggcanggaangtcttgggggcccttaaccaagcanggaaccnccgtgccaaagcccngggcaaggccgggtcccaaccttaggaaccccaacaagccccctttnggggaagccaacccccnaaacctttttggggggg

SEQ ID NO: 4618 - DNA, 787 bp, Homo sapiens
  misc_feature 2, 3, 4, 36, 39, 43, 306, 329, 362, 438, 449, 576, 578, 590,667, 702, 715, 737, 751, 754, 755, 781, 786: n = A,T,C or G
gnnnttttaaatacccagctttcaaatccttgttcncgncttncgcaggatccctcgattcgaattccgttgctgtcggtgatgagattctgatggaagagattaaggattacaaggcacgcttgacctgtccgtgctgtaacatgcgtaaaaaggatgctgttcttactaagtgttttcatgtcttctgctttgagtgtgtgaagacacgctatgacacccgccagcgcaaatgtcccaagtgtaatgctgcttttggtgccaatgattttcatcgcatctacattggttgatctaagtcaaganaagaagaggagctggctagtcangaacttattcattaaccaccaaacctctacctnttctctccttgactgtcacctgtaggacagtttatcagtcaactacctttcctccagactttacttccaggctctnctcttcagtanctggatgactttagcagaaaggactggtaaatacaagccttgggtttcagaatgaattagaaacaaataactcttactgtcttccctcccagctttgtttattttgtgcttttagacttttcagtgntntcttttttcagnccactgtataaacttggattgtccattcctcctgaagaaatcaagttgggtatttttgatgtggaaaagggaacaanaagtggaaacatggctactttttggggagtggatnttttaaaaaaatnaggttggctatgggcaccaaanttttctacatttgngtnncaaacttcttgtgaaatgtgggattncaaant

SEQ ID NO: 4619 - DNA, 743 bp, Homo sapiens
  misc_feature 3, 4, 5, 6, 7, 8, 9, 10, 650, 685, 691, 703, 738: n = A,T,C or G
ttnnnnnnnncagctacttgttctttttgcaggatcccatcgattcgaattcggcacgaggctgggtgtggtggcttatgcctgtaatccaaacactttgggaggccaagaagggaggatcacttgagcccaagaatttgagaccagcctgggtaacttagtgagaccctgtttctaaaaataaatagacagatgatagatagtcagatagagagagagagagagatgatatagatatagatagatagatagaatgttctctaccccaagggtggagaaagacttgagcaaagacacagaggccacatggattaaaaggaggaggagaagccctgtgtttgcagggatgaatggcctatgctctggggaggtgggctgtgccctcagcagcatccacatctaatgcaggacaacaccatcgacttcctggagtacgtggcagctctgaatctcgtgctgaggggcaccctggagcacaagctgaagtggacattcaagatctatgataaggatggcaatggctgcatcgacccgcctggagctctcaacattgtggagggaatttaccagctgaagaaagcctgccgcgagagctacaaactgagcaaggccagctgctcacacccgaggaggtcctggacaggatcttnctcctggtggatgagaatggagatggccactgctnttgacnaattggtgaagngcccctcgggccaagtgggtgatgaaaatcttccnatggc

SEQ ID NO: 4620 - DNA, 730 bp, Homo sapiens
  misc_feature 92, 93, 468, 506, 554, 574, 629, 646, 647, 660, 674, 707: n = A,T,C or G
atcagctcttgttctttttgcaggatcccatcgattcgggagggcaggagagtgaccaagcagctagaagagagggtgcagcaccccaaggnnaggactgggggagtgggtgttccaggaagggctctggcatgtaaagctgcacagaagtcaaatcagataaagcctgagagggatccatgggatttcttggcaaagggattgttggtgataccaggaagagcagcttcagtggctcatggggagagaagccagattacaggagatcagcaactgagagagtgagtggagagcatcttttaagaatgtcttgagtgcgggccggctgcggtggctcacgcctgtaatctcagcactttgggaggccgaggcgggcgaatcacgaggtcaggagttcgagaccagcctggccaacatggtgaaacccgtctctactaaaattacaacaattagctgggcacggcgcantggtgcgtgcctgtaatcccagctctcgggaggctgangcaggagaatcacttagaccagggagtcggaagttgcagtgagctganattgcgccactgcacttcanactggtgacagaactagactctgtcaaaaaaaaaaaaaaaaaaaactcgagcctntagaactatatgagtcnnattcctagatccngacatgataagatncattgatagtttggacaaccacacttgaatgcntgaaaaaatctttatttggaaat

SEQ ID NO: 4621 - DNA, 769 bp, Homo sapiens
  misc_feature 3, 4, 5, 6, 7, 8, 9, 10, 11, 16, 17, 18, 20, 41, 109, 120,635, 638, 688, 703, 716, 719, 743, 754, 761: n = A,T,C or G
ggnnnnnnnnnttttnnncnatggaaacttttgctattgcnctttttgcaggatcccatcgattcgaattcggcacgaggccaccaccaccaccagccccacaaaattnacctcaaggcntacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcaggcccggctaactctggcaccccggatcgaggacaagtgagagagcaagtgggggtcgagactttggggagacggtgttgcagagacgcaagggagaagaaatccataacacccccaccccaacacccccaagacagcagtcttcttcacccgctgcagccgttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttggtggtggtggtggtctccattgctgntgntgcaaggaaagtcttacttaaaaaaaaaaaaattttgtgagtgactcggngtaaaaccatgtagntttaacagaaccnganggttgtctatggttaaaaagcctntagaactatgngagtcgnattacgta

SEQ ID NO: 4622 - DNA, 743 bp, Homo sapiens
  misc_feature 1, 4, 6, 7, 651, 652, 653, 654, 655, 656, 657, 658, 659,660, 661, 662, 663, 664, 665, 666, 667, 668, 669, 670, 671,672, 673, 674, 675, 676, 677, 678, 679, 680, 681, 682, 683,684, 685, 686, 687, 688, 689, 690, 691, 692, 693, 694: n = A,T,C or G
  misc_feature 729, 730, 731, 737, 738, 742: n = A,T,C or G
naanannagctcttgttctttttgcaggatcccatcgattcgcccacctcggcttcccaaagtactgggattacagacgtgagccaccgcacctggcctaaatttcaccatcgtttctattcataacttacctgcaaagtgattatctgactagtactactgcaacaaagataataaagtgcctgatgtttatatcaaataggatatggcatgtttctgagtgtttctaaagaaaaatactgaatgaacccctcgcctaacctagtgcctgtggtaacaataactgacatgcattgagcgcttactgtgtgccaggtgcttgttcgaggtactttaccggtattaactctttaattcgcataacccttctgtgagatgggtaacattatacccattttacagatgaggaatctgaggcctggagatatcaaatcatgtgcccaaggccacaaagccaacatgtggtagaactgagactcgaatctaggcagtttgttccaatttttgtgctttgaacctgtgcacaatatgactattgctattttgtgatattatttgagatttctcttttaattattcttgatatctttggggcagaaaaacaatgaataataatgttatgaatattaaagcccctcaaaaaaaaaaaannnnnnnnnnnnnnnnnnnnnnnnnnnnnnnnnnnnnnnnnnnnaaaaaaaaaacctggcctttaaaattttggggggnnntttccnnaaanc

SEQ ID NO: 4623 - DNA, 748 bp, Homo sapiens
  misc_feature 3, 70, 80, 113, 131, 208, 209, 241, 273, 274, 297, 326, 350,354, 403, 438, 440, 455, 459, 471, 491, 498, 507, 510, 559,563, 583, 604, 614, 617, 618, 634, 639, 641, 650, 670, 673,681, 700, 703, 712, 714, 724, 739, 748: n = A,T,C or G
ttntatatcagctcttgttctttttgcaggatccctcgattcgaattcggcacgaggatataatggccangaggaatcanaaacctgacgttagaaaggctcaacgagaacangctatcagggctgctaangaagcaaaaaaggctaagcaagcatctaaaaagactgcaatggctgctgctaaggcacctacaaaggcagcacctanncaaaagattgtgaagcctgtgaaagtttcagnctacaggtggacaatgaggaggaggaaagccnnggacaggttgaagggcggcttgncccatccactgtggtcctggaccacacangcggctttgaggggcttctcctgntggntgatgacctgctgggggtgattggacacagcaactttggcaccatccgntctaccacatgcgtgttcaaagggaaatggctctncnaggtcctcatctctnccangggctcatgcanatcggctggtgcaccatcanctgccgntttaaccangangagggggttggagatacacacaactcctatgcctatgatggcaaccgcntgcncaagtggaatgtgaccacancgaattatgcccccccatctntgctgggttncanncctgtggtcacaagtnctgcngngcctgtatnaaccagcacctgttgaacancanggacttgnttcttcttcaaaaccaccnttntgtctgtanangacttggtanaagggagccaatccnagttctacn

SEQ ID NO: 4624 - DNA, 771 bp, Homo sapiens
  misc_feature 2, 3, 4, 5, 6, 9, 10, 11, 12, 13, 14, 15, 16, 17, 18, 19,20, 25, 29, 584, 585, 586, 587, 588, 589, 590, 591, 592,593, 594, 595, 596, 597, 598, 599, 600, 601, 602, 603, 624,627, 636, 642, 644, 652, 661, 671, 701, 708, 729, 771: n = A,T,C or G
gnnnnnttnnnnnnnnnnnnttttnaatntcagctacttgttctttttgcaggatcccatcgattcgaattcggcacgagggatttctcctccttccgcgctttctgcgtgacactggctgtcagctctgggctgggctttctgggggccacacagctgctgaggcggcgggttgaggcggcccgaaaggacccagggtgctcagcctggttgtggatagcggcctgtgtggagaggagctgcttgtaggcagtgaggaggcggacagcatcaccttgggccggtatctccggcagctggcacgccatcggaacttcctgtggttcgtgagcatggacctggtgcaggtgcagtggctcacgcctgtaatcccagcacttcgggacgccaaggtggaaagaccgcttgagcccaggagttcgaggctgcaatgagttatgattgcaccactgcactccagcctgggcggcagagaaaggctccatctctaaaaaaagaagagctaagtgctgtacctaaaacatgcagtatataaactggctgaacttagaaataaactgttttcatgttatgaaaaaaaaaannnnnnnnnnnnnnnnnnnnaaaaaaaaaaactcgagcctntanaactatagngagtcntnttacgtanatccagacntgataagatncattgatgagtttggggacaaacccaactngaatgcntgaaaaaaatgctttatttgngaaaatttgggatctatgctttatttgtaccattataagctn

SEQ ID NO: 4625 - DNA, 779 bp, Homo sapiens
  misc_feature 2, 3, 4, 24, 585, 610, 626, 686, 703, 708, 718, 750: n = A,T,C or G
cnnntttcaaatcgcttgttactngttctttttgcaggatcccatcgattcgaattcggcacgaggtgaggggctgtctggcccttctgattttttgttaacgagacatggattgtggcatcaagatttagattcattcctctgtttgttggagtcattgaagccagtatatcctggacattttttaaagaggtccccattctgagaaaagacaggagttgaatgtcttattgattcttacctttctgttcgttatagacgaccagaggaaacaaatgcccgacacggattcgactcagtcataagtgtgaaccaaataggccgatctgggttctctcactgactgaagaggaagagaaataagagaggacagtgggcaaaatgtagggtgacaaccaagggttctggtttgcccagaattgccctgggttcaaccctgaagttcccatgttgtggacagccccgtggtcctagacaaacaggtcaccttagcggtaaaagcctttctcaggagtgagagctccaggggagacaaaacgggtttggttttggaacctggaggaagaaggcaaaatgagaagagtncactggcagtgagtcccggaaaggncccgccttgcaacaancgtggcatcttccggacccacttccttgctctttctcccgttagccctgcccttaatgtngggtcccagtgcaaaanccctnttgggggccngggcccgttgccctgcttaattcaattgcaancttggaccaggaaaagcccagcccagctt

SEQ ID NO: 4626 - DNA, 744 bp, Homo sapiens
  misc_feature 617, 719, 732, 733, 741: n = A,T,C or G
tacaggctacttgttctttttgcaggatcccatcgattcgaattcggcacgagcaggctcatctccaactgacctcatgatccactggcttcggcctcccaaagtgctggagtgcagtggtgtgatcatggctcactgcagccttgacctcctgggctaaagcaatttgccttcctcggcctctcaaagtgctgggattacaggtgtgagccactgcacgtggcctctttttagtttattttttccaaaattattttgaaaagtttcaaggtggaatgtagtgacaccatcacggctcaccgaagacttgacctcctgggctcaggtgatcctcccacctcagcctctcaagtagctgggactacaggtgcacaccaccacacccagctagtttttatggtttttttagagacagggtttcgccacgttgcccaggcaggtagaactcccgtactcaagtgatccgtccgcctcagcctcccaaggtgttgggattacaggtgtgagccactgcacccggcccatttcttcttagatttaacagttaacattttgctacatttgttttatgtccccatatatctggttttcccttaagctatatgaggctacattgngggtacactttacccaatattctggtatcaaccacagtgccataatcataataaaaaaatttaacattggtgcagtaaaaaaaaaaaaaaaaaactcgaggnctttagaactatnntgagtcgntta

SEQ ID NO: 4627 - DNA, 753 bp, Homo sapiens
  misc_feature 2, 684: n = A,T,C or G
anacagctcttgttctttttgcaggatcccatcgattcgcaacagaataagactccatctcaagaaaaaaaaaaggttaaagttcctgacttaatgaggaaataaaaaaattatatgctgaagttgctaagatctagcttgtgtttgtgaaattgtgaagaaagaaaaagaaattcatagtagttttatggtcacacttctgcaaaaattgcagccacagtgcatgataagtgcatagttaagatggaaaaggcattttttgagtggaagacatgaagagaaatagcttccaatgacagcattcaagttcggtactatacatggtttcaggaatctactagaggtcttggaacatatccctgtggataagaagggactactgtattgccaaccagggaagcttcagtgcttccagagaatttattagggcatcattacataggcacgattgatttgtttggctgcccacatggttgaactcagtcttcaagtcaactgataccaagttgtccaaagttccccaccctaaaccacatggttggtctttctggcatggcccggctttcaccctaagactactgggtgttgcagctgcaacctaaaatctagtaacaaagacatgcttatcaggtctgacatagattaccttccaaaagggaaagatcagacatctctttgggtaangtcaacttttttttactacattgagacaaattctatttcaaggacagagttaaggagggaatgaatttt

SEQ ID NO: 4628 - DNA, 740 bp, Homo sapiens
  misc_feature 507, 644, 688: n = A,T,C or G
tacagctacttgttctttttgcaggatccctcgattcgaattcggcacgagaccacacctggctcatttatttttattttgtctagagacagtgtctcactatgttacctgggctggtcttgaactcctggcccctaatgatctgtctatctcaatcacccaaagtgttgggattacagatatgagccactgtgcctggcctatttctgactttttttctttttgtatataagaatatatatttcgagacaaattgtggattataaatggatgcttatttatctcgactgcctttcagacctttttcccccagccaaccagtttttttcttctcaaagaagacacaggtgaaactgaaactcatctatttcttctgattgagattgtgtgggtctactccactcagcttttgcagtacatggaaagttgagataaacgcctaaagaaactagtttcagtcatagatttagtaaaaatgttattgcaaatctcttctttgaactcaangtgcttttctcagtttcttaaaccaccacccagagagatctttcatgtcctctttgccctggagatgtacattgggaacaaaaaccttaagtcagttcttcacttttttactgctttggctcttagtaattatctgntcttctattaaacaaggagaagacagattaaatttctaacagtnagggcacaaaaccaatccatttacagaattagtcttactttaccacatagga

SEQ ID NO: 4629 - DNA, 753 bp, Homo sapiens
  misc_feature 3, 4, 5, 10, 25, 604: n = A,T,C or G
tcnnntgaanacctttacaactacntgttctttttgcaggatcccatcgattcgaattcggcacgaggaaaagaaaaaaaaagaaatttaaaattctgttttagtggagtcatttgaacttaagtctaagtttataacaacactggcttccacagcacaggaggtgagcatgtgttaatatttaagattggcataactccctttaggtgcaagtgttcaggccaaaatgttcctgagcattttgattcctcctcctgctgcccatctataccaagcccagaaactgtctggaatatattttagtttcctgaatgacaccaagaagtagaacagtcttttcaaaaatgtattttaaaaataagctgaatctcaagaatctgatctatagtataatgaaaactgaaaagtgaagtagtcattgggatactctactgtctcacttaattctcacggcttccctgcaaggtgggtaaaattgttcctacagatagtcaaattgagttttacagttagaaaatgattgggctaggatttgagcccaatgtctgtcagattcctgagtttctgctacttctactaaaatatgctgcttcttgtgtgtccngtcttctgtttggggacaagcagatgatatccctaacaaaatcaatttctttattattattctcttttaccttttggttcccagcagtacaagtcccagttttgaagctcaaaagactggtatgagcatagctcatcgacgacatggtg

SEQ ID NO: 4630 - DNA, 791 bp, Homo sapiens
  misc_feature 4, 6, 7, 11, 12, 701, 709, 748, 760, 768, 773: n = A,T,C or G
tccntnngaanncccttacaagctacttgttctttttgcaggatcccatcgattcgaattcggcacgaggccaaatccttcagtggatgtgaaaggaataggagatgaattatataatccagaaacacataaacgacatactttgttttgtgggacaactgttattcagactcgtttctacactggagaactcgtcaaagccatagttgttagaacaggatttagtacttccaaaggacagcttgttcgttccatattgtatcccaaaccaactgattttaaactctacagagatgcctacttgtttctactatgtcttgtggcagttgctggcattgggtttatctacactattattaatagcattttaaatgaggtacaagttggggtcataattatcgagtctcttgatattatcacaattactgtgccccctgcacttcctgctgcaatgactgctggtattgtgtatgctcagagaagactgaaaaaaatcggtattttctgtatcagtcctcaaagaataaatatttgtggacagctcaatcttgtttgctttgacaagactggaactctaactgaagatggtttagatctttgggggattcaacgagtgggaaaatgcacgatttctttcacccagaaagaaaaatggtgtgccaatgaagatgtttgggtaaaaatccccagttttggttgcnttggtatnggcttacttggtcattcccctttcacaaaaaatttgganggggggggcccnttttgggnggatnccaccttggaatcttgaa

SEQ ID NO: 4631 - DNA, 764 bp, Homo sapiens
  misc_feature 1, 4, 11, 21, 28, 29, 598, 636, 669, 676, 687, 691, 698, 718: n = A,T,C or G
nccntttttanaccctttttnctaccgnnctttttgcaggatcccatcgattcgaattcggcacgagaaaagacttataagccctctgattgatctcctttgttgttgacttcttgatcctctttaattcaggaatcacagttagatttcttagaatccttctttgtgctccaagtatcaaagaccttatggggctccccagccataatggaaaaagtaatttctttaacaggggagacaccagagcaagagcggagatgggggtacgagggggtcctcatttatgcagctggccagagctcctcatccaacccggggcttagtgaggtgacagatgtgatgttggccaatgtagtcttccttttctttctttttttttttctgaggcagagtctcgctctgtcacccaagctggaacgcagtggcgtgatctcagctcgctgcaacctctgtctcctgggttcaagcgattccccagcctcagcctcccagcactttgggaggctgaggtgggtggatcacttgaggtcaggggttcgagaccagcctgccaacatggtgaaactccatctctactaaaaatacaaaaactggccangtgtggtggcgtgtgcctgtaatcccactactcaggangcagaaggcaggaaaaatcactttgaaaatcangaaggcngaggttgcaantgancctgaanatggcaccactgcactgtanccttgggcaacagggcaagaactccatcaaaaaaaaaaaaaaaaat

SEQ ID NO: 4632 - DNA, 757 bp, Homo sapiens
  misc_feature 2, 5, 12, 19, 91, 120, 130, 730, 756: n = A,T,C or G
gnccnttttatnccatacngctacttgttctttttgcaggatccctcgattcgaattcggcacgagccactgctacagccttagtccaganttttctctttctcttatctaggctgttantatagcctantaaatgttccgggccctccagtctatttgtcattcaatcacttgtttcagaaatattactaggcacttattttatgccatggcacaattctaggtgctgaagacgacacagctgcgaataaaacagacatgggacctgttcttgtggagcttatactttagtgcgtagagaaactaaacagagaggtatgaaagatagtgatgggacataattctactgaaggttgggtgatcaaagaagctttgctgaagagatttgtgttgatgttggtattttctaaaaacagatgaccaatatggttaaatttggttctgagggagaaggtaacatgagatgagctcagataattagacaggggccagatcatttatatgcaaattagattatgagataacagaatggtatatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatggatggggctaagttatacccaaagctcactttacaaaatatttnctcagtcttttgcagaaaaaaccaant

SEQ ID NO: 4633 - DNA, 926 bp, Homo sapiens
  misc_feature 2, 5, 7, 13, 14, 15, 17, 21, 22, 23, 24, 25, 26, 29, 31,32, 33, 36, 39, 40, 42, 44, 45, 50, 53, 56, 57, 58, 60,66, 73, 74, 75, 80, 82, 89, 98, 101, 102, 103, 104, 106,108, 109, 111, 112, 115, 120, 123, 125, 126, 129, 133, 140,142: n = A,T,C or G
  misc_feature 145, 154, 155, 163, 171, 172, 174, 181, 183, 184, 188, 190,193, 194, 195, 223, 419, 429, 500, 531, 548, 560, 589, 603,647, 658, 673, 708, 710, 722, 725, 733, 735, 773, 791, 793,799, 800, 804, 805, 815, 817, 827, 831, 832, 842, 862: n = A,T,C or G
  misc_feature 872, 873, 876, 886, 890, 901, 905, 910, 921, 922, 925: n = A,T,C or G
tncgncncttttnnnantagnnnnnntgncnnntgnaanngntnnatgangtnctnnntnactatnatgtaannnagacntncgcttanatatatcgngcnnnnananncnngtngtatnatnannagngtgnctaattngncanaaacgcctnnactgaggnacttgtanntntttgcangnncccnangannncgaacaaatccatcttgtaatgaacggnggaaaagggccagcgagaccacacagcacatcaatgccatcaagcgggagattgatgtgaccaaggaggccctgaatttccagaagtcactacgggagaagcaaggcaagtacgaaaacaaggggctgatgatcatcgatgaggaagaattcctgctgatcctcaagctcaaagacctcaagaagcagtaccgcancgagtaccangacctgcgtgacctcatggctgatatccagtattgccagcacctagtggatcaagtgtcgccaccgcctgntcatggaattttgacatctggtacaatgagncctttgtcatccctgangacatgcagatngcactgaaagccaggcggcagcatccggncaggcattggtccntgtgaacaggattgtgtctctgggagaagatgacccaggacaanattcagccaanctgcagcagagggtngctttcctggagggcccctgattccatctgctttnanaatgccaaagtnaanatagagcntnaagcataattacttgaaaaccattgatgggccttcagngggccccatagaaaaatnanaacctnnttgnncagttccttnanggaaaaagancagnnactcctaccntacttggtagtgggagctgnttcaaccacnntgnccaaaaactngtancccccttttanttcnattgntgggaccccanncang

SEQ ID NO: 4634 - DNA, 754 bp, Homo sapiens
  misc_feature 2, 3, 4, 6, 15, 18: n = A,T,C or G
gnnncnttttgaatncanatacaagctacttgttctttttgcaggatcccatcgattcgaattcggcacgagcattagtgtaagtgcaggtaattgcttcattaggacatatgtattgaaggagggagggcaagtctatagcatggtgataaaaacaggcctcaccctctttctctacccacacagggagcatctcagcttgacttcagggatccaggagccaccagccaccctgtaaacagcccagattaatcctgggtttcagtgtcatgggaggaaggaaggatgacctagtaaagagcaacttacttactttctttggggtggtaactcattgctgaactctggatggcactggtgcgttcaaggcaatgtgattgaatcattggggattattactgaattagggagcaaagtattcttatggaagctgtatgctttctgaggctcaccaggccggatggcatgagccctatcctctgtttgagttatttgactggctttttaagggagtctccattttcattctggccatgacagatcaagaggttatattctcccatcagaccttactactttcctgtagagttgaatattattctgattttatgccatgtctgtgaatgtctttgtgtgcaccctacctagttatgcatctcctctttcaaaagcatgttaaaagatccaatagtaaatgattctgcttatatgaagctactaaagtagtcaaattcatagaaagtagaatgggtgg

SEQ ID NO: 4635 - DNA, 750 bp, Homo sapiens
  misc_feature 2, 3, 6, 15, 24: n = A,T,C or G
gnnccnttttgaatncacatacangctacttgttctttttgcaggatcccatcgattcgaattcggcacgaggttactgatggagagagcagagaagctggtgtttgcagtcccatctgtcagccttgacacccctactcctgtccagccagtgtttctcaaagcgtgctgatgagcaatgcaagatgatttcatgttatagataagaataaaaaaattgttttgtgtttaactcaaattagaaaaaggcaacaattggtatgtgcgacctgtggttttgcagatgatactgcttaggatgttggtacttaagaaaaggtcaacttttcaaaaatactattagtgacatgtggacctagtcctcctgaagaggactacattggggcaccggtaattgtttctatttgcggtactctggctgtgtggctctggccacgccactggaggcagtgtctgagcctgtgacttgagtagtagctctgtgtcatgtctgctgattctccccaaatcctgaagattcatgatgaagtgactgccggcttggtctgaactagattgaaaacaataaggatcccagaacgatagcactttacaatcctataattttggctcaaattgcctgcagttactatcttaaccctgcctgttatgttcattgagcaccaaagtttttcagtcaattcctgagtaattattctctgggattgaattatgaaatagtaaatatttccactatgcaatcaattggtg

SEQ ID NO: 4636 - DNA, 750 bp, Homo sapiens
  misc_feature 2, 4, 20, 548: n = A,T,C or G
gncnttttgattccatacanctacttgttctttttgcaggatcccatcgattcgaattcggcacgagcaagaattgctgctgctgttttttttttaattttattttttatttttaaagactttcctaccttctcattgagagagagaaagatgcccagagttaaaataggaggtgcttgggtattttgttgaacttcacaagttaaactggcgaatggcgtccatcagctgttattcagtccttgaacagagcagatatgtttgtgcgaggacaaagaagatgcctcaaagacaaagaagaagatgcctcgtcgtcccctgagctcccacacggcatctgcacatcaccagctcagcatttagcacactggattgacactgccatgttaggtgaggtgacggcatgccctagagtgaaggaatctacagcaatatgatagctaaatgccacatgaagttctggattggatcctggattgggaaaaaacatggctctaaagggcagtattgggacaattggtgaaatttaaatgtagtctatgtattangggataatgctgttatcaattatacatttccttctgttataattgtccttggtcacaccaggaaatgtccttattaggagacgcatgcagaagtcttttagggatgaggacttactgcagcttattctcaaatgtttatatataaggtgacaaaaattaagaaattggtcaatcttggtgaaaagtttatgaagagtaaagt

SEQ ID NO: 4637 - DNA, 751 bp, Homo sapiens
  misc_feature 1, 3, 5, 6, 14, 23, 657: n = A,T,C or G
ngncnntttgaatncctttacangctacttgttctttttgcaggatcccatcgattcgaattcggcacgagcctaggcgtagtcatttctttattagtccttactttatttttcaaagttacgtaataaatgtctatgtttctaagctatctttagatttgtaaaagggctaaaatgttacttttaaacatgtttggtttattcaaatttgtttataaatctctcctttgtacccctggctaccacccctccccactcctctgcctaaaactaagggaaaatcctgtctttgcccatagcttcagaatgttctgcaattttagacttttacttttaactgatcactgttaagcaagggaggaaatttaccacttctctttgtgatgtaatattgcacagtgaccctaagtggaagccttcctgtgtcctggatgtgagctctgcgctgtcagtggttggcttgtaagctctggctccaagtgttctgaggtgcaaggaaccgatcttgtgcagtagaaagagcttttggaagttggcaagtagcaaggctagttctcatacattctatgctctggccacctttttctgtggcaggaaaacaaaacaggcaaatgcacacaaactgggtacatttaactttgcctcctgagccatctnccaagccatttagctttggatggcctcaatttggaacaagggaacaaacaaaatcatgatgataacgatgatgaccccagtcgtccttactaat

SEQ ID NO: 4638 - DNA, 749 bp, Homo sapiens
  misc_feature 2, 4, 5, 10, 14: n = A,T,C or G
gncnnttganttcnatacagctacttgttctttttgcaggatcccatcgattcgaattcggcacgagattgcttctgttttaatggtaatttgtctaattgtaaaaataccgaagtagtgattccaagttagaaagtagtgatccctaagaacagttggagaaacatatggtttgttctatagctgtaagcggtaattttgaagcaattttgaaagcattctttccctttaagaaaaaaatagtttcttactgaaatgactttttaggatgtcttgaaaaacgtagtgaaattcatctagaaacttacaaggttgatgctagccatcacatgcatgctgcaatttgctgaaatgtcttgatccaggggagctaaacttttacaaaaataggtttgtttagaagtcatatcactacatgaaaaatcaccacttttgaaacttacggttaaaggcagtttctcttttaaaaatgtgctcattgattattcccacccaaatagccagaatattttgtaattacccattaccactcctaccatctgaaacgtgcatgaaaaaaatgaaaaattgacttcatctgaaaagagttgtgtcatgatatatgaaacgttttttgtaacctccaggaaggaacattgcaatttttccatttcagatcgcctttgttttgccattctctacagcagaccaaagagtgcatcaaatgtacattatttcagcatagataatgacttgaatatgagaagtaa

SEQ ID NO: 4639 - DNA, 753 bp, Homo sapiens
  misc_feature 2, 3, 4, 15, 20, 95, 741: n = A,T,C or G
gnnntttgattcccntacanactacttgttctttttgcaggatcccatcgattcgaaaaaaacaaaaattcccataaaaaaaatagatgtttctnacatgttgagcatatatggatttcatttttaatatgattgtagaaacattagatttaaagcatattgaaaaagaaaacagtatattctttaggagcttcaaaaaagggttttggtttagttcaaagggtgaaagaagatcttttattattttggtaaataacttctaaggaaacaaaccaccctcacatgcactatctcatttgtatttctgtcaattctgaaaggccagcatttggccagtattatttgaatctgtattgtattttttaaccagaagaatgaaggtttatagcttcattcttttggaagaggaggctggagaccacaggttaaatgcaggtgcatcgctcttggccggccctggcagggtcctttctccctccttttacacgcgcagacaaagcttgtggatgctcaataaggacagctgccgtttggacagagattaatcatttatttgtgaaggttttttctgccttgctttcttggtcttttttaaatcttcacattggtttgatcccaaaatgtttgtgttgtccttactcaaaactaggaaaaacaaattatgtggtaagaagctcagagccacttacttaaatctcaactagatttatttgtgagaacatctgttttctggatatttanacacttcctctt

SEQ ID NO: 4640 - DNA, 755 bp, Homo sapiens
  misc_feature 2, 3, 5, 6, 10, 14, 15, 17: n = A,T,C or G
gnncnntttnaatnncnatacaagctacttgttctttttgcaggatcccatcgattcgaattcggcacgagacagcattcgctgaccattctcctcctccacccaccaaggacaggagggctaacccaggcagagaacctacgctgagaactcaccaccagaaaaaatatctgcttttaaaagcacagtgcacaatagtactttttaaaagctaaaagagctaagtttaaagttaaagacacgtatgttctttgacacagatctcctaaaagtctgacaaaattagaagtaccagcacataaaaatagatgcccaagaatgtttattgaaaaaagctgaaaacccatgactatctcaataggacaatgacaggatacacaatggtttatcatgccctgacctgcgagcagtgaccaagaaggagggcacagatcacacagcagacagacagatgctctgaggcttacgatggggttatatcatgatgagcccattggaagttgaaaatgccgtaagtgaaaagtgcatggcaaactgggagctgctgccgctgctgctgcccacatcacaagagaagtacagtttctgaatgtctattgcttttgcaccattgtaaaaagccacaaaatcatataggtcgaaccattaagtcagagaccctctgtgcatagacttggcattggcccatgacaagtgaaaagagtaagctacagaataatattcatccattcttcatttttataaaaccacttttt

SEQ ID NO: 4641 - DNA, 745 bp, Homo sapiens
  misc_feature 4, 7, 8, 12, 27, 28, 31, 33, 89, 91, 596, 656, 678, 688: n = A,T,C or G
aggnttnntttntgactcatgcttggnntantngttctttttgcaggatcccatcgattcgaattcggcacgaggttacctggggggcntntgggacgtcaacagccagatgctgacggtgctcagagccttcccttgtcggagccggctcggggacgcagagactgcagctgccatcgaagaggagatctaccagagcctgttcctgcggggcctgtccctggtgggctggtaccacagccacccacacagcccggcgctgccatctctgcaggacatcgacgcacagatggactaccagctgcggctgcagggctccagcaatggcttccagccctgcctcgccctgctctgctccccttactattctggcaacccaggccccgagtccaagatctcgcctttctgggtgatgcctcctcccgagcaaaggcccagtgactatggcatccccatggatgtggagatggcctacgtccaggacagcttcctgaccaatgacatccttcacgagatgatgctgctggtggagttctacaagggttcccctgacctcgtgaggctccaggaaccctggaccaggagcacacctactngacaagcttaagatctccttggccagcaggacgcccaaggaccagacctgtgtcaacgtnctggaacaagtgtgccggcgtncttcaagcangggaactgacctttcaaggcaaggtgggcttcaattgtcttgaaggtccggatggct

SEQ ID NO: 4642 - DNA, 784 bp, Homo sapiens
  misc_feature 1, 6, 32, 606, 613, 645, 662, 681, 692, 702, 720, 721, 724,738, 743, 744, 745, 747, 748, 750, 764, 770: n = A,T,C or G
nggccntttttgaaaacccttttcaaactacntgttctttttgcaggatcccatcgattcggaaatccctctcctgaccacttgtcagaaatcagaaagtgtggaagaagaaaatattagttacctaaatgagagttctggggaagagtgggattcctctgaagaagaggactctatggtgcccaacttatcgcctcttgagagtcttgcctggcaggttaagtgccttttaaaatattccacaacttggaaacctttaaatcctaattcctggttgtatcatgctaaactgttggatccaagcacaccagtccatatacttcgagagataggtctaagactctcccattgttcccattgtgtccccaaactggaaccaattcctgaatggccccctctggcctcttgtggagtcccaccttttcaaaagcctcttacaagtcccagccggctctctagagatcatgccactctaaatggagcactgcaatttgccaccaaacagctaagccgaacattgagtagagccactcccatacctgaatacctaaaacagatccctaattcatgtgtttctgggtgttgctgtggctggctgactaaaanagttaangaaacaacttgtactgaccccattaacactantttatttttacattggncttccaaaagggcaggttnaacaaactccntaacttgganttccttggaaaaaaaccnnccntttggcctctgaanatctnnngnngngggctaaattgganaaaagngggtcccaaaattt

SEQ ID NO: 4643 - DNA, 750 bp, Homo sapiens
  misc_feature 3, 4, 7, 12, 691, 738: n = A,T,C or G
gcnnttnattanatcagctacttgttctttttgcaggatccctcgattcgaattcggcacgaggacaaagcaaaacatcaacattaagtcataggctaggattatacaaatgagaacccccaccttatacattacttaatataagttaactacaaagagcctctccacttacatttttatcatgcatcttacattttaatgtccttattcttttatagaaaaggtcataatacccaataaaaaagaatctgtaatatccctgatgcagcaacaattgatcacatgctttcacatgtgaccacaataggaataaaataacagcgtaaagaaatttgaaagttgtattacatcattattcactgttcaaaaatttttttcaagaaacaagtacactttcaatgaaattacaatgcttcagaaaatctcccttttaaagttatatacaaaaacagctttagttgtggattcatttttatactcaatactctgatttagtgtaatgtctgaagtgtcagtgccttattctagtgtaaattctcatatttacgtaaaatcaattttgaattaaatatttttttcatatttacatctgcaaaaatatactttagtataaactctctgatgttttctaagctatagattttgaaaaaaaaagtctttccaaattcattatatttgcaggactcttctncaatataaattccatgatgtggaataaagctggagcaactgcttcangttttcctctag

SEQ ID NO: 4644 - DNA, 742 bp, Homo sapiens
  misc_feature 13, 405, 420, 423, 473, 501, 627, 634, 645, 652, 673, 708,720, 727, 734, 739, 741, 742: n = A,T,C or G
gaaattcatacanctacttgttctttttgcaggatcccatcgattcgaattcggcacgagatctgttactacttcagaaattgctggttgatgttaggcccctcctatctgtgctctctcagctacagtttcccgtttgagcatattcattcttttttatttttgctctgaacaaaaatattagagttacaatattactatattccaggccttgctagaaactggggataaatctatgaatatggtcgcttccctggaagacctcacagtccagggaagccaaaccctgcagacatgcagtagacttagtggtctctcttaaggttgcttgttgagttttgacattggagattatgtacagacttgaatgactagttagcctcaggcacagcattctgtttggcnttggggggggggggnaantactgcctctcagcctgggcaagtcacttagagatcgcctcgtcactctnccatcctttgctgatgcctctggtctantacctctgactcagcttcgcctttagagatactcatgctttctggcaacagaggtccttcaaaccccaattcctattaaaacttccatcacttaccgcccttctttttcaaggggaccaagccagntttattncccccattttnccaggtnacttggtcccttgggcccaanaatgtggtggaaaatttttggggcaaaattccccnttttttcccttnttttttnttgggancttcnann

SEQ ID NO: 4645 - DNA, 785 bp, Homo sapiens
  misc_feature 2, 4, 20, 28, 31, 36, 39, 40, 42, 51, 55, 143, 150, 197,260, 296, 368, 389, 391, 423, 557, 582, 608, 655, 659, 665,710, 711, 712, 715, 721, 723, 724, 725, 726, 727, 728, 730,731, 738, 739, 741, 743, 744, 745, 748, 750, 751, 756: n = A,T,C or G
  misc_feature 758, 759, 764, 765, 766, 767, 771, 772, 773, 774, 775, 778: n = A,T,C or G
gntnaatttcaaagacgctnttgttctnttngatgntcnnancgactctanttcngcacgagtggcagtgggagtcgaagcgagggtctgaagttcacgactactagaaggggaggggagtggaaaggctctcagtgaaaaangtattanaattatttctgaattatcagtctctcatttgtgctttggagaagcanaaaaggcaaaaggggtctttggccatcttctgctggagcttccagggaggatgtgtctccaanagaccagatgtccgagtttgaaatcccagaacccangaggaaaagaatcacagggaggaaaagactgtccaaaggctcctggagtcttctgttctctaaccttggaangttttgaacaatatttctcanangatagccctttttttccaaccttttttttttntcatctgtccagcatgactcatcccccgggagtggttgaatgtcttgtctttcacccaagaaaggacggacttttgcattgggcttgtaaatttggcccactggttgcttaatgggaagtaaaaaaaagagtcnttgcttaccatgccggggaacctanaaattaccatcactggcgtttttttngcttttggttcttcaatggggttggtagggttattgaaattatttantttnccaaanaaataaaaaaatgggatttttaaaaaaaatttttcatcccccggnnnaantttttngnnnnnngnnttggaanngncnnngcncnntattnannctttnnnntttnnnnnccnttttttt

SEQ ID NO: 4646 - DNA, 751 bp, Homo sapiens
  misc_feature 6, 13, 129, 234, 429, 505, 511, 527, 575, 576, 681, 716,738, 744: n = A,T,C or G
gttgantttgaanccctcttgttcttttggaaggctcccatcgattcgaattcggcacgagagatgttataaaatgtgtaggcttttaatatataagttatttgggctcctttgttttgggcatacttnaaacagaagaaaaccccttctgggggcagaaaagctagaactggatatcacagttccctctgggtgggctgctatgtgtcaattcgatctccttaaaagaaaatngtggtagcctaaaatagggtctttctttaccacaagttagatccctggcagcaatctacttctcgaaacagaataaccattcaactatgacagctatcttaaaatcatagactgtaaataatattggggcacttctacatatcatagaaaataatgtttcaaccagaaaacatcttacctttttaaagctttccncccccctaaagaaagacatccaatagaagttgccacttctccatttatcaaaagtaaaatctacttccatgtaggnccggcnacttctttttaccttncagtcaattcttaactatttaaagactaaaacaaaataacttatctgnntttccattttactacagtaaatgggtattaaaaatagttcacatggcttttctttttaaattcaaaagggtattaacctgggatggtggaaaaacccacctttanccacacctccttaaaaataccttaaccttaacttncttaaaaccaatttacccagancaactngggggct

SEQ ID NO: 4647 - DNA, 750 bp, Homo sapiens
  misc_feature 29, 119, 130, 135, 136, 150, 151, 152, 161, 163, 217, 223,234, 243, 246, 263, 269, 277, 285, 288, 303, 320, 350, 355,358, 387, 389, 406, 410, 415, 430, 455, 458, 471, 473, 486,488, 502, 523, 548, 551, 556, 567, 568, 573, 591, 601: n = A,T,C or G
  misc_feature 608, 624, 632, 638, 648, 662, 666, 674, 691, 703, 733, 742,744, 750: n = A,T,C or G
cttaattccatcagctacttgttctttgnaagcattccatcgattcgaatttcggcacgaggccatccttctctctggctgtagactgaggcttttctcttgcttcaagtcagagcagnatttgttgatnacctnncaataatgtttggnnnacatgccantnattaaattaattcaacatgaagttgaatttgatgaaagtggtcatcgtatccangtattnggcttttgaangttttgcangtnaatggagatggaactcnccctgncacacacnctgaactncantggtgcaatctttgnctcactgcaacctccgncactgggctggagcaattcccctgcctcanccttnaantagctggaattacaggcatgtgtcaccanancccgggggttaaaattntttnttttnatttgaggaaaagcngggtcaccatgtaggcatgctggtntcnaacccctgacctnangtgatccacctgncnttggccttcaaggngctgggattacaagcttaaancaccatgtcagccagccaagtattnggnttttnaaaaatttganntttcntttgcgcaaagggaatanaattttcctnctgggtnaaaaagaaaccttttnaaagcccncccttnttttcaaaanaaaaaattttaaanttcnttttgggnggtaaaacctggccttnaaaacccctttnacttgggcaaaataaattttaatttttttnccccctttnantttttn

SEQ ID NO: 4648 - DNA, 711 bp, Homo sapiens
  misc_feature 3, 11, 14, 15, 79, 95, 153, 155, 182, 208, 212, 221, 244,292, 352, 368, 374, 416, 419, 435, 439, 459, 464, 482, 546,552, 554, 557, 608, 628, 640, 674, 693, 706: n = A,T,C or G
ttnatttcganacnnctcttgttctttttgcaggcatcccatcgattcgcccagctacatgggaggctgaggcaggagnaatcacttgaacctgngaggtggaggttgcagtgagccaagattgcgccatgcctgcagcctggcacggccagngnctccttgtcaaaaaaaaaaaattaatnaatgcctttggctaaacgtaaaagcntttnttggaccancttaatgcttaaaatctgttttngttccaggtgggttgttaacagggactcatttttttggtcttggatanggatcccggctactcaaacagaaaatggaaggaggaatctggttaaagaaaacaccagtntccagaatggtgaagntttggnaagaaaactcctttcttgctcaaagaaaaatttaaaaggttnggnccttttcccaaaaaancccnacacttttttttttcttgantgaangggctttaaaatttcttnggaaatagttttaccaaaaatgggatttaaaaaaatcctaccgatcaagatgagttcagctagnaagtcntnccncctcaggatcagcttaagtattttacttgatttttttaccaaatcaatgcncgtacctaccttaatccttnaaataagtttanaatttacctaaccccaaagtccaggagggtgttnttaccaaaaaatagctttntcaagggctggcncctaa

SEQ ID NO: 4649 - DNA, 668 bp, Homo sapiens
  misc_feature 4, 135, 150, 151, 205, 207, 212, 225, 231, 243, 247, 255,256, 259, 261, 263, 264, 266, 271, 273, 291, 317, 323, 329,331, 342, 343, 354, 361, 362, 363, 369, 379, 395, 398, 400,401, 409, 411, 412, 413, 417, 420, 428, 429, 430, 460: n = A,T,C or G
  misc_feature 470, 486, 487, 492, 498, 502, 504, 519, 527, 532, 554, 556,557, 564, 566, 575, 590, 591, 595, 609, 615, 626, 633, 639,645, 655: n = A,T,C or G
tganttcaatccgctcttgttctttttgcaggatcccatcgattcgaattcggcacgagggtggtcatccctaccttgttcctaatcttagggagaaagaatttgtctttcaatgagtaagtctgatgttacctntgggattttttggtnnatgctctttatgtgtttgaggaaaatcctgtctactctagtttttaggaaggangnccctngaatcggtgttgnatactntggcgatatcanaatngctatggnnggngncnngnttatncncattaagctcggaaatangtggtggtgcgacatcacaatgaccnatacantactgnangggccctagcnnccaatccttanggttccnnncatttnttctggctcngaatcaactgcatggncantnngccccccnannngaantanggaaggannntcacataggtacatgtgactatccttactnaatctggctntaaaaacatggtcctnnacatnaacatnttanancatactttgcagatntttgcggnctgcnctgaaatgtcccataaacaacntnnttacttnanggaaaaaanatactccatgggggnnaaanaaccatggaggaangaaggnaaagggccccncatgccnctgcangtttancaagggcagnttatttattctta

SEQ ID NO: 4650 - DNA, 707 bp, Homo sapiens
  misc_feature 11, 12, 13, 15, 19, 27, 150, 152, 195, 239, 242, 245, 255,263, 301, 308, 323, 329, 339, 353, 364, 417, 424, 437, 448,451, 472, 488, 499, 511, 514, 544, 552, 560, 575, 609, 610,611, 636, 642, 644, 646, 647, 651, 654, 662, 665, 674: n = A,T,C or G
  misc_feature 675, 677, 683, 699, 704, 707: n = A,T,C or G
tgatttccatnnngntacntgtctttntgcaggatcccatcgattcgaattcggcacgaggactagaaagaggccctgccctctagaaagctcagatcttggcttctgttactcatactcgggtgggctccttatcagatgcctaaaacntnttgcctaaagctcgatgggttctggaggacagtgtgggcttgncacaggcctacagtctgagggaggggagtgggagtctcatcaanctnttnggtcttggcnttatggcnaccactgctcacccttcaacatgcctggtttacgcacnatcttgntcatgggaagaggtnggtggnagactctcanagctcaagatgctnagagagaaagntccctgaactgggcccatctgactttctacctaccccattggtttttttggcnccttttntcccactcaatancttctggcagnatnctcctgagccacatgtgccangtactggaaaaacctncatctttggcntcccaagagctntanggactcttcatcagcactagatttgcctcntctaagtntctatganctcgcaccatatttnataaattgggaatggggtttggggtatttatgcnnncctataaaaactatactgagtcgtntttcgnananncaanacnttataagnatncatttgatnnantttggncccccccccttcttanaattnggn

SEQ ID NO: 4651 - DNA, 698 bp, Homo sapiens
  misc_feature 4, 31, 153, 297, 372, 420, 421, 429, 433, 436, 438, 449,474, 477, 491, 518, 521, 524, 538, 579, 581, 590, 600, 620,631, 655: n = A,T,C or G
ttanttccatacagctcttgtctttgtgcangatcccatcgattcgaattcggcacgaggtttgtataaaggttgtcagtttaatattcaagcaattaataaagacaaggtgtgagtttttctgttaatgcacctctgtctttaatgtggaancaccgtataaccatgcatcttaccataattggggtgcatgtctgtggtacatgggcacaaacatttttctttcagccttgtaatcacatctccaagtaatctaagcaaaaaagaagcaaaatctaagccagtggacatgctganggctatcttaagggcttctggaatgacaaaggccagaaatccatcttcatatcattttttttttttttggaatcnaggtcttgctattgttgcccaagcttaaaaaaattggcccgggggggnngcttttcnaggngcnanatagttaatgnatcctttaacctcctggggttaaanganccccctgcctcaanccttttggggaacttgggacccaaggngcnccnccccacctgggaantttaaaagcatttttatataaaaaggggaaggtgggctgtngncttttcctntttacctttnaaacccgggaatcaaaaaanaaggggcaagnggggatttcgggccatacaagccngggtttggggtccctggggggaacattttttttttttttttta

SEQ ID NO: 4652 - DNA, 639 bp, Homo sapiens
  misc_feature 8, 112, 127, 147, 162, 214, 262, 403, 408, 446, 447, 460,523, 547, 559, 572, 602, 607: n = A,T,C or G
ttccatcngctcttgttttttgcaggatccctcgattcgaattcggcacgagacactgggctcaggggctgagccattgttgggtgctattacttgtgttgggaaccaatanggaacagaaaacaancaaaacactaaccagagaancgggcttattgaatnctttgcacctaagaagattaagaggaaaaggaggaggttagagttggtgccntctgctcctccggtgtctgagtgttgataagaaagatagatgttaganggtagcagaattgtgttgcaagaattaaagccaccagcagatgagacttggaccctaaccaattccccaggagaacctgtgaaaaattaatgtcttgaagtaatggacatcaaaaggagcacttattttttggaatttggnaaaangctctagatccttaggaggatctattttgctcatttgnnggtgagaaactanattcaaagagataagtacttgctcatcattagtatggcagagccaaatcaactagatgtaacntgtcttaaacaccgactgtaatgnaatctataactntactggagatctncaataacagcctcagtgaccttgaaacccncagtngttagtaaatatcctggttttcctgatttagc

SEQ ID NO: 4653 - DNA, 727 bp, Homo sapiens
  misc_feature 1, 2, 9, 17, 24, 29, 38, 44, 47, 279, 401, 405, 415, 422,423, 434, 445, 490, 534, 589, 625, 660, 670, 710: n = A,T,C or G
nntttgaantccaatanatatatngctanttgtgcttnatgccntangattcgaattcggcacgagcctacctcaccaggttgtcgtggggagtgaacaaggtgagtggccctcacctacagactcaacatatggcctttggctcttcccacttccaagagtcttggaagggatgggtcgagcaagcagaggaaaggaagatgtgagttcccaaaatgctcctcacctttttcttctgagtgggctccttctcactgcattggagggcttgcggcgcancatggtcctccaccctgggagactccgtccctgctctcttaggtgtcaagatcagaggcctcttgcttacctaccagactgcccgggggcacggcatgaaccgagccttcagcttgccaacnttcnttgggaaccnttttggnntgaattgcaanttgggggtgcnggccatggacaccccggcagcaaccagcatacaagaagcccttgncacgtgacctactcttacagcaatcgcagccctgccggccctanggaggaaggaagtccaacttcagtctcagagattctgatgcagtatatcaattgngggttggctgtggccaagaatttttaataacttttnaaataacctttctttgggtatttaccaaaaagccnaacttggtantttggtcaatacaaatttttcaccaaaaccccctttaaanccaaaaaaaaaaatttt

SEQ ID NO: 4654 - DNA, 728 bp, Homo sapiens
  misc_feature 1, 5, 6, 13, 21, 419, 420, 443, 444, 546, 553, 570, 574,575, 605, 617, 654, 670, 682, 688, 724: n = A,T,C or G
nttcnntttgaanccttacanctcttgttcttttgcaggatcccatcgattcgaattcggcacgaggtcgtcggttttctgagggtacttcagctgacagagagattcagagaacgttaatggaggtaatatttggtaaagggggtttataaagaaaccaatgtttattaaatgaagaactgaacattgcatatttgatagtcaaaatatatagaacattttaaatgaaatatgaaatttgaaaatattgtcaggaacaaacatgtttctctatcacaaactctaagaaaatgactactggaaaataaggctatctgccaaattccatttggtatacacctgtactattctgtgttttttgagtagatcagtcattcatatatttaaattcttatgaatgtggaatccttttgggccgnngcgagttatgaagacatttttgnnatggcatattaagactgttggcaataaatgagcttaattatgtatgaagctgctctaaaaattattttttctctcactttattgctgagactgaggcaactnaaatagntttgataattggaagangatnnatgacagaatgaaaagaatgccttaaaggncctttccttccnagtttttaccctttcccccacttcccaaaaattcttntggaaaaggtggaatnttcaaaaaattnccaaantaccattttttcccacctttcaaaattgggaaaacntagg

SEQ ID NO: 4655 - DNA, 931 bp, Homo sapiens
  misc_feature 2, 3, 5, 7, 8, 11, 18, 21, 88, 152, 232, 311, 325, 330, 347,410, 413, 423, 426, 427, 431, 465, 470, 495, 508, 521, 545,558, 568, 581, 605, 618, 628, 631, 635, 672, 676, 682, 696,699, 708, 716, 733, 737, 748, 754, 758, 764, 781: n = A,T,C or G
  misc_feature 799, 848, 851, 863, 881, 896, 910, 917, 922, 931: n = A,T,C or G
gnntnannacngaaactnttnaactcctgttctttttgcaggatcccatcgattcgaattcggcacgaggtggctgttaagaaaacantggttttttcttttaaggtgatcatttcatgttcctatggtatggatgcatgtagaccttttangaaacagttaatgaagtttaatctgcttatgtggaaggaaaaggtttgaatggaaaaggcttcttggcatgcaacggaanccgccctgcttttcccccgatgtgtctatttaggaacatttctgtgacacttgccttggcgtctgcaacctgctacgtngctccttgatgganggaanaagcctggccgtggtanagggaaagctgagctctgttgggaaaatgagagttcctattggagaaatgcctctgggcaacntgnctggcctttnccnnaaangtttgggggccgacataggctgtgtacaagccanagtcnaaggtattaaaacctaaccagccantgcagaagtcagnttgggaggttccnggaaagtgcctaaactaaggcccnaaaaggaccaaangggcccggcncccccaggggtanttaaaaaaattaaaaaaaatccancccctccaaaggncccttaattnttncaantttttcccctgggccccttaattccccaattcctttngggncctttngggggaagagcccnttnaaaattttngggcccancccccctttttgggccntttnaaaaaaaaggngtgggnaaangggggntttttttttttttgggncctttccaaattgggggnaaaaaaagggcccttgggccccctttaaaaagggggggcccttggggtnaancctttccaaccntttaatttcccccccaanttttaaattttttgncccctttaattttnaaaaatnccttnccccccatn

SEQ ID NO: 4656 - DNA, 798 bp, Homo sapiens
  misc_feature 6, 8, 12, 32, 33, 72, 95, 97, 410, 482, 552, 570, 578, 634,640, 644, 646, 649, 651, 655, 658, 663, 669, 681, 683, 684,689, 699, 701, 703, 704, 711, 714, 715, 716, 719, 725, 728,731, 732, 738, 740, 743, 750, 763, 765, 798: n = A,T,C or G
gggccntncgtnaaccctttgaaactacccgnnctttttgcaggatcccatcgattcgaattcggcacgagnaaagaactcaaagggcagcaatncntttaagtaaggaaaccagttaggagataattgtggtaatccagggaaagaaagatggcagtttatactggggcattgccagtgtggatagaaatagatctcagaagaattttaggaagtagaagtggcaaaacttggtgactgaattgtgagggcagaagtgggagaaatcaaggatagagtttcttaaacaagctttggtgaagacagggactaccctatttgctgtcatgtatccacagcttagcacaaatctttatacgctggagatgcttgataagtaccgagtgaaattttctggcttgagtacccanataaatgggatgccagtctctgatttaggtaacacagaggcagactcacttgggaggtaactggtgattcanttttaaacatgtctagctcaacatgcctgtgaaacatacacatgacaatgtccagatacattggcaattnggatgaattgatttctgnaactcaanaaagagaggtctgagatgggattctttgcataccttaccaaaaaaaaaaaggtttntgtttntttngnaantnaacncgnttttntggccntgttaatcccantnnctttnggggaggccnangnncgggggngtnnnccnaagggntcnggnntttaananccntccccancccaaaatagggngnaaaaccctttttttttttaaaaaaaaaccttcn

SEQ ID NO: 4657 - DNA, 465 bp, Homo sapiens
  misc_feature 5, 6, 16: n = A,T,C or G
atganncttttacaanctacttgttctttttgcaggatcccatcgattcgaattcggcacgaggagaatcttatatttttaaaattgtccctatgttaaatccagatggtgtcatcaatggaaatcatcgctgttctttaagtggagaggatttgaataggcagtggcaaagtccaagtccggatttacatcctacaatttaccatgctaaggggctgttgcaatacttggctgcagtgaaccgtttacccttggtttattgtgattatcatggccattcccgaaagaagaatgtatttatgtatggttgcagcatcaaagagacagtgtggcataccaatgataatgcaacttcatgtgatgttgtggaggatacgggatacaggacattgcctaagatactgagccatatcgccccagcattttgcatgagcagctgtagcttcgtagtggaaaaatctaaag

SEQ ID NO: 4658 - DNA, 516 bp, Homo sapiens
  misc_feature 9, 10, 13, 112, 129, 141, 150, 170, 184, 186, 192, 193, 206,211, 213, 220, 226, 231, 238, 240, 273, 278, 289, 307, 315,320, 354, 370, 374, 378, 390, 407, 453, 473, 497: n = A,T,C or G
ttcatttannctntttttttgcaggatccctcgattcggaagagcttctgcaggggctgagcagaccccagggcctcttagccaatccccgggcctggtgaagcaggcgaancatatggtcggaggccngcaactacctgnacttgccgncaagagtgggcaatcttttntgtctctcgggaangncccaannctcctcccccaanttgananaaaaagnaagttntggtnaacccancntaagccataagttcccctggggcccctgggganaaagncttcaatcacngggccaagggcttctggnccccattnattgncttggacaagaactctgggtcacaagtcttgctnggtcttgctggggaancccnaccngacattgggccncagacttgctggtcttnttgggaagaagggcaagaccccaaaccaagatccaaaatacacttncagctcttaaccaaggcttnctttcaagtcacaagttgttgccngaaatcagtaacaagaagt

SEQ ID NO: 4659 - DNA, 461 bp, Homo sapiens
  misc_feature 8, 12, 13, 24, 28, 52, 103, 151, 152, 160, 165, 168, 171,172, 173, 176, 179, 183, 189, 190, 191, 192, 196, 197, 200,207, 208, 216, 220, 227, 228, 229, 230, 232, 238, 242, 243,244, 250, 255, 259, 265, 275, 280, 283, 285, 286, 300: n = A,T,C or G
  misc_feature 317, 325, 326, 328, 335, 336, 337, 339, 351, 357, 359, 372,376, 383, 386, 389, 391, 395, 397, 399, 408, 417, 418, 419,422, 423, 426, 429, 432, 434, 438, 444, 446, 448, 449, 450: n = A,T,C or G
attcattncacnnctggttctttntgcnagatccctcgattcgaattcggcncgagagctgggggtgactacagctcacctgcagctggtgagcaacttcaangcgtgagacccaggtgggccgggcctggacccctgtgccatggcaacnntgatattncagangtntgnnntangcncatnactgtnnnnggtnnttntctaggnngccttaanttancacatcnnnntncttcgntagnnnaaatgncctcntatnagcatnccttccttcnctgantgntnnatgagagcatgatntataatgcctgaaagancctgggtnngngattatnnntnagttaataaatnattctnancactatcacatgntgantgccctnctnacncncctngngnaaagagaanactgacaannnggnntanttntantncctngccaanancnnngttaccagcct

SEQ ID NO: 4660 - DNA, 466 bp, Homo sapiens
  misc_feature 2, 85, 412: n = A,T,C or G
tntacgttcaagctcttgctctttttgcaggatcccatcgattcgatgcgcttattaggtattttatctttcaaaaatatatgtncccaactgtgtttgtttgtttcctgactgtgaacactgaagaggactagatcaaaaatgaccaattgagtagcaattgaacatttacagtgctgtgtgcagtgaacttctgtagcacccaaattgtggggttggggaaaaaccattccaccttaaaagaaaaccaagcctttctggcaaaattgctgattctaggttttggccaagaaatgtacatgctgactggaacattgcataacagttagtaaggaggctgttaaagactatttagggtcatttcagaaagactggagaaatgactgtagaattcccactggcccagagatcnggtagaaacctgtgaagtgtgtttaaattcttgagttcataatgggtattttaa

SEQ ID NO: 4661 - DNA, 459 bp, Homo sapiens
  misc_feature 5, 7, 293, 364, 459: n = A,T,C or G
tgccntncagctcttgttctttttgcaggatcccatccgattcgaattcggcacgaggagaaactgcattttgggggggtttgaaatccaaagaatgcagtttgtaggcagtcgagatccttgaaaaatcaagatggattttaataatgtattaagaataaattggatttgaatcaacacaggaaacagggattttacttagagactatttcagtaattttgaaatcattgcccaagattgtagttggtttgtttataatgggtaggttatttatttgtgaatcccaaatgtnctccatcaacattccattgaataatttacaaaagcaaacagcaggggtttatgtttctcttctcctagttnaatattgtggcagcatatcatactttgttttagactaatttaacaggagttaatgtttccaagtaaatcattattatctaaacagtgtctttttn

SEQ ID NO: 4662 - DNA, 465 bp, Homo sapiens
  misc_feature 1, 2, 3, 5, 6, 10, 46, 52, 55, 62, 73, 88, 89, 98, 117, 123,144, 145, 147, 154, 160, 176, 178, 182, 183, 184, 187, 194,195, 206, 207, 222, 223, 225, 230, 245, 250, 254, 255, 256,258, 266, 277, 291, 292, 299, 301, 312, 314, 333: n = A,T,C or G
  misc_feature 338, 375, 384, 396, 403, 409, 415, 416, 420, 427, 431, 439,446, 452, 453, 456: n = A,T,C or G
nnntnnctantcaagctacttgttcgcaggatcccatcgattcgtnttcatncanggggtanatgaaaaggcngaatggattttattnngagccgtgngacgtgccgtcagaggctntctgtncttcctcctcacttcagcgcnnantgccacncccaanaaacgggattctaccngnctgnnngcncgtccgnnctgctacctcnngtgcccatgcatcgnntntcacnccaagaaagaggctnccttnctcnnntncttcattngtacatagacnaatcccaaaaaaannatgaacntnagcgcaagagncnttgactcccagggagatancgacngtagctcttcttcctcaaaataatgcatgatgatgcngcatacacnttataaccaaantatgctngccttntaagcnnacgnctgtccntccnacactatnagaggcngaagcnnacntgatctcct

SEQ ID NO: 4663 - DNA, 469 bp, Homo sapiens
  misc_feature 3, 4, 12, 14, 15, 16, 17, 18, 19: n = A,T,C or G
tannatccttancnnnnnnctacttgttctttttgcaggatcccatcgattcggcctaaaattagagaattatctgctcagtccttattcctgcagaatacaaatgtcacattctaacctgttaagagattgtcttcaaaataaaactgttattaactacattaatgttagacaaagtacactttagggcaaaaggcattattagggatagatttcataatgatagagttctatagtagaatatagtaatgcaactgaacaaaatgaagctcattccactgcatggaagaatctcacagatgtgatgctgaacaaaggaagccacgtacaaacacttactatataattttatgtacatcaagttcagaaacaggatagttacctttgggaaggaggtaactgaaagagtatgaggaggggtttctggtatctggttaatgtactttgtaccagttacccaggagtgttt

SEQ ID NO: 4664 - DNA, 462 bp, Homo sapiens
  misc_feature 4, 12, 131, 134, 146, 152, 207, 213, 234, 239, 261, 276,281, 287, 303, 306, 308, 311, 313, 333, 336, 342, 362, 366,367, 368, 376, 380, 386, 398, 419, 421, 436, 438, 445, 451: n = A,T,C or G
gatnccaatcanctacttgttctttttgcaggatcccatcgattcgaattcggcacgagacaaggacaagaaagaaagtacggttgcaacggctggctcgcatgcatgccgacatgatggaggatgttgangangtatatgccggngacatntgtgcattgtttggcattgactgtgctagtggagacacattcacagacaaagccnacagcngcctttctatggagtcaattnatgtncctgatcctgtcatttcaatancaatgaagccttctnacaanaacganctggaaaacttttcanaangnatngnccggtttaccagagaagatnccncatttnaagtatactttgacactganaacnnngagacagntctntctggnatgggagaattncacctgcaaatctatgctcanangctggaaagatgagntntggctgncttgtntcacaggaaag

SEQ ID NO: 4665 - DNA, 464 bp, Homo sapiens
  misc_feature 4, 5: n = A,T,C or G
cttnnttagatacagctacttgttctttttgcaggatcccatcgattcgaattcggcacgaggattcatcttcttgttctttaaaagtcaaaaggctttttgacctttaaataactcttacatctggtcatcactgttgaaatgttctactaaattttcagagtggaaaagttttaggcttaaaactgactggtaaaaatagaatatttctttgtattgatttttcagtatagctgtacagccagttatccttcgttaagtgtttcggtattaaaactgctcacatttgtaaatattgagcagctttattgtcagaacaagaatcccttggtttcccaatccccaacttttaacattgtaattaaacatcctgtataacctattttattctctgccaaacaattttatgactgctgtttttactctttgtgatgaaaatgggatggagaagataaggttctttg

SEQ ID NO: 4666 - DNA, 463 bp, Homo sapiens
  misc_feature 4, 65, 290, 371: n = A,T,C or G
attncaatacaagctacttgttctttttgcaggatcccatccgattcgaattcggcacgaggcantagctgtggggatggagaaaagtggacaaattaattagagagatttagaggcagattggtgattgaattgagcagggcagtgagaggattcccaggtttctgactgaggtgtctaagtggggatggtgatgaaagggggaatattgggagaggatcacgtttggagggagactaaggcaccatcagtattctagagattagagggctgtgagagaattgtgatangagggatttactctttggcagatatccaagcgtggaaggcctgtttgatggactgtccttgataatcacaggcaggtatancctcaaggctttgaggatggctctaaagtacatttcaaacaccacctcctccacaaagcctttctactacaactccatcccctgagtagagt

SEQ ID NO: 4667 - DNA, 470 bp, Homo sapiens
  misc_feature 2, 51, 53, 55, 60, 63, 65, 66, 72, 83, 92, 93, 95, 101, 102,103, 116, 127, 132, 139, 141, 142, 144, 152, 169, 171, 177,192, 196, 200, 205, 212, 218, 220, 244, 245, 246, 251, 259,265, 274, 275, 279, 281, 282, 283, 291, 302, 310: n = A,T,C or G
  misc_feature 312, 319, 320, 337, 338, 346, 350, 354, 359, 365, 376, 379,380, 388, 393, 395, 401, 402, 404, 408, 410, 413, 414, 416,418, 419, 424, 427, 457, 470: n = A,T,C or G
anaatacctttacaagctacttgttctttttgcaggatcccatcgattcgnananataanaangnnaaaatncagcaatggtncacaggctnncncctaannnatctgcctgctgncatcagagccnatgtnctgggcntnntntctggggntacattatttaggccantntatcanggccaacccctccanctgnctantagangccatgnccactngntaattcaagggcccagctccaggnnngtttncttctctnggggancatcagttnncttntnnntaccacgncattcccattngcatgttntngccgctnntcttaatagataatatnnaaaccctnattnctcncgctnactaantaccatcattnatnnagtaaaanatctnanaaaagnngncaancnagnngntnntgatnctnctcctcccctcccccacctgtgtttttaanagacaggattccn

SEQ ID NO: 4668 - DNA, 465 bp, Homo sapiens
  misc_feature 4, 8: n = A,T,C or G
ttanttcnatacaagctacttgttctttttgcaggatcccatcgattcgaattcggcacgagaattcataaaaggagttagttgcagtcatgtgtggccttgtctagaagcaaaaattataatatcaaaagctctacgtatgaattgggccttaatgtctttgtactcatttattcttttattgaaaaaaagctctaaatgcctattttgtgtcacataattgagatttgctttgaaatgtctgattctttactatagtactatctgagttgttcacagtggtatggtgatccatactctgaactgttccattatctggaattaaaggcatataataaaaagaaatagactgtatttagtttattctagtgtaataaattgaaaagtaaatagatgattagaagcaagtgttccaaataaaaatttatcagcagtataacaattctatcattcattccaacttgg

SEQ ID NO: 4669 - DNA, 460 bp, Homo sapiens
  misc_feature 2, 6, 174, 227, 251, 280, 332, 340, 346, 350, 363, 390, 393,397, 409, 415, 429, 439, 441, 448, 450, 453, 457: n = A,T,C or G
cnttgnttcgatacagctacttgttctttttgcaggatccctcgattcgaattcggcacgaggagagtctcactctgttgctcaggttggagtgcaggcatgtgatcatagctcaccgaagcctcaacctcctgagctcaagtgatcctcttgccttacctcccaagtagctangaccacaggtgggcatgaccacacctggctaagcttaaaatttttctgtatangtggtgtctcactatgttggccanactggtctcagatgcctgggctcatagcngtcctcctgcctcaaccttccaaaggctgttgattgtttaaatacgaaaaantttagaanatatantttnacgcacttaattnttagtctggtgatataccatccaaaangcntctnatgctgggcacngttgantcatgcctattatnccagcacttngngaggccnangcnggangat

SEQ ID NO: 4670 - DNA, 751 bp, Homo sapiens
  misc_feature 1, 2, 4, 5, 14, 20, 648: n = A,T,C or G
nncnntttgattcnatacanctacttgttctttttgcaggatccctcgattcgaattcggcacgaggctcaatcaatatttattgagtgcctacgacatatcaggctcagttaggagctggggataaagcagtgaccaaagcagacacagttccttctccagtgagattataatccagatgggataggctataaataaaggaagaagttaacatatatcaggtggtggttagtgctgctgagaaaaatgaaggaggggagagagaaaaggggatgccacaaggctagggtagagagttctgtttcatacagtggtaaaggaaggcctttgtgttgagtgctttgctctggaacgactttaggatggggaagaggcccaggtggcacctagacatttgaaagtaagggctgaggctgcatgtctctacctatattttctttcatgtttgcctttcatggattttttttctatgtatctagaattaaatatagaactagggtgaaatatccctcaaaaatggtatgggagcaactattagaatgaataggactcttggggccaatgggatggaatgtctgtttctggtcaagaggattgattttgatactggaatagaatattcacatatatcttcccattgcctgactncaatgggtgcctagctttccatcaaagtgggacttggtgaggtggggatgtggatgcatattaattaaggtacagctggcaccggcttaaatagaagggaagg

SEQ ID NO: 4671 - DNA, 463 bp, Homo sapiens
  misc_feature 2, 3, 5, 10, 14, 250: n = A,T,C or G
tnncnttcanacangctacttgttctttttgcaggatcccatcgattcgaattcggcacgagaaacgaccacctttacgagaattctttgtcgatgactttgaagaattattagaaggtgagagaactctttaccacacgtttcttccagatgctcctatggtcccgtaaacaatgatatttttttctgcaaggctattttactttttaagagcagtaatcgtggcatttgccgcatgatgggaacccangtagggagcgggtgatgttcccaggcagccttggtgtcggcaggtctctaaacctggttgttagtcgtcctctgtgggagttgattttgttctgtgacccaggtcaggtctctctctaagaactctgtaagagtatagaaatacaagtaaagtataaacatgtagaaaaacaagtaaactggggaaatccttcgctggcagcaaaactggcgt

SEQ ID NO: 4672 - DNA, 747 bp, Homo sapiens
  misc_feature 3, 4, 8, 11, 12, 18, 747: n = A,T,C or G
gcnnttgnttnnatacanctacttgttctttttgcaggatcccatcgattcgaattcggcacgaggagttctcttgtgttttactctttttacagtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaagctggttgggaaggtgatacctctcacagttagcttggctcagtggggagataatattccctatgggagttgtgtatcctattaacaatcagaggtgctacagaactccctgaagttaatggagccaactggaatgtgttgggagtttacaagagtgaacattatgtagcatgtgaatggatatacaaataaaagatgaaacgtaattcatatagaagtactgacaaaaaaaaacactgtcattacagtgtctattgcctgtaaacctacaagcctgagctggtcttctgtaacttttgattaatgttatgttattattgggtaagttaaaatctcttggcttn

SEQ ID NO: 4673 - DNA, 468 bp, Homo sapiens
  misc_feature 158, 267, 347, 388, 464: n = A,T,C or G
tttcctttttgtaaaccctacttgttctttttgcaggatcccatcgattcgaattcggcacgaggtaaaacaccccctacagttccaattctgggcctgtcttctatctatctttgcccttctggtccgttccctgttctgagccccagggaacttanggctgaaagtcacccccgaagcctcagaccagatcgggaggccacacgcagctcatggggacagagggcccagggtgacggtccactcatgagaagtgctatgtgactncagggagtctgtccctcttccgggctccaatccccagcccaagctcagatgacccagcctgtgtccctttagcggccgangagccaccacctgttcgggggctggaggatggcttccagangacctgggacactcacctagctcgttcatggcacggcggtactcctcatcaaaggacaagcttcataacagcacangtgg

SEQ ID NO: 4674 - DNA, 467 bp, Homo sapiens
  misc_feature 2, 8, 10, 17, 24, 26: n = A,T,C or G
cnttgatncntatacanctactcnanctcttgttctttttgcaggatcccatcgattcgaattcggcacgagggggtctcttctactgtcttattggaccctagcagtggctctgagccagcagtcctgtcagttgatttcttggtcgttcctttgttttcttctataatcacatgtggactcagaatgaattttgagttactctgaaatctatttattcaacagatatttacttagtacctcctattgccagactctgctttatgttggatattattttttaaaagcccaccttgcctagatttcctcaaaggaccaggtggcttccctggttttgaaagaccctaattcttactatgatcttaagtaaattatatcctttctgtgggctcaagttctttctaagagggctctttggggctacaaaagaaattgttagtgcaaaaagagtttataaggtttataaa

SEQ ID NO: 4675 - DNA, 471 bp, Homo sapiens
  misc_feature 2, 6, 8, 13, 14, 17, 20, 21, 27: n = A,T,C or G
tntttnantactnnaantcnnatacangctacttgttctttttgcaggatcccatcgattcgaattcggcacgagccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagagg

SEQ ID NO: 4676 - DNA, 470 bp, Homo sapiens
  misc_feature 18, 19: n = A,T,C or G
tataccattttgaattcnnatacaagctacttgttctttttgcaggatcccatcgattcgctgctaaaaggcggatagatgttcagttcctccatgaaatgagatttagttcccatgtaatggcattttccataataactgctgatatcatcaaggtaaagagagctgcttctcctaactacccatgaaagaatttagctttttatatttctacctctcccatatagtttaatctctccccactgcgagtatgactgactccaaggtattgaagtctgtgctctaattgggaattcaatgaacaagacttcagtgaatgaacttttttagccatattatataaaatgaaaaaggatctgctcctcatttcaatctcctgtacaattgctcctgaacagtagtacagaattgtagagatagcacattatgcaacctggctttttatctgagacatacttaatgaaagcaca

SEQ ID NO: 4677 - DNA, 465 bp, Homo sapiens
  misc_feature 1, 5, 20: n = A,T,C or G
ntccnttggattcgatacanctacttgttctttttgcaggatcccatcgattcgaattcggcacgagcccctgtgccccttccccaggaaatcaagtcctaaggaataagagtttgttggacagagttgagccttggagggacacaaaacattgtaatatctaagatttttttcatactctcccagaaagaaccaattttcaccctggggtggcggggtggtaaaattgcccctgttcagaatacatgctctaataagcggcagccatgggattttatcctaatactgagtctagatgccaaatctttttcaccctgtctcaaaacaaacaacaacaacagcaaaaagatcactttggctgtttttatttttggctgttatgtgaagaatgaattgcaatggggcaagagtagaagcaccaggagaaaagcaaatgagttttgaataaatattttcccctatctt

SEQ ID NO: 4678 - DNA, 469 bp, Homo sapiens
  misc_feature 11, 15, 17: n = A,T,C or G
tgccttttgantacngntacaagctacttgttctttttgcaggatcccatcgattcgaattcggcacgagaaagcatgtgtgttggggggtgcgtatcattttaccatgtgataagcacttttcataggtagcaaagacacattatgtaaacttaggaggagggagagaatgcaaatttgcatgtgaattttattttgattaatcgctttttttgcttttcagcaatgttatttatgaacaacaaaattatagaaaaagtgagaaaaagtcaattatcaattattttctgatgaacaacaacaaagacaaaaaaatggtgggattgatttattttcccctgacagaattgattgtttctttaggttctatgcaacttgcagactcactgagggtgaatggaatgtgctgaaaattcagcctgacttggcagctccaagggacacacctcaatgtagagaaagcaggaat

SEQ ID NO: 4679 - DNA, 465 bp, Homo sapiens
  misc_feature 2, 3, 7, 11, 57, 140, 180, 188, 189, 215, 217, 219, 221,228, 230, 236, 246, 255, 256, 259, 284, 336, 337, 348, 390,411, 413, 414, 417, 418, 425, 426, 431, 454: n = A,T,C or G
cnncatntggntcccgttccaagccacgagcccattttgcaggatcccatcgattcnaattcggcacgaggcacaggccacggagagagagaggccgggcctggatgaagccgtgggcgttggtgccgtgcgaggcccancatgcttggaggaaaggtcaccgtggctgtcaagtgctanccagggcnngagccgggcttgtgtttctcgctcantntnanccatctntnatctgnttcaaagggnattcaaaannccngggtcagattgtttcttggattacnctgatcgtctggcctgccttatccaccctggaaagttctaagcagataatanntatgtggcatntctgaggttttgatgccccgagccgtttacaatatgcttccngactgaaagctgggccctgantnnctnngctgagnnctacnttggaaaccacgttcccctcagnctcattatcac

SEQ ID NO: 4680 - DNA, 1039 bp, Homo sapiens
  misc_feature 8, 11, 14, 16, 19, 26, 28, 33, 35, 41, 42, 43, 47, 48, 49,57, 59, 60, 64, 70, 72, 74, 102, 105, 126, 146, 147, 151,153, 157, 170, 196, 198, 204, 211, 213, 218, 233, 235, 240,246, 247, 250, 256, 257, 264, 266, 268, 295, 296, 297: n = A,T,C or G
  misc_feature 313, 317, 330, 336, 344, 354, 384, 394, 396, 408, 411, 422,430, 432, 435, 443, 445, 464, 474, 482, 489, 492, 493, 494,495, 499, 510, 513, 516, 522, 528, 538, 542, 554, 559, 564,569, 570, 574, 575, 580, 584, 589, 591, 598, 605, 606: n = A,T,C or G
  misc_feature 607, 610, 615, 630, 632, 635, 636, 637, 640, 642, 646, 647,649, 650, 652, 653, 654, 663, 665, 670, 684, 685, 688, 693,697, 699, 704, 712, 714, 739, 742, 743, 750, 752, 755, 762,776, 778, 779, 781, 783, 790, 792, 793, 795, 797, 801: n = A,T,C or G
  misc_feature 802, 804, 805, 808, 810, 812, 814, 821, 829, 834, 835, 839,842, 851, 852, 855, 859, 863, 868, 869, 871, 876, 877, 878,891, 892, 896, 897, 898, 899, 908, 919, 921, 930, 932, 935,936, 939, 940, 941, 945, 949, 955, 961, 962, 964, 965: n = A,T,C or G
  misc_feature 967, 970, 972, 979, 993, 995, 997, 998, 1004, 1012, 1015,1031, 1034, 1036: n = A,T,C or G
ccagccanaanacngnganaaaaggncngacgnanacagannncgannncgacgccngnngaanaagcananancacccccccaggcgttggaacccttcanagncgacgaaggcagacccacgancgaaccggcacgagactgannagancnggcncgaaaaagtgtgngccatactgagacccacgggcagccncnccgccnctacagngncaggnggaccagggacaccncnggacngcgcannacngagaannaaggaancnanggccggcacgaagggcaagggagggannnctgcacgggacggcanaacngcaagccagcctncaagcnggcaaganccagccaggnggcggcaaaaacaagaaacagcccgaggcncagcccggcncncaaccaggcccnaancaagaaaaganaagcaccngngcnggacggcngnacccacacaacgggcacgnaaaaagggcngcccgcgnggacacngcnnnncatnggaaaccaccnccnggnaaaaancaccanaagggggccngcanaaaacccgaacngggancaagngccanncagnncgggnaaanaggangnaaaaacnggccagnnngcnaccgnggaaaaaaaaaacgncnccnnnatngncgcnncnncnnncacggcaananaccanagcgggacagacanngancgcanacanangcgancggagaananggaaagaagggagacaaaacagcanganngacgaananggnacacgcnacacgcacagcgangnngnancaaaagnanncncngcannannagngngnangcaaaanaacgcgangagannaganagnggacgcacnngcncacnaganggcgnncngacgnnnccccaaaacgacnnacgnnnnggagcaganaacgacgcacnanaaaggacgnanganncannnccgngaanaaaggnagaaanngnngnacnanggcgacnccaggagacaacanangnnaaagcnaagccccnagnacaaaagcaccaaaanaancnccg

SEQ ID NO: 4681 - DNA, 759 bp, Homo sapiens
  misc_feature 3, 4, 11, 13, 20, 577, 655, 657, 748: n = A,T,C or G
gcnntttgatntncatacanctacttgttctttttgcaggatcccatcgattcgaattcggcacgagctgccttccaacaaaatcgtcaagcgggcagaggagttggtggggcaggagttgccttattcgctgaccagtgacaactgcgagcacttcgtgaaccatctgcgctatggcgtctcccgcagtgaccaggtgcatcttcagcctgcatccccttcccaggagccaggccactccctcagctgccagaggctgggtccctgctggggccagggtgggatggaaatagacatgagcaagacaaaatagcagatatgaaactgttgtccttgagggtgtcacatttggggtggggacaagggtggggagataggcaagtcggcaatgtagaccagtgcagtgggttggggggtggccacagaagggagtcacagcctgaaacagccctccacagccctagaggccggctttatgattcccactttacagatggggaaactgaggctcaccgtgcttaagtaacttgtccaaattcattaaactcctagttattgagtctctagtccatgtcanccatggtgaagaacgggggagttaaacctacatgtgttctctccaagggccccgatcaaggaaagcttttgtagaaanangtcacacccgagcccacctgatttaattattttgattaatcttgaaaaaaaaatgaacctggagattaccagggaaccgggggccaataangaagtgtagct

SEQ ID NO: 4682 - DNA, 751 bp, Homo sapiens
  misc_feature 2, 4, 5, 20: n = A,T,C or G
gncnntttgattccatacanctacttgttctttttgcaggatcccatcgattcgaattcggcacgaggcacgcagcacccactcagcacctcttagaagatgcgtccgtagtatatagtatgatttttcgaaggggattttgctcatattaagggttgctttagggatgtccaggaagggtcaggtaaggaatctttcaatctgctttctaattggcttagttttcccactgtcttcgcaaaaggacaggaatttccaggttagtttgcagcttgtctttcatcaagcgaaatgctcatgctgttgggtagatggtaatagaaaccttttgctacctttatttatcaagagttgtggagccgaggaaccgtgtcttgggagttgtgcaggattgaaactcacaaaaaagcctgtttgaagaagttgttacctatatttattcaaggcagttcacaagccttatactaactttgcggggtctttcagttgagcttacatgactgcgcttggctttgtgccttggcagccaacatttgccatgcaggaggcttcccagaaaggttcggattcctcttcaagtttgagaagcctgactgagaccattctcagcatggcatgacccgtgaatcaggaagtgagaatctggagtactgctaaggcaccttgtgggtggaaatgagggtttgagatgccaacccttctgtgccttcccacaacttccaattgtttccattgctcatttgaccaacct

SEQ ID NO: 4683 - DNA, 750 bp, Homo sapiens
  misc_feature 1, 4, 5, 6, 12, 16, 21, 626, 722: n = A,T,C or G
nccnnntgaatncccntacanactacttgttctttttgcagggatcccatcgattcgaattcggcacgagatgaatttgtctctgaggatattcaaagaaagcagcagtagtagtgttaaagggtcccagctaggccttttcagttctttcctatcattgttaatgtagacaaccatttcccagatttttgagataaatcaatttatttatttgcaatatttacatgcctacatggttttttaaagttattttaatgtatttttaatgattaaaaaattatgtcccgtatttattagtcattcattacttaccattatttgcatttaatccttaaagcagaagtgtacaaaaaagagattaatgtaaagcaaatcaatgaggattgaagcaaattaattctctcaaaataaatatgtagtatctttagataatttggcacctgctgagtttgtcaatcttagcaaactaggccatttagaggaaataattctgtctactttttgagtgtgttttttaatgcttttacttctggtgtgggcatgctggattttatatttctaaaaaccaataaaatttggaaggcattgcctctaaatgttacctaaaaaatagaaaacacaacccntaaatatgcctagtaattagcacatattttatttcatagaaactgattcctggctggcctggtggctcacacctggtaatcccaacactttgggangttgaagcagggggatgcttgacccttg

SEQ ID NO: 4684 - DNA, 751 bp, Homo sapiens
  misc_feature 1, 4, 11, 14, 19, 655, 675, 697, 745: n = A,T,C or G
nccntttgatnccntacanctacttgttctttttgcaggatcccatcgattcgaattcggcacgagattagatactatagtaggttaataatgactaacaccttgtcatctcatcactgagcttttgtctaagatagtctctgaatttagaactgggacgaaagtgtacataataggctattataaaatttttagaattggatttctaaacttggggtcagtgaatctagcaggcttaagcagtgttctcaggtttttctggcacagacaaggaatataagaggaggagagaaaaggagagacagtagtgggagggaatagaatgagagaagatagaaaatatggaattaatagagaaaggatacatgaagtattacaagattttcttggaaaaattggcatttcagtgatggatcaaagatgtctaatgaggcaaaatctactattacttaaatatttaatgttttaaagatttgaggataaaaggatatagatctgatggcgttcatactaattgctgtagtgttgatgttggagagaggggtaatgtatcaagacagagcagacagaccctttacaatgagagcagaagatatgttgtttactgattctactttcccacaaaatgctaatgcttttataagtccctcctccntattttctagattaactccntgtttcttcctctaaaccagangattatggcagacaggcaaaaaaaaaaaaaaaaaactcgagcctttanaactat

SEQ ID NO: 4685 - DNA, 800 bp, Homo sapiens
  misc_feature 578, 581, 671, 736, 744, 746, 751, 794: n = A,T,C or G
aaatacacaacaggcaagtgccgtataccaggaattgttcaaggagagcaggtagtttgtcttatattctaacgtgggagaaagaaagcaaataaattacatgaattgattaattgatcagttgcatggcttttagtatacatttctgtcagtctgccaaccagcacaggtcccttattagcatgggagaagggcctgatcactgaaagtattatagatttatagagtattgaaaggaaacttaaggaaattgggggcagtggccttttagaaaacagcctaactccatcagtgacttctgcttgcttgtgcctctcatatgtgatctgctactggcctttgttacttctctctgaaataacacaaaaattatgtttagggctctcattgacttcaactccaaaccatatgttacttcttttaaaaacataatttctaaaaaaaaaaaaaaaaaactcgagcctctagaactatagtgagtcgtattacgtagatccagacatgataaagatcattgatgagtttggacaaccacacctagaatgcagtgaaaaaaatgctttatttgtgaaatttgnganctattgctttatttgaaccattataagctgcaataaacaagttaaccaccaccattgcattcattttatgttcaaggttcagggggaggnggtgggaggttttttaattccgggccgcggggcccatgcattgggcccggtccccacttttggtncctttagngngggtnaatgccccctggcgtaaacatgggcatagctggttcctgtggnaaatgg

SEQ ID NO: 4686 - DNA, 464 bp, Homo sapiens
  misc_feature 5, 17, 86: n = A,T,C or G
ttatnctttgaaacacnctacttgttctttttgcaggatcccatcgattcgaattcggcacgaggaaaaggccccagaatgggctngcttgaactggaaaaacacactttctcatcccttttggaccacgagcttcttgagagcaaagcatgtgtttgatattcctttgctcaccctcaggccttgtttggcaaattgcctgggatacagaaaataaggacaaggtctgggtgtagtggcttatgcctgtaatcccacactttgggtgaccaaggcaggaggatctcttgaggccaggagttgcagaccagcctgggtaacatagtgagaccttgtctctgcaacaaaatttaaaaattagccagacttggtggttcccacttgcaatcccactatttgggaggctgaggcgaaaggatcacttgagcgcaggaatttaaggctgctgtgagctatgattgtgc

SEQ ID NO: 4687 - DNA, 759 bp, Homo sapiens
  misc_feature 14: n = A,T,C or G
gaaatctttatcanctacttgttctttttgcaggatcccatcgattcgaattcggcacgaggctactcaggagactgggcaggaggattgcttgagcccaggaggttggggcttcagtgagccatattcacaccactgcgttccagcctgggtgacagagcaaggtgctatctccaaaataaataaataaatgttaaatttgcttttttctctctctctttttttatgtagaatttgtttgttgatacttactgaatgtagtgaccctgctgtggtaatgaacacttctagtgccttctaggcttaaaataccagacagccccaaataacaaatgctcttttgtgttttgataggttggatttctgtttgcttaatattgggaatactggggggaaaaaagatggtgttttcattctaaggattgtcctaaagaaagtgctactttatttttaagaaagtaaggccacttgttatataagaaataacaagttcccattgggtcccattttgcaaaaggggataaagaattagactgatagcatcatacgaggcatatttcactatacaaagtgttgtcacctgtctatacaactctcctacccagcttgacctcacttttcatacctgatgcagcaaaacaattcaatgccataggagaaggaagcacatggttataagtgactaacacgatattaggcaatttgtccaaatttctcattttctttataggtaaagaaagcattcttatttgattaaat

SEQ ID NO: 4688 - DNA, 954 bp, Homo sapiens
  misc_feature 4, 5, 6, 16, 17, 18, 24, 33, 41, 42, 48, 54, 62, 71, 72,88, 89, 107, 109, 112, 113, 114, 122, 124, 130, 148, 158,159, 162, 171, 187, 191, 202, 206, 207, 208, 210, 221, 222,263, 264, 277, 289, 309, 318, 320, 321, 323, 338, 347, 362: n = A,T,C or G
  misc_feature 367, 376, 377, 416, 419, 420, 439, 441, 444, 445, 446, 449,461, 467, 481, 496, 508, 512, 514, 515, 528, 537, 558, 566,578, 592, 614, 618, 655, 656, 683, 684, 705, 708, 719, 721,725, 732, 739, 745, 749, 757, 762, 768, 782, 788, 804: n = A,T,C or G
  misc_feature 812, 817, 829, 837, 841, 853, 879, 880, 895, 900, 910: n = A,T,C or G
gggnnntttttttggnnnaaaaanttttttttnccccccannaaaaantttttntttggggnaaaaaccanncccccccttttacctnngggggaaaaacccttttncnccnnnggggcccnangggggnaaaaacccccccccaaancccgggaaannttncccgggggnaaggcccaaaaaaaangggnaaggaaacttngggnnntnccctcgggggnngggaaaaaaaatgggaatggtaaaaatgggggcccaagganntaacccaaggggnccaaatgggggngggggggaaagaaaaaaagnaaagggggntnncncctcccctaaaaacncccaccaangggggggaagccaanggaantttaccccnngggcaagggaaccaataattaacccttggaattacccgnggnnacccgggcatctgggaaananggnnnacncatgtggagtanaacaanggcggctaatcaanccaagggggccaagnggggcacacatncatncnngctcctggaaccngcatatgcnatgctctcctctagaacactngtccattngccaccggctcntcacatgaccaaancctacattggctccaaaaatcnccangtaaaatggcacttccccaaagaagggggaaattttnnaaaacccccccccgacgcaggccaaannggaccccctgggctacttaancanagccatccccnancaanacttggnagcactnaaaagnagangggggganaatanctgggncggacaacacggcnactctngggctcaggattaagngggaaagnggaanaaactggggttntcaggacnggantccaactctaancgggggggttaaagggaaaaaattcnnggactgaaagggggnggganggggggaacnggctccagaaaaaggaactccataccctcctttaatcacagaca

SEQ ID NO: 4689 - DNA, 828 bp, Homo sapiens
  misc_feature 416, 506, 521, 575, 592, 609, 648, 657, 700, 702, 729, 755,757, 781, 794, 798, 800, 803: n = A,T,C or G
tgttaggcaactgatgactatacttatttcacaactggtaatgtgaattattattgcataaactatagtgctgaggccccagtctttacacttccatttaataacttcacagtttcatatcttcttgagatacttactaatttcaagtcccatcttggtcacaaggagttgtgaattagagaacaattaatatcaccagttaaagaagttagattagaaatctgaaccatcctaaacataagaagtacctgcatcttcagagtcttatcccaaagccgttctgctaaattgttcaattttctccatagcagagctttccaggcccttatttggaagtgatttatctctatgcacagttatgtatggatagtatacataatactagcaagtgttattacctagtgttaactggtggngtatttacatcaaaatataacttaatttatcgatatctttttaggggtttcccattaatcaaaacacgtgatatatgtaatcagttgcangttttctgtgactgngacagtagagagtccttcatcctctgaagttgaagaaggtggatgattcttcanagagtgttcatgaaagngcctgggaaaactagtnttgaacaagaagcattaccgggaaaactgggaggagtgnctaaagccntttaaaggaagaaagaatgataaggcttaagggtggtaaaccnantcaatgaacctgggacaatgaaaaagnccccctttaaaaaaaaataaaatttntntttggtttggaagcccttcatgcncaggcatttgacnaaantnaancccgggatgaaaaaaggggtttttg

SEQ ID NO: 4690 - DNA, 1046 bp, Homo sapiens
  misc_feature 2, 20, 25, 31, 56, 64, 69, 70, 77, 79, 83, 99, 107, 108,122, 125, 127, 129, 135, 152, 165, 169, 171, 181, 184, 197,199, 204, 205, 207, 209, 210, 212, 215, 223, 248, 260, 266,272, 278, 280, 295, 302, 317, 320, 330, 342, 363, 367: n = A,T,C or G
  misc_feature 370, 374, 386, 421, 428, 443, 489, 494, 521, 532, 537, 548,553, 560, 562, 577, 594, 599, 611, 639, 653, 662, 671, 677,698, 700, 706, 709, 726, 733, 736, 737, 740, 751, 773, 792,799, 824, 828, 841, 843, 844, 845, 846, 854, 861, 872: n = A,T,C or G
  misc_feature 876, 882, 945, 951, 966, 981, 1017, 1019, 1023, 1046: n = A,T,C or G
tngttaagcattcaattttnagatncatttntcacaaatgcatgattctggccctnaaatccgnatatnngcatatntncccnttcaggggggatacanaaatgggnntatgcacacactantcngngngcacgnaaatttctggtgggtgnaactggtcggctnatgntngtaaaatggntcnatagactatctgnancacanngnanntnttncaccctgnatgttgaactatgaaagatcctttntgcgcttaattntacggntaaggngcaagntnttggcctccaaaccnatgtgtntcataaatgtgccanacntaaattattnttgaactttttncagaaatactaaccattaaanggangtnttcnagattggcaacntaatggcaagccctataatttgcacacttatttcntgcaggngatggtatttggttnatcaagggcatatctggtggcccagaatcttttggtaaataaattngaaanaaaaaccccatttaaaaaaatgaaggnggaaccattcnctttnaaaatcaagcnaattnggcttancntttaaaaattaaccncctgggttttattaacncgggngggtaaagtttnaaaaaaaaaaaaaaaaatttttttaaanggggaaaaattttnaaaaggccntttaacaangggggnaaaccttaaatccttttccantnaaaaanggncccctaaaaaaaaaaanggttacnttnngtnaaaaataaaanttttttaacccccctttccttnggggggccttttttcattntttaatncccccaaaatttttttttttttttnaaanggagggggggggnannnntaattaanaacaatnaatttttaaanaaanaaccangggggtcttttggctttttgtttggccccaaaaacttggggaggtgccaggggggcttttttnaaaggncccccaattctttanctttacctggtagangggaatccctttgcttggcccccattctttttggananaggnttgggggaatatttgggcctttn

SEQ ID NO: 4691 - DNA, 1021 bp, Homo sapiens
  misc_feature 14, 15, 18, 27, 59, 70, 73, 119, 138, 140, 149, 170, 174,176, 197, 198, 202, 218, 226, 235, 239, 241, 245, 247, 259,261, 262, 282, 283, 298, 302, 304, 307, 312, 316, 336, 345,348, 364, 366, 375, 378, 385, 388, 394, 398, 402, 410: n = A,T,C or G
  misc_feature 416, 418, 419, 430, 433, 441, 443, 445, 446, 448, 454, 456,458, 469, 470, 479, 482, 483, 485, 491, 496, 506, 508, 509,512, 513, 519, 542, 551, 553, 555, 559, 566, 568, 569, 571,576, 583, 585, 586, 592, 594, 595, 599, 607, 616, 617: n = A,T,C or G
  misc_feature 626, 629, 631, 635, 636, 637, 644, 650, 657, 662, 675, 680,690, 692, 693, 702, 707, 709, 710, 712, 713, 719, 736, 758,760, 766, 768, 769, 775, 776, 777, 778, 781, 782, 783, 789,792, 794, 795, 805, 812, 813, 814, 815, 816, 832, 833: n = A,T,C or G
  misc_feature 834, 839, 841, 842, 845, 846, 853, 855, 859, 860, 862, 863,871, 872, 876, 877, 889, 899, 900, 901, 903, 911, 912, 913,935, 956, 966, 978, 983, 984, 988, 989, 991, 992, 993, 996,999, 1004, 1005, 1020: n = A,T,C or G
tacctgatggttgnnttnctctcctgngctgctcatgtctgcttaactacctactctancagcaccaggnagnaggaataatatgtctctttcatgataaactggcttggaaggccttntttgtacatgcaatgttgnancttcaggtntccaaggtggataatgttggncatnancatcttgctttggggcttgtnnttcnaagactcatatgtatngccctttntttattttnaagncntctnantggcccccaccngnngagttttcttgaatgcttcnngagaaaatttcccanaaanancgnctttnaccncaaacttcccccttatgggntaactttancantaaaccccggaaggancntttaattcngcnaacccantanaaaaanttgnatcntttgggcnccaaantnntttaggttaanctncaatgtancnannancctgtntntncttgtaaattnntcaccaagnacnntnttgtcnattgnccacgttccntnnggnnggtccnctatttttgggtttggttaaaangaagggctngncntatnggggccncnngnaaaantgccccnanntcttcnannaagnaaccttgnacaaccaanncccttcttnagnanttcnnnaaaccanttgcanttgttcnggctngctttgtaatttncaagncaattctttngnntaacccatngtttntnntnncagaanagggaaattccccggcntcaattaaaggtgggcctggcnangatttnannaaaaannnnaannnaaaatnatngnnggcctttttnaaacttnnnnnggatggcggatttacnnnagtantnnccnngcatgtnantagnnannacatgtgnnttannttgggaaccaanccccaccttnnnantggcgtgnnnaaaaaaatagcttttttcgggnaaatttgggcaggcctatggnattattgttntaacatttattngctcnngatnnannnttnacnccacnntcgcctctatttctnc

SEQ ID NO: 4692 - DNA, 898 bp, Homo sapiens
  misc_feature 15, 17, 30, 39, 43, 46, 51, 57, 71, 101, 114, 116, 117, 126,142, 143, 149, 150, 151, 153, 156, 170, 172, 173, 175, 177,180, 185, 189, 190, 195, 198, 201, 206, 207, 208, 212, 213,219, 220, 221, 229, 230, 232, 238, 243, 245, 248: n = A,T,C or G
  misc_feature 251, 264, 269, 275, 279, 285, 286, 287, 288, 289, 295, 298,299, 307, 309, 310, 319, 326, 328, 329, 334, 336, 339, 340,341, 345, 346, 349, 351, 357, 364, 366, 367, 377, 379, 384,391, 392, 394, 396, 398, 404, 407, 423, 426, 427, 439: n = A,T,C or G
  misc_feature 459, 472, 479, 483, 484, 491, 493, 497, 498, 499, 515, 516,522, 537, 539, 542, 549, 551, 552, 553, 556, 564, 565, 567,573, 581, 582, 586, 589, 590, 591, 597, 598, 601, 603, 616,621, 631, 657, 663, 683, 691, 703, 709, 713, 723, 744: n = A,T,C or G
  misc_feature 750, 754, 758, 762, 764, 771, 778, 781, 784, 785, 788, 790,801, 803, 824, 831, 839, 841, 849, 850, 863, 864, 865, 868,870, 874, 879, 887, 888, 890, 892, 897: n = A,T,C or G
tttggtcctggagtntnatctacttactgncatcttccncggnctntggcngtgccntgttccatgccgcngtgaggctatatgagatgcgccttggagcngcctggatttttngnntgtaacacngtgggctgacttgtgnntctatnnnanatngccgattatacaancnngngntcnctggncaannactantgnttnagagnnntctnnaacccnnnccgctgtnncngctggnctgancnganggncttgtgtgcagtnactgnttcccntttnccaggnnnnngccctnganngcatactntnntgcctgtcncagtgtntnngggancnttnnntcannganangtctcnctgaccngnnaaggaacatntntggantgacatnngngnantctctngangtatggggaaacccanganngtggtcaataangggccctacaaacatgtttnggaaggctcctanggcattngggnnaaacatntncacnnnctatacaagtggcttnncaaagngaaagcggttattcntntantaactcncnnnacnggacccannantgaccncggcttgnnaccntgnnnaacccnntcntngaactacgggccnttaangaccaaccanggttggttcttgccaccattttcttntgccanccacaaacctggccttgggnaaattttncggttgcattantaaaantganggggggctanctgcttttgggccctctttcnaccttntttntgangtangntttttcntttttantcncgnncantngataagaatancntttgggttgaagttttgggtnccaaccnccttcttntnaatttctnntggaaaaaaaatnnnttntntttnggcgnaaatttgnngnangcttnt

SEQ ID NO: 4693 - DNA, 804 bp, Homo sapiens
  misc_feature 476, 680, 691, 736, 738, 792, 793, 800, 802: n = A,T,C or G
gaagttcaagtaagatctcagtggtgacaggtctagcttatttcaagagctgcacaaaagccacttaacctggcaacaaaaagttaatgtgttggttccctttggtgtattatattcagtctattaaagttttgattgtgatgttttcattgcagtttttataccggataaaatgtattttagaagtagaacttttggagctgaaatagtctgcagaatgtagcttgaaaaccacggcagtgaactactaagggaaagtttcagaattcaagtctagacttcatcacttcatagctctgtagctttagggcaggttctttagcctctctttgtctccgtttcctcctgtgtaaagtagggataataaaagtatccatctcactgggatattttgataattaactgagttaacccatgtcaaacatttagaacagtacctgacacacagtaaatgctcaataaaaattacatattgntatattgctgttctagtttataagaacaggtgtcagaatccagttttgaaatgaaagcccagaactgtgagaaatgatggttttctctattagatgttctaggaaataaggaaacatcaagaataatacagccatgcttagaacaagttaaatatatgtccctcttggctttggactttctctgtcacttccgtgctggtcttnctctttccagnctcttcatactctaatctctggtctcagcttctacttggactccntngaagggatagaaaaaaaaaaaaaaaaactcgagcctttaaactataggggtcgnntacgtanancc

SEQ ID NO: 4694 - DNA, 840 bp, Homo sapiens
  misc_feature 12, 175, 302, 370, 447, 454, 460, 549, 584, 588, 607, 608,663, 671, 687, 712, 715, 735, 756, 784, 790, 793, 794, 814,818, 832, 840: n = A,T,C or G
ttcctacctgcnctggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtnctccagtcccaggtggagaacctgctccacagaacctactgtatgtggaagaacaagagtccctccccagtccatggggcaggcccctcggtcatggagatcccatgggatgatcttatcgccttgngtatcaaccacaagctgagagactggacgcccccccggcttcctgttcatcagaggcgctgagtgaanatggtcagatattgtgtgtatttttttaaaaacgatttgaaaaaatatgatgttcctttgtcgtgggaacaagccangttgcanacgcanaaggagctacagctgatagagggacgtttggcaataaaagcctttttcatccttctgcaaacaattttcccataccattgcttcacatncaccggacttggaagaggagcacagagtgtgcttnagangggaggattcccagcacannaggatctgattgcgaaggagcttttgctgagggagctctttggcgcagtggtttntcgagcantcttgcttgttggggnaaagaaagaaaaccaagagggtttnaanaatcagccttcaccaatggntggtttgaaagaactcaggangccttttacgggttttaaactttccttncccctnttnntctttcctcagacttttagnggtntctttttcacactnttggaacn

SEQ ID NO: 4695 - DNA, 841 bp, Homo sapiens
  misc_feature 418, 593, 597, 614, 645, 715, 731, 736, 779, 788, 796, 818,824, 825, 831, 840: n = A,T,C or G
tttattgacgggaagaggtcatctttttttccttctgaaaacaaatatggattaattgcctcaaatttgtataagtgattggctagtgattcttgttttcagaagggagagtggtatagatagaaaatgacaaagatggcaatatacacttaatgttgttattgtatgttgttactgaagtacttagatttttaaaatttcaaatcctaaatcacttcttgtaggagggttttcattaactgcagtatatacagttcactacatatgggttgtttgagttttttgtgtgctgtatttctttctgttttttaatacctggttttgtacatatctaactctgttctcttttggttgttcagaaactggattttttttttcttaagcagtgcttaatttgtgttttttaattttgattcanaagtagtcccagctcataggtgttcatactgttacatccagaacatttgtcaggctctctgtcagctttcatgtacatatggtatagaaacccatggagttaggcacttcctggattttttttttatgagaaaaaatctgtatttaaaatgtaaaataaacttttaaaaaagcanggcnctaatatatatttcttnccgcctttgattaccaaatttgtcccttgcncatggttaaagatgaaattatcttcctaaaaaatatcaatggttcttggggaaccagggggattgttacntttaccataaccaacnggttncctggcaatggggttcatggtcaaaaaaattttttgggttttnaaacttttnttatttgncctttggcttggtggattaagnccaagnncaaagngccgaattnc

SEQ ID NO: 4696 - DNA, 796 bp, Homo sapiens
  misc_feature 753, 760, 762, 765, 796: n = A,T,C or G
gataatgaaaataaaaattttgtgggctcttcatagtgggtactttgattatgtgtgataatactgtgctgtgacaaataatataatgaagaaattaataccaagattgctattctgaaagattaaacattctttaatacttagatctttcatctgtttatgtaacaaaccctaacatacaggcttaatgccttgcagatattaacttctttaacttaatctttgtaacagtcccatgaagtaggtctattattattacattttccatttgaggaatataagacataaagatattaactaccttgcccaacagctaattagtggtggagcctacttttgaactcagacactctggctctagactcttttcttttattaaccactgcactatgttacattgtttttttatttttaacttaagtgtgttaaccttgaatttgaattatgttgtattagcctggtaagtgggatcacagaaacgtgtccactgcctagatggtaagagatcatttgtctttcatctttgcatacttaacatcaaaatataaggaagaacaaaggaaatgttaatcttttaaagcctcaaagtataactccttttaaaatgctaatgattctggaaaatggtcagacctttaactgctttagttgaacattttagacaggagctaatatttttaacaaggatagcaggaatcatatgttttatttctgatccttgacaaagctgaagagttgcatcttcataagggnttcactntntgntacacactagactacttgcaaggggtgcccn

SEQ ID NO: 4697 - DNA, 827 bp, Homo sapiens
  misc_feature 17, 44, 57, 96, 183, 191, 261, 266, 272, 356, 461, 504, 521,564, 573, 628, 633, 639, 676, 682, 693, 695, 702, 714, 721,744, 751, 758, 766, 773, 783, 785, 791, 793, 795, 796, 797,798, 799, 800, 802, 803, 804, 805: n = A,T,C or G
gcatatgtgggaagtgngtgtcccgtccaggcctgtgcctcggnccacagcaactgnttcgtgtgctggagacgcccagaccgacaggcgaatggntcgagtgcacctcgatccgagtctcagcacctagactaattaggatgacctcagagatgctgaagagtacctttggtcagcctcagnctttttgnttttggttttttttgagactgtgtctcactccgtcacccaggctggagagcagtggtgcgatctcagctnactgnagcctnaacctctcagactcaagctattctcctacctcagcctcttaactagctgggatcacagacatttgccaccatgcccggctaagntttgtactttttgtagagacaagggtttgccatgttgccaagctggcttcaactcctgggctcaagtgatgcctgcctcagcctccaaaggtgttgggattacangcgtgagccaccgcacctggcctgttattttttaattagctgnggaatttttttttccanataaaatattataaaatttattaaaaactttatttctcaaganggggaacgnggaaatactaattccccaaatggttccttttacatctagaggtccaaattttccncaatngaaacntttctttcaattttcggtactttttttggttggtttngagaanggaagtcttgntnttgtctnccaggctgggantacaagngagcccgagaacatgccccctgnattccanctggggngacaaaancccgacntttttttaananaaaaanangnnnnnnannnnaaacccgggcctttaaaatttt

SEQ ID NO: 4698 - DNA, 826 bp, Homo sapiens
  misc_feature 277, 478, 479, 495, 531, 544, 561, 571, 577, 588, 614, 618,660, 670, 697, 701, 716, 732, 737, 760, 807, 809, 822, 826: n = A,T,C or G
ctgaaagggcagcgggcagaaaccgggctggggctggcattagctttccctcctcccagtttctctccagcgcagcagggcacctctagcccagaaaaagaaaactgactttctcttatttctgttttctgctgctgctaatctcctcctgaagggttgtgtggcttcttgggactctggaaagaaactgcaggggacgaggacaaaggaaacagctactgtagtcactgcagctatgcaggctctgtgctagccctggaaaggcctggacgttcangtctgctgtgccgggggtaggccccagaacagagcggtgggcccatcgctctgcaccacagctgccagggctcaaaccttggctctgccttacctggctttgggatcttgggggatgcacaggacactctgtgcctcaattttcttatcttgtaaaatggggcaaatacctaccaagtcataggggtgatgtaaagtctanntgagataatggagggnaatttcttttttttcttaacttaaattttggatccnttttgggtcgatntttgtatattggggggnaatttcttanaagctngaaagttattnaatgctgcttatgagccaaatactgngccnagggctcttgtccagatcattccagttaatcccacccaagancccaacagcncaaggggttgcttatatttttgggggngganggaactgggaacccnaggggaagtcacgggnctttngcccaaagttacccccgaagttnaagcgtttaaaaccaagaaatttgaacccccaagccaagcttgaccnantttggtttgcttnggcn

SEQ ID NO: 4699 - DNA, 812 bp, Homo sapiens
  misc_feature 469, 494, 500, 540, 577, 603, 614, 616, 628, 644, 674, 691,726, 730, 764: n = A,T,C or G
ctctcatggtaatgccagtcatgctcctcagtcatcagaaccagcaaaaatactcctcacatgtccttagatagttgcaaatgctccagagaggggtaatggcactgctcctacttgagaaccactggctcctgtaactgcttggcctagttctaacttctaaaatgttctcctttcctgagagtataatgaagagccagatactttgtgatctttctatcattcctctggcttcttggacttccttaatgattgagctcagatgctggagtcacatcgtctggctatgaaatcaagctctgccatttactgggtgtgaccttgaacaattacttaatctctccgtacctcagttttctcagataaaatggagataatagtgacatccacttatttttgtgaagatgaaatgaaataaagcatgtaagctggttatcacactgtccactggtggaggcatggtaattgnatgaaggggatgacgatgattgacnatgacnatgatgatgatgatggctcccaaccttaagggcttattcnagccagaacttgaaattgaccttaataatgaatactncaaaaaacacagacaggcacatgatntattagaaaangnagcaactacggngggagtcaagtaaatnctaaacaccctctgcctcaatctgtatggntttgaaatgtcctttanccgtcttgatttttacatatctatgaaaattttgnggtncatgggggttaaacaaaatggatgacttaagccnttgggaagtaatttcataaacaaccttgttgatatgtaataaaaaacc

SEQ ID NO: 4700 - DNA, 835 bp, Homo sapiens
  misc_feature 47, 160, 161, 220, 260, 349, 435, 457, 477, 480, 500, 516,519, 525, 547, 556, 562, 654, 682, 718, 734, 743, 749, 750,753, 763, 764, 765, 766, 774, 779, 780, 781, 783, 784, 785,788, 789, 790, 791, 792, 797, 798, 799, 800, 807, 808: n = A,T,C or G
  misc_feature 819, 821, 824, 827, 828, 832: n = A,T,C or G
ttgctttacattggtgaaaaaagtcatcatttcgaagccactcattncatcggaattgggagggccaccatcttatagctgggcttgtgaacctttgacttttcccagtatatattggactattttgatcactgctatatgcttctagttcctcaatcannatctgccacagaggaggccctctaaattttttgtggaattacttaatgaaatgaatgantgattattcgccttcacaggattgtgtgagaccatataangtgtgtagagcggtttgacctcccaccattgaaatgctccttaccattagcatctaaagtgattcactagagaaatgtgtgtgctctcntgacagtctgcttgttccaccttgctggaatctaaatccacgagaatcctgtgttcatttctctctaaagaataattacgaccatntaaggtaatagctaaagaatcnagacctgtaagaactcttancangtacagtggcctgtgcctgnagtcccagctactcangangctaangtgggaggattgcttgaacccntgagtttgnggctgnagtgccctatgattgtgtctgcgaatagccactgcattacagcctgggcaacataagggaggaccatgcctttggaaaaaacaaacaacttnttgggaagtctcctaaataacctatttnaaagaggtcaacaattttgcccggtggggttggcgnggtaaaggacaaaaanttgccattnggtttnnatnttttaaaggnnnnaggggggnggggnnngnnnggnnnnntaaannnngggcccnnggggcccattnanttnggnncccngtt

SEQ ID NO: 4701 - DNA, 772 bp, Homo sapiens
  misc_feature 5, 8, 9, 10, 19, 29, 606, 636, 663, 745: n = A,T,C or G
ggtgnttnnnccttgaaanctttatacanctacttgttctttttgcaggatcccatcgattcgctccaaggatcacagtaggatcctcgttggtgacagtcgaggccgagttttcagctggtctgtgagtgaccagccaggccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgangtggttcctaggagcaacactttcgacctncagtcttcctgatgacagtactgtctncaagagaaaaatcctcacttattaactctcttttcttgcatctcattttatagagctactcatccttatttggaaaaaccancaccaaaaaaggcttttagaaaatggt

SEQ ID NO: 4702 - DNA, 820 bp, Homo sapiens
  misc_feature 131, 608, 621, 656, 657, 658, 659, 660, 661, 662, 663, 664,665, 666, 667, 668, 669, 670, 671, 672, 673, 674, 675, 676,677, 678, 679, 680, 681, 682, 683, 684, 685, 686, 687, 688,689, 690, 691, 692, 693, 694, 695, 696, 697, 698, 699: n = A,T,C or G
  misc_feature 700, 701, 702, 703, 704, 705, 710, 711, 734, 737, 741, 744,751, 758, 785, 791, 796, 804, 815: n = A,T,C or G
ctctggctcttggaaaagggcagtgtctctaaacccaggcaaacggtaaatgtggggcataggcaagagggtcccgggtaggtggccacttccccatcatgctcgtttctcattttgtgttttttagtaanaaaaacacagtgtgttcttttgcccagacattaatctttagaatgcctgtattttctaatgttgggatttctttcacaaccacccaccttaatatttccattgtgactcagaaaatcagacttcattcgattctttagagaactataaatactgttgtcagtagagtgaagtcttgtcttatgtaatcctaattacagaatgtgttctcagaagaggtaggctagaccagagctgggcagaccacaggcagaggccaaatccagccccctgccgatagtagctaatataagttttacacccacttgttcatgtattttccctggctacttgtgggcagcaatgccagagtcaagtcatcataacagagacagaatggcctgaaagctggatttactatttcaacttttacattaaaacttgatgacccctgtgctagacaggcagctcatttctgcaggtaaaattatattcatctnccaactttcattncaaaattgaacctatattactgaggcccaaaaaannnnnnnnnnnnnnnnnnnnnnnnnnnnnnnnnnnnnnnnnnnnnnnnnnccctnngccctttaaaaccttttgggggncgntttnccngaacccnccctganaaaaaaccttggtggagttgggccaancccccnctttnaatgccgngaaaaaaattnttttt

SEQ ID NO: 4703 - DNA, 777 bp, Homo sapiens
  misc_feature 5, 26, 586, 596, 682, 709, 711, 741, 745, 760, 761, 766: n = A,T,C or G
ggtgnttcccctttgaaaccctttanacaagctacttgttctttttgcaggatcccatcgattcgaattcggcacgagggtgggcaggcagctgcacctcattcctgagaccatccggggcagggcttttctgactgagacacacgaccctgacaccagagagaattctgtatttccccacccttgcaggggctgcccctagagaatcccatcgggtgagcccaggaacccacaagttctgcacccctcggatgggtaggcattttgagggcatgaggtaggcgttacagtgataagatacacagggctctaaaccacagaggccccggttcaaatcctgcctcttctaagtacaaattagttggctttgggaagtgagtcaactttgccccgggctgcagtttcctcgctgtcaaatgcatgggagagggtgtgtgaagagttaaaatgtatttagatttcactgtagtgtctcctccaacatgatctcacactccttttacagtataagcaggctgatgtcagaggctgtgactcgccctgccaggtctaagaccgtggggcgtggtcacaggtactattttangactcctctnaccacaggcactgaacttggggcttgcatatatatcaccccattactcctcagaagatactgtaacgtaggatcttttattggctntattgaggcttaatgcatccattttangnggtacaatttgatgagttttgacaaaagtntaancttgtaaccacaatnnccganttcatgacact

SEQ ID NO: 4704 - DNA, 765 bp, Homo sapiens
  misc_feature 2, 3, 4, 5, 7, 8, 9, 20, 28, 654: n = A,T,C or G
gnnnntnnnccttgaaaccnttatacanctacttgttctttttgcaggacccatcgattcgaattcggcacgaggacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtgaccagtgccttccaggagtcctcagccctggggactctgactcaattgtacctgcagctcctgccatttctcattggaanggactcctctttgggggaaggtggatatccaaccaaaaaaaaaaaaaaaactcgaggcctctagaactatgtgagtcgtattacgtagatccagacttgatagatcattgt

SEQ ID NO: 4705 - DNA, 771 bp, Homo sapiens
  misc_feature 3, 4, 7, 8, 9, 26: n = A,T,C or G
ggnnttnnncctttgaaaccctttanacaagctacttgttctttttgcaggatcccatcgattcgaattcggcacgaggcgagactgtctcaaaaaaatcaaaaaaaagaaaggggatgtaaaataatcgctgcaagttacagtgtttttcattaatgacttccaaatgtctcacatgtattgtctcttcccagtagcataaacaaagatgcagggaggtgcaatgagttcctacaggccctagagctgacggtaggggtgggaatacagttcacaccgcgtcttcagctgtgttccttgtggatgacatccactggacagccaattgataaaaacagttatcagttctaaagtgttaggacaattacagcttattcaaagaaaactcaattaaggaggagttagtaaagctagtattgttcttatcgtgtgcaatgctgcagtgtcggctcactgcaacctccatgtcccaggctcaaatgatcctcccgagtagttgggactacaggcatgtgccactatgcttggctaatttttgtatttttttatagagactgggttttgccatattgcccaagctggtctcaaattcctggacgcaagcctggatttgcctggctgccatttctgggttttgccgcaattcagttttttatgacaggcagaccagtgagtagaatacagttctttggataaaggacaaactgaagcactaaaaatggagagtcattttaaagcaaaaaccagtggaaatgtgtacttggcttcacc

SEQ ID NO: 4706 - DNA, 707 bp, Homo sapiens
  misc_feature 5, 8, 9, 13, 14, 105, 653, 686, 691, 692: n = A,T,C or G
ggtgnttnncctnngaaacctttatacaagctacttgttctttttgcaggatcccatcgattcgggaaaaataacatgttcactttatgaaaggaagaaccaggnaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtcagtgatttgtccagaggggggacttaagtctttggtaaggatcgccaacagctggaaagtatttattgcataaaatatgtccatgatactttaccaacattgtagagaatgtaagctataaatacagttatattacaaagagtttacaatctaaaattaaacacaagaatttacggaaaaatcaccaaaacaaattaaatggaaatatcatttcacaaggttctttaatttttggccatatatttgataataaatacatatgtgttntagctatcttacttctcttcttattctgatttnacctnntgtggtcccctgctg

SEQ ID NO: 4707 - DNA, 621 bp, Homo sapiens
  misc_feature 3, 4, 9, 13, 19, 21, 46, 50, 53, 62, 64, 74, 77, 79, 80,95, 96, 123, 127, 130, 132, 150, 151, 154, 155, 156, 158,165, 183, 188, 193, 194, 203, 206, 210, 211, 227, 232, 233,234, 235, 244, 249, 250, 257, 258, 259, 260, 262, 263, 279: n = A,T,C or G
  misc_feature 283, 285, 309, 319, 344, 355, 370, 375, 380, 391, 397, 435,455, 474, 477, 488, 491, 505, 513, 540, 541, 555, 556, 571,572, 583, 599, 610, 612: n = A,T,C or G
tgnngggcnaganacccgntngggctgcaagggccggcttgacccnacgnatnccggggcananatgcctgtcnagncnncaaaggaaggttgtnncgctttacgcctattggtggaaaaaancccnttntngaaggtctatcctcaaanngcnnntngcgttcncccgactggccgtttatncaccnctggnnaagaggganttnattnnacccgctcttttttanaagannnnaaaggttcngcatnntggggcnnnngnncacactggctttgaanagcnanagctgagtgacatccacccagatncaaaatggtnacatgtcaactgtggccgaaaacgnggccgcactgncccatccgctcttcnggagnttgtnggccctttatncgcacnaaattgcagcctgccggatactgtattcacacaggctntgaggggggagggattgttntcagaatgcattaagcgcnttnaatagcctgcntcngttgctttgtcaantggtcttnacatgaatgcccgtcccctgaatatcnngtaatcatctatcnnacctgggatcgcaanncgttaaaacanaagggcaagtgacggnggtcgtactgngnaagagctcc

SEQ ID NO: 4708 - DNA, 790 bp, Homo sapiens
  misc_feature 3, 5, 6, 8, 9, 10, 11, 12, 13, 21, 26, 27, 441, 457, 518,594, 683, 698, 717, 738, 740, 771, 781, 785, 790: n = A,T,C or G
ggngnntnnnnnntttggaantctannatacaagctacttgttctttttgcaggatcccatcgattcgctcagccccccagtttttatgtggacatgttttcatctctcttggatatatacctaggagtggaattgcttggttgtgtggcaattctatgtttagcattcgaagaaattcattgaatggtaagctgaaaagtgacgtggttgaatttctgatttcagaaagatcactgatgtgatgagaatgaataactctctggagtgctaggatgtgggggcagggagctagcttagtatattattgcaaaatcttgccaaagatgagctgatcaaatgagaggaagcatgaactaagaggggagcagcaggagtggaaaagagagatataatgatgctagtacagagtttatatttacagaacttgaaatgcagctcangagtgggaggagtcangtggtgccaagcctacataaatgagcatggtgttgcttttgacaaatagggagaagcaganaggggaataacattttgtagtttcttaatttctaatatgtcttgagataggtctctaattatatgcagctcaattnacagatgaaagttattggtttatcatgcattcatctttatgaaaagaaaggattcggccttgcttcttccttggtaccaaagtattggncagggcttgggcacngtggcttacacctgtaatncccagcgcttttgggaggctnangcaggaaaaatccttggaccctgggaaggtnaaggttccantgancccan

SEQ ID NO: 4709 - DNA, 766 bp, Homo sapiens
  misc_feature 2, 9, 537, 647, 707, 712, 742, 766: n = A,T,C or G
ancctttanacaagctacttgttctttttgcaggatcccatccgattcgaattcggcacgagagtgactacttagaagatgctgtccccaccttcgccccctccctctagttgcccaaatgtcttacctcccccagcttcactcgggctagtggaggtcttcttagacttctttcaaggcggaggatttagagtctggggtgaagtggcggtgatggatggctggggacgtggggctgctgactcaatggtgatacatcaagcagttaattaagggacaagttatcttctaagtgggaggtaaaggattttctgttcctttgttcttaatgctcatattaatgccattttccctcatggagacctcaggctgtgcttaaaacgcttccataattccttttggcactgctagaggtcagcattgtccactcgtgaaggacacaggtaagtcacagacattggggcttctggttgttaaaggccaagaatgtgggatgaaaaccccccgtgtccccatagcaagttaggggttgctcancagggctgttttcattcagacaagcagctcattccaaaccagccccagagagccgcttcaataagccattgtctgcccaaggaggaagaactgttgtccaaggctgtggntaatgcatgacattggtagttgttccaacaagtcaaaacttggttacagaaaagcagcantgacnaggatcttggaataaatgccttggacccangtgccaaggaattttccacgcatn

SEQ ID NO: 4710 - DNA, 1154 bp, Homo sapiens
  misc_feature 29, 38, 45, 50, 146, 157, 214, 229, 240, 253, 260, 267, 272,306, 316, 320, 340, 361, 390, 429, 458, 475, 481, 494, 513,537, 562, 572, 576, 588, 594, 614, 615, 651, 652, 660, 670,695, 702, 706, 708, 716, 720, 726, 730, 739, 779: n = A,T,C or G
  misc_feature 789, 794, 823, 833, 864, 868, 877, 882, 913, 931, 943, 959,984, 991, 1006, 1014, 1037, 1057, 1058, 1066, 1087, 1111,1112, 1115, 1125, 1140, 1141, 1143, 1153: n = A,T,C or G
tattgatctcacctgctttgagtccatcntcaattcgncaagccnggtcnagagtaactctgcactcctagctgggttgccttaacaagtctatttaactttttcttagggtatttctaagagagttccaaaatggaaaaaaaatnctatggtggtntggaaattttaatgaataataaattcccattttaaggttaaaaataacccaaaaaantaaccacctccgtantccattaagancattttaggaagnaagtttncctttanctttnggggaaaaagggtttttccaattttttccccttnaaaatggganccanttccaaccttgggaaaaaanccaaggcccaagggggttaanttggaaacccaaggaaagggggggttttnccccccccttgggaaccctttttttgggaaattaagggnttttttttaaaaaaaattttaaattcccnttttaaaaaattttttnaaaatnccccccttccctnggggttttccccccttccnttgggccccccttttggggggggnccctttttaaatttttaaaaagggntttttttttngggnaaaaaatttttnaaaaanggggggggggtttttaaaanntttttgggggggaaaaaaaaaaaaaaaaaaaaaaannaattttanttttaaaaancccccccagggggggggtttttttnaaaaaantttnancccaaaantttnccgggntttnaaaaaaatnaaaaaaaattttccccaattaaaaaataaattaaattttnttaaaaatanccccncccctttaaaaaaaaaatgggaaaaaaantttaatttanttttcccccaaaaaaaccttccaattaaaantttnaaaagtttnttggnaaacccaaatttttggccaatttttggaaanaattttttaaaaaaattnaaaaagcccctnaaaaccaattcggggnccccctttcccctttctttcaaatnaaaattnaattttcctccccgnaaaggggnccctttttcctttccctttgganggggccttgggggaagcccnncccaaggncccttttggccagcccccggnaaaggggggtcctggcacccttannctnggggtttttncctttccccctgggnnanggggcctggna

SEQ ID NO: 4711 - DNA, 917 bp, Homo sapiens
  misc_feature 12, 254, 259, 353, 424, 518, 527, 539, 551, 583, 617, 623,638, 658, 662, 670, 678, 679, 680, 681, 682, 683, 684, 685,686, 687, 688, 689, 690, 691, 692, 698, 707, 715, 727, 735,737, 748, 753, 758, 763, 770, 776, 777, 800, 828, 837: n = A,T,C or G
  misc_feature 843, 861, 866, 873, 901, 911, 912: n = A,T,C or G
gtgattccattngatacagctacttgttctttttgcaggatccctcgattcgaattcggcacgaggatcacaccactccactccagcctgggcaacgaagtgagaccctgtgtcaaaagaaaagaaaaagagaaaagaaaagaaatctgaaggtcttgacaacccttggtcccccatcctcctatgactttgggacctaaatcagagctggccctctttgtaacaagggtgtgggcccctctatttcactgtantctgntttcattccctgcagccctccttgatacgaaagatgccagtgacagggccaggcacttgtggctcatgcctgtaatcccaaggaggccgaggcngggcagattgcctgagttcacgagttcaaaaccagcctgggcaacacggtgaaaacccccggttcctttcntttgggcccctaagatacaaaaaattaccaggcatgttggtgcattgccttgtaggtccccaactactcggggaaggcttgaaggccaaggaanaaattggcnttggaaacttcnagggacaacaanaaggcttgccaagttggaagaacaaaggaatngggtggcccacttggcaattttcttaagccccanggggcntttccagggaagccnaagggaactttcttggttcnttcnaaaaaaanaaaaaaannnnnnnnnnnnnnngggggnccccctttnttttaagnaaaaaccctttnttttaagntngggaaaggttncccgnttaanttttnaaccccntttaannaaatttccccccaggaaaaccantttgggatttaaaagggaaattcccccntttttgggnattggnaaaattttttttgggggnaaccnaaaaaancccccacccaaaaccttttaggaaaaantgggcccaannttggg

SEQ ID NO: 4712 - DNA, 847 bp, Homo sapiens
  misc_feature 12, 16, 74, 80, 119, 194, 202, 207, 210, 248, 265, 317, 325,402, 405, 442, 456, 463, 503, 534, 555, 570, 589, 603, 615,652, 655, 670, 672, 677, 681, 703, 704, 764, 785, 799, 811,815, 829, 836: n = A,T,C or G
ttgatttccatncagntactgctattgttctttttgcagtatcccatcgattcgaattcggcacggaggtgagnaacggngaatacgggtaaaacccttggctcatggaaagcatagcncaacataaaccttttaagcaaaccagcgcagagttcccgtcataagtggccaccatcttcagaaaccagggctcntgggtgtntccanaantttgccaggaatttatgttactttaacccactttggtngggggaaaagcttttgnaaatagaatcatacatgcatttggtttttaattacagtgccgttggcccatnaatggggnttaaatttatactggagcacatgggcacccatatctgggggtttccctcttgggtcaagggccccccattggccaanaancagagtctaaaggaaaatcttgaaggttgaaaaaccnttggggggaaaggnaaaaaantcaaaattcccagtggggaaaaagaaggaaaaatagggangggcttaaaccttgcaaaaaaattgaaaaanttgaaggggtttgcttggtcnaaataatcttggaanggggcccctttttcttgcnaagaaggaaggtgnaacaatgggagnacaacatttcaaattaaaccattatttggtaaaaacnttncttaaaaagtcaatngnccatnccanaaaggttggaaatgggaggggnnggtggtttctttccgttccaacttggggagttcttggccaaaacttttttggaaggggcnttgttttctttttggaaaagnaaattaaaaggttnttttgggaacangggncaatttggagtttntggaatnccccaatttta

SEQ ID NO: 4713 - DNA, 661 bp, Homo sapiens
  misc_feature 1, 12, 13, 15, 19, 27, 31, 110, 194, 218, 240, 256, 264,265, 281, 299, 349, 394, 474, 487, 567, 579, 599, 641, 661: n = A,T,C or G
nttgattccatnntntacngctcttgncttntgcggatccctcgattcgaattcggcacgagatgaatgtggaacttttatttttatccattattttcaaattggatcantgtcctcctgatctattagatctaagacctaagaggaacctaccttgttttggctagcgggtacagactttcttactaaaaggngggtgtatttcctagaatagcatnttctgttgagtagagatgattntcaacaatgtggctgngtcacttnncttcaaagtgattatngagtgtgaaagtaagcanttgtaatactttttaaccactgtctgtgttcttaccagatgggaaaacancactcgtcttgaaactggaagttcccagtcctgggatgatctganaaggttttggaagggaaaaaccccttgttagagatattgcagttgcatcacacaccagcttgggtgctgcctaggatcanctgctcagtgaanagtactcttgctaaaccttacaccacccagactatgcgatttggataagtaatacttatcttgacctgtgttcttttgangggaaagaatgnctattgggtaggattattgnaaaatgagatgagatatccttataaagttttagcatgatgcngcctctaataatctgcatcn

SEQ ID NO: 4714 - DNA, 803 bp, Homo sapiens
  misc_feature 29, 30, 129, 352, 408, 435, 475, 476, 494, 513, 520, 527,530, 534, 535, 539, 542, 562, 563, 564, 573, 577, 581, 584,595, 600, 612, 622, 623, 634, 635, 638, 639, 640, 655, 657,676, 677, 683, 692, 700, 706, 707, 721, 722, 733, 737: n = A,T,C or G
  misc_feature 738, 739, 760, 778, 786, 789, 790, 803: n = A,T,C or G
ttgaattcaatacttgattcgattttcanncttggcgggatcccatcgattcgaattcggcacgagagtgctgggattacaggagtgagccacttaggctagccctgaaatgcttttgtttttgtttgngttttttgttttttaatgaaaatacagggacatggagatgtggaaagacaccttgctttattactggtgttattattattattactacagtataattcatgtatcacaaaattcacgatttttaagcatacctttcagtattttttactatattccaaaaagttgcagccagcagcactacctaattccaaaatatttcataatgccaaaaagcatgcctgcnctattggctgtcactctgcaattcccccttcttgcaggctctggacccaacccccncccctttaaaaaaaacttctttctttntgtatagatgtacttggtctggggcaccttcctctttatnngaaaaacaaaatgggggngtttttggggtttgggttntcaaaanaaagggnccncaannattnaanacccttttaaaccccggccnnnaccctttanaaantttnttngggcccaaaanaaatntccccccttatngggggtaacnnccaaatttggnnggnnntaatttcccaatttnanaaaccaaagtgggtttttnncccccntttttttanaaaccttntttttnntggaaaaataaaannggccctggccntaannnaaaaacaagccttttttggcnaccaattggttttttttngggaggtnggnnaaaccattttttn

SEQ ID NO: 4715 - DNA, 834 bp, Homo sapiens
  misc_feature 4, 12, 18, 31, 33, 34, 35, 147, 186, 187, 249, 256, 262,294, 307, 355, 368, 388, 405, 413, 433, 440, 444, 486, 531,536, 573, 612, 618, 648, 649, 660, 714, 722, 726, 738, 764,781, 783, 784, 785, 787, 789, 792, 799, 801, 802, 806: n = A,T,C or G
  misc_feature 809, 814, 815, 817: n = A,T,C or G
cttnttctactntttctncctggaaaaccgncnnntgcaggacccatcgattcgaattcggcacgaggggatttgaatgcccatgaaatacatttttttttacttgaatatattcttgcttcactttaccctccataatatgttgtncattagtgctgatcaagtttacagagttacattttgctnncctaaccattcaggcaggaattaaaatatggcattgttaacaactgggaagaagctcatagnggatatnaattanagtagataatgggtcaccttgatagcctctgnttacatcacttgnatatgggcaaaataattattacctatacgtgtatttaagcttaatttncatataaacagtnttttgaatctatgctaaaanagataatatctaaaagngtgatctntacgtagtccttagtttatnagtctgnactncaaaaagattcttaaataagcccggcacggaggctcatgccngtaatcccaacactttgggaggctgaggcgggcgaatcacctgangtcangagttcgagatcaacctggccaacatggtgaaacccngtctcaactaaaaatataaaaaatagccccggccgtggngggcangcacctggaaatccccagctactcgggaanncttgacgccangaaaaatcacttgaaaccccaaggggcaaaaagctgggagggtaagcccaaaanccgcattnattnggacctcccaancctaagggggacaaagaaacgcgagnacttcaatcttaaaaancnnntngncanttattgncnnaaanggnaatgnngncccggaaaaaaaccccc

SEQ ID NO: 4716 - DNA, 970 bp, Homo sapiens
  misc_feature 4, 523, 539, 549, 576, 580, 597, 622, 626, 673, 674, 686,693, 704, 726, 730, 748, 756, 770, 775, 798, 801, 821, 834,856, 859, 868, 877, 881, 885, 886, 900, 909, 916, 922, 926,944: n = A,T,C or G
tgtnagacgtttcaaggtcagtgtattagtggctcatgcctaggggaaggaataacatttggagcaaacaggagacaaattgaaaagcttcaggaggaaaggctaggaaataagattctttgggcgagaataaggactttaaagagattccacatattcctgggaatctgaaagaccatacacatgcctagggctgggcatgtgcttaaaaagacttgagagggccctatgctgtcacctctgcctgaccttcaggctctgtgcaagcaggaagtgaaggctaaggcatagttataaactgcatgggtgaaggttgaaaggtgtgtcccaacacagaacacatctgcaaatgctacgaggcattttgttgttccaagtgttcaaagaaatcttttgaatcactactgaccactaagctaaccaaagacttagtggccacacctgacaaagaatacaaactaaaaaactaaaaatgtagttcaagaaaataacaggctgggcacagtggctcacatcggtaatnccagcacttttgggangctgaagcangtgggatcttctttgaacccaaggacntttngagaccagccttgggcnacattggcaaaaaacccccatcttnttgnaaaaaaaatactttaaaaaaattttgccagggggccctgggtgggcnnccccacctttantaggttncccaagctttncccccaagaaaggccttttaanggtngggggaagggaatccaancctttgancccctttgggggangggtnccccagggcctttttaaattggnagnccccattaaattcccttggncccatttgggcanctttccaaacccctttaggggnggnaccacccanatgggggangggnaaannaaaaattttttaantttttcccnaaaaacntttggncccnccattttttttaaaaatnaaattttttttccaaaaaaattggtt

SEQ ID NO: 4717 - DNA, 807 bp, Homo sapiens
  misc_feature 328, 536, 553, 563, 568, 607, 647, 680, 690, 712, 788, 804,807: n = A,T,C or G
actgaagctgccaggcaagtgaggaaccaggagccgtcactgagtgtggctgggctacatcatagctcatcacggagctacgactttgggtactgcggacagacctggataggcccagcattcgttctgaagatcacagttcacagaagcttttgcttcgtaaagataatccaaaggacctgagacccgcttttccttttcccttcattcccttgagagtcagccataaacggaatacctgctaggttccaggaatgagctcacctaacagacagcaaatgtgtctggttagatctcagcagagcccattctgcaagacctggctganccagatgagagggtgggccctgtgctggggggccttgggtcacacacaggaaccaagacctggcttccaccccccagtcacccacttgggttatctgctggaagttatcgataggactgtgtggccaaccaagtgcttgtgagatcactgacactgcaaaaacaaagcaaactgctccgggtaccaggacttccttcaacctggcaangggtgtgcgctgaggcngggcttgcangtganggggctgtatgcttcaggaactaactaaaatgcatgcanaaggtaagaggcatgatgggaggtgttcaagcacacaatnccatttgggaggttattttgatactgcgatgantaagggtaanggccccatggaatggggctaanggtgggagtgaacactggggtgaataaattttaaatcaattcaggtaaaaaaaaaaaaaaaaaactcgagcctttnaactatagggggcgtnttn

SEQ ID NO: 4718 - DNA, 461 bp, Homo sapiens
tatccatcagctcttgttctttttgcaggatcccatcgattcgaattcggcacgaggagaaaagctctcaggtaatctgtatggcttataagggaaacctgcagtcctttctgaaaggggagctgtgaatatgactgctttgtagaaagatgtcttaggattctgggtgaaaatttttaattcccctcatgtaggaatgtcacagagtgtacctttttgacttagtattttcctagtaaaatacacctttcttaagaaaatggctacaaagtcagatgcatgtaaatgctttcagcaagggtttattgatcatctgctttaggctgggctctatgttaggtgcctgtggattccattctagtacctgtgttctcatagaattgaatcctggtcccccatatgacttttgatgatattcacactgttaattccaataaagacagagtagacaaacagaaact

SEQ ID NO: 4719 - DNA, 833 bp, Homo sapiens
  misc_feature 379, 514, 525, 538, 558, 650, 653, 680, 685, 689, 713, 729,736, 737, 750, 762, 773, 799, 816, 830, 831: n = A,T,C or G
cttggtgaagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcanaggtggcagggccctatggagcaccaactgccctcaaccccaccctgtgcccaagactgggaagggattgatgtcaggctgtggccataggtagcatgagttgcccaaggagggacagagcatatctttgctgangcttggctgangggcttatgatanggcttgcagtacctcacaancccctgtgggcacaagacaccctgaggtttacccaggccaaatatatttgattagcagggaaaaaaaaaaaaaaaaaaaaactcgaaccctntanaactataagtgagtcgtattacgtaanatccngacnttgaataagaatccattggttgangttttggacaaacccncaacttnngaatgcccgtggnaaaaaaaatgcntttatttgggnaaattggggaagcctattggcttttntttgtaaccattttaanctgcaattaaacannta

SEQ ID NO: 4720 - DNA, 833 bp, Homo sapiens
  misc_feature 275, 425, 531, 602, 603, 605, 608, 610, 611, 612, 613, 614,615, 616, 618, 619, 620, 621, 622, 623, 625, 626, 627, 628,629, 632, 633, 634, 635, 636, 637, 638, 640, 641, 643, 644,645, 646, 647, 648, 649, 650, 652, 653, 654, 655, 656: n = A,T,C or G
  misc_feature 657, 658, 661, 662, 663, 664, 665, 666, 667, 668, 669, 670,672, 675, 676, 681, 682, 683, 684, 688, 689, 690, 696, 697,698, 703, 705, 711, 712, 713, 714, 715, 716, 717, 718, 719,720, 721, 723, 724, 725, 728, 732, 733, 734, 735, 737: n = A,T,C or G
  misc_feature 738, 739, 743, 745, 747, 750, 751, 752, 753, 754, 755, 756,766, 770, 771, 773, 774, 776, 777, 778, 783, 784, 785, 786,789, 790, 791, 793, 794, 795, 796, 797, 798, 799, 801, 802,804, 806, 807, 810, 811, 812, 815, 816, 817, 818, 819: n = A,T,C or G
  misc_feature 820, 825, 827, 828, 831, 833: n = A,T,C or G
gtttgtgggtgaatggtttcacaccagagtgggatcctctattgcatgtactcgactagcttttcattcttatcacacttcccttcctataaagttacgtatcttttaaagggaaatttaatacccaccttcgctttctgtgcggccttgtgaaaatcaggcaataacaaggacagccttattgccagtgtatgaccagagcatctagatggcactactagtggaatgtcatcttgtctaccattcattcattcattcatgattttctctaccanacagttttggaactcctagaatgggtcaggtggtaggcaggcattgggaaaacaaggttttaagccattgtccaaatcctcaaagaactcaccattttggtcgaggggccatggtgagaggtgtatagaacaaagtaagaaatgctgtangagcagagagagagaaagaggcccagagagcacagtggcagagtacatctcatccagagaaacagcatcctgcatcctccagagtcctggttccttcagtttcatnccctttcttcttcttccatggattatgtaatacattgtaaaggttttaattaattaaaaaattgaaaaaanncnaancnnnnnnntnnnnnngnnnnnttnnnnnnngnngnnnnnnnntnnnnnnnccnnnnnnnnnntnaannttttnnnntttnnnaaaaannnaaaancnaaaggnnnnnnnnnnngnnnttngacnnnngnnnaaantnanaannnnnnngaaaaaaaanaaannanntnnnaattnnnnaannngnnnnnnntnncncnnccnnnaannnnnnggaantnnaanan

SEQ ID NO: 4721 - DNA, 1213 bp, Homo sapiens
  misc_feature 6, 9, 14, 50, 54, 60, 65, 69, 136, 150, 206, 230, 252, 271,281, 311, 320, 325, 328, 347, 350, 352, 366, 424, 433, 469,489, 495, 550, 554, 703, 869, 966, 996, 1022, 1049, 1058,1066, 1120, 1135, 1138, 1148, 1152, 1166, 1185, 1197: n = A,T,C or G
  misc_feature 1207: n = A,T,C or G
cctttnaanggggntttttttttttgggggtttaaaaaaaaaaaaatttncccnaaaggnccccntttngggggggggggaaaaattttttttttccccctttttttccccccccttttttttttttttttaaaantttttttttccccnaaattttttcccccttttttttttttaaaaaaaaaaaaaaaaaaaaattttttttnaaaatttttttttttttaaaaaangggggggttaaaggggtttaanccccaatttgggttttaangggttttttnggggggaaaaaagggaaaaaaaccctttanccctttaanttttnaanaaaaaaaaacccccaaaanttnantttaatttgggttngggggggggaaaaaaaaaccctttttcccccagggccccccccttccttggggggttnaaaaaattngggtggggtgggtcccttccaaaaaaatttttgggnttccttgggggaaaaaaagnaaaaanggggggggggaaaaaggtcctaatggaaacccgaacttttttcaaacctgggccnattnccatatacccaatgggttaaaactttggattcttatgacatattcctatgaaaataataaatactggccttttccttgcagaaagcctcagacctgaatcagagaaaatcatatgccaaagccaactgccagtgttagacctctttttncataaagagtaaatgggaatgctaacactagtgggcttattgagaaaatttaaagggtgctgtagtgtttagaacttaggctggaaaaccatattttagtgcatcattttactacatgatcttccaattagatagcttgtaatctggtccttacagcacttgctgntggtacatgtgaagattttataaattttaaggaaaggtgtctatgatatatagtgaaaagtgtgggaaaagaatatagaaaataatattcacttctnaaaccattatgataaaaatatttgtgtatnggattaagaatagaaaggggattatnggatggtatctatttcaatttctcagnttatggttngggccttnccttttttggaaaggtacccctgggttattgcctattggaataaaatggatatnaatggggtaaaaaanttnttcaaaaggncccnaaaaatggaaaatnccaaaggaatttcccttcnttttggacctanttttaagggnaaaaga

SEQ ID NO: 4722 - DNA, 972 bp, Homo sapiens
  misc_feature 97, 188, 197, 236, 256, 261, 301, 303, 322, 335, 405, 409,413, 415, 431, 437, 442, 457, 481, 504, 521, 527, 582, 588,604, 650, 657, 660, 664, 693, 702, 723, 739, 761, 773, 776,779, 795, 799, 806, 810, 820, 826, 833, 838, 863, 886: n = A,T,C or G
  misc_feature 894, 903, 919, 922, 934, 954, 958, 971: n = A,T,C or G
tccaccctgactcagccttggtgcagagtgagactctgtctcaaaaaaaaaaaaaggaatcagtttgggtcttggcagaaatcaacataagggaatntgacaagaaccccagtaggtaaccctgagtgctcaaggtccgagcctgtgggtctcttttacggcttcatgaaaaggaccgtgccctcacnggagggggnacccaccggctttgggctttgtggggggtcttaaggtgnatggcttgcccttctttttnttcantcaacccacaccccaagctttttttggcttgggcactttnangggggaaagaagaagccancccaaaatggagnaagaattttaacccttttttaatcttcccccaaccggaagccgaaaaaatggtttttcccccttggtttncaanaagnangggaaagttaacccantccccntttantgcctttggaacctngggggggttttccttttttggttngggttgggttttgggtttttttnctttttcaaatttgggnaaattncttggtaatttttaaaaaatggtttattggtccagccttggaacaccattggggnacaacntccttgaaaaaaggtngacttgggcccccccccccctgttttgggccggtgaagttttccgnaccaccnggncttnaaaaagtggtcccttcttgctttcgtctntttgtttcncttgcttttgtaaaaactttnggtcccaagcttgaanacattggctttgtaaaaacgtngaagagtcaatnccnaangggggttatttgtcanaaanaacttgncctntgccctttanccgaangcagtcnaatcntgccagttggatttttcttactggnggaatgacaagaaacagggattnattttgcncttgcgganaattttccgggagtgnctntttaatattttnagacccgattctttgacatnttanttgactccaaaana

SEQ ID NO: 4723 - DNA, 884 bp, Homo sapiens
  misc_feature 420, 455, 458, 526, 595, 614, 617, 624, 630, 647, 660, 664,695, 715, 730, 747, 755, 791, 797, 798, 823, 833, 837, 858,862, 865, 869, 877, 884: n = A,T,C or G
gggtaatattttgttttataacagtgattcagtatatctgaattatggattatatggccatagaactacaagcaaaaaggatacacaaacaaattttgtagttaagacaaatctgttgcctaagatcaagaaatgtaatagatggaggccatgtagaggttagaaattcaaagaaatcgaggtcaaaaactggccaatcataacggcatagggattagttcctaaatttggtcacttgagaataacagtgtgaatagagtggagtggaagatgtgactggtgttgtttctaaaaatgtagaattgtcctcttagttggggtctaggtagtttttgagaggtgaatatagacactaactttttgttttacaactgaaatcaaattgattggtaatttgcaacaaaatattttttgaccccnccatttatatcttaccatgtatattattttcactnggntgataaagcctatgactacctcgtcagaatacatcatttgctaataaattagggtttactggtactgntggaaataacccgtggcattctaccctccgagaatcctgttcaggtggctgcaccctttcaaaatccantgggcgtttggccatttgnaanccttgtntttttnccgggggaaaccaccangggtcaagtttanttanggccttggcccagttaaggcctggaccgttntttccccaattttgcttggntttggaaatggaatngggttttcatttaattnaaagaaanttgcttgttttggggccccatggttgtggaaaaagnaattcnntgaaattgggccggttttgaattanttttaaatcnttantccttaagaaaaaaaattttngaanccntttngggggccnttgtccn

SEQ ID NO: 4724 - DNA, 998 bp, Homo sapiens
  misc_feature 3, 12, 14, 18, 28, 43, 52, 67, 98, 116, 131, 182, 185, 188,262, 917, 946, 978: n = A,T,C or G
aanaaaattaangngaancctttaaaanttgggcccttgggancccaatttnacccaattttttaanccccccaatttgggaaatttaaaaagggttnccaaaggaaaaaatttancctttggggggaaangggggcccaaaaaaaaaaaagggaaaaaaggaacccttcctttgggtttanggnttncctttttcccccaagggggggaaggggggggggggggggaaaaaaaatttgggttccaacccaagggaacccanggggggaatcccaagggggaagggttccaatttgggaattgggaaccccttccaaggcccaaggcccaccttttctttgggggaaaaggccccaaaaacccaaattggaaggggccaaggtttttttcttttcaaaaaggggtattgaaaaagaaaaaaataaattacttggatgccagccttttcttttttaaccaaacaatgaatgaagtgtgaagatggaatcaagataagttcagaaatgcatgactttaatacatgctaatagtggagatggtgcttaaactaaaaacagaagtcatgtgatccaggacgcacaatcctctggctgatggtagaatttgatctgaaataggagacatgctgtgaaaccagtctaggatggaacagatcaggagggttctggtgagagtcttcttcaagaagatgatccgcagaatacccatttgaatgtggtaaaaggagttataaacagctgagagaataaatctaactcaggggaaatagaagtggtaatgtatgataaggtcactctgaatatgatatatataatcatgttatgtaacattgaatattgatctacccaaattatagtgatcttgagaaaagaatagagattctacagagttaatttctcttctttggggaagtctcngatactctaaaccaaaatcatgatatgtngacctgtcagaatatgccaaagatactaatgntgagtgtgcatggaatactg

SEQ ID NO: 4725 - DNA, 820 bp, Homo sapiens
  misc_feature 66, 458, 544, 638, 667, 721, 727, 733, 754, 763, 794, 815: n = A,T,C or G
tgtccctaaaacttaagttaataaaaaataataaataaataaaaataaaaaaataaaaacacattntaaagggggcaatccagatggccagtaaaccattgtaatagccagaaattggaaacatatattcattgacaacatttaagattataatatagtcatataatagtcctgatataacaatggaaataaattacagctacacacaacataatggataagtcttaaaaagccacatgtacagaatacataccatgtgattctacttctgtgaagtcaagaacagacaaaactgaaatactcatgtaaggatgcacactaaggtagtaaaactataaagcagagcaagagagttattactataaaagctctgtcgagggacaggagttgcaattaggaatatacagggaattctgtggtgctgagaggatttgttgatctgggtgatggttacccangtgtttattcactttgcaaatgattaagttgtatatatgttttacttaagtggtatatttcatagttttaaaaggtttaaaaaatntagagaatacagcctgggcatggtggctaacacctgtaatcccacactttggaaggccaagacaggaggccgagttcaggagttcaagaaccgnctgggcaacatggcaaaaccctcatcttntgcaaaaatttttttaaaaaatttaaccccggcctggggggcatgtgcttttgnatagtncccagnccccttgggaagcttaaggtngggaggatnacctttaacccccggaggccaaaggttgcantggatcccccaatggatgccncttct

SEQ ID NO: 4726 - DNA, 833 bp, Homo sapiens
  misc_feature 463, 622, 637, 643, 646, 652, 654, 655, 660, 663, 665, 666,667, 668, 670, 672, 673, 676, 680, 685, 686, 687, 688, 689,694, 696, 697, 698, 701, 705, 706, 707, 709, 710, 712, 713,714, 715, 716, 718, 719, 720, 722, 724, 725, 728, 729: n = A,T,C or G
  misc_feature 730, 731, 735, 741, 742, 743, 746, 747, 748, 749, 751, 752,753, 754, 758, 759, 766, 770, 772, 775, 781, 784, 785, 786,787, 788, 790, 791, 792, 793, 794, 795, 796, 797, 798, 802,803, 805, 807, 808, 809, 810, 811, 812, 818, 823, 824: n = A,T,C or G
  misc_feature 827, 831, 833: n = A,T,C or G
catttatatgagcaaaccaagttttacataacatgcttttggtatgtattatgactttttacatttctacttggatttcctcttcagatctcagtttccacaaatctgcatccaggttcagggcctctgattctgcacaaatcatatgagccaagtggattgattactagacagatcagatccttccccagctaataactctgccttctgattccagtcctcaaaataaattgcagcctgccattttctttatgttttataagggaggagtgaccaccttttgtcagtttgcttagtttcctattctttgggctcatctcccatcttttttgggtagtcttgctaggagtggttgggaactctgaagccccattttcccaagttgctgagagctatcagacttttagctgcaggctaagagctctgttgcaggcctagtgattggcattaaaagtagggccangaaatctgtcctcatcctcaaatgagaccaacagatatgtattaaagtggagctggagtttgtccttccacccgagactaccaagggcctttgatgcttaatgggaatgtgtgtctaacttgctcttctgacatttagcccgatgaaaataaaatattntatctgtttaagtcntttccnaanaaaaananncaatnttntnnnngncnnggngaanggagnnnnngggtntnnnttnctannncnngnnnnncnnncnannccnnnnggcnccccgnnncannnntnnnnttgnntttaaanaagncnccnattggnttnnnnnannnnnnnnngggnnanannnnnncccccnggccnnttngggnan

SEQ ID NO: 4727 - DNA, 863 bp, Homo sapiens
  misc_feature 137, 143, 152, 154, 156, 160, 167, 169, 172, 173, 176, 179,189, 207, 209, 210, 212, 214, 221, 225, 229, 230, 239, 240,243, 252, 253, 254, 255, 256, 264, 275, 281, 290, 292, 297,301, 310, 311, 313, 317, 320, 321, 334, 337, 338, 367: n = A,T,C or G
  misc_feature 375, 383, 396, 401, 407, 408, 416, 418, 426, 433, 437, 445,448, 456, 469, 471, 473, 475, 479, 480, 483, 484, 487, 489,492, 493, 500, 502, 514, 520, 525, 530, 531, 536, 540, 548,549, 559, 562, 563, 564, 572, 577, 579, 582, 606, 614: n = A,T,C or G
  misc_feature 616, 621, 640, 642, 643, 651, 659, 670, 677, 686, 702, 705,706, 708, 724, 735, 736, 742, 754, 757, 759, 771, 784, 785,791, 799, 817, 818, 827, 829, 832, 846, 847, 849, 850, 853: n = A,T,C or G
ggacctggctgcctgctctgacaggtacctgtcatctgcccaccatgggcttctgggacctgctgtagcccctgccacccactgctgcagacccacccactctcagcttagctcaaaagctgttctctaactcattnctgacnaatagctgnangngttnccatgantngcnnttnatncaactctggnaaagagggatttaatttnanngncnctttttnacangatnnaatatgttnngcnttatggggnnnnntttcacantggttttgaanagacanaagctagantncatcntaanacccagatnnanatgnggnnatttgcagagctngtnnccgaatatcgggtgccgtcaactgattangattacanttgttacngtgcagccttggnatatnggccannttttaatntngccaaccnatatacnttgncaaagccnttngtccgggntattaacttgggnancncngcannagnnacngnttnncatggantntgggcaaagcgngacttngtttnaatannccaangganataatggnnaattttaaangannntccctttngtgananaantccaaggctccattgttctgcccngttttttncnatttngtatcccaaaatgttgtgnanncttttaanaaaccaantggggaaattngaacccncttttccanctcttggtgaatattnttnnantggtttaaaatcccanttcctaaatcnnaaatancccctggggggnatncngaaaaagggcgntttgaaaaaaaanngaaaanaagggggnacaatagtttgaaagggnngttttttcnanttnaatttggaaaggtnntnntanggcaacccct

SEQ ID NO: 4728 - DNA, 904 bp, Homo sapiens
  misc_feature 5, 15, 46, 161, 175, 266, 324, 392, 464, 497, 546, 557, 574,630, 684, 703, 721, 726, 735, 779, 830, 840, 845, 888, 893,904: n = A,T,C or G
taggncgtttgtatncaaatggtggtaggcccggcctatccactgncacaaagcgggcaatggcccctcaagaaccaagatgatatcaccctccatcaagacagctcggaaaagtaaaagggcatcaggggctggaggataaaatgattatgataacccantggtggatgtttgnttatatcaagtcaacccagtattaaaggcctgcctgatatacaaccctcgaatgcaacacagtgtccttctgaggccactctaaaggccangaaaggtttgctaagaagtctgtgctgttaaaacagaagaaaaagaccttatccattntctgtgctggtggtatagggtagattcataaaaaagaaggcaaaatatttcaaaatgatcaagaaatntgcaagatgcaagacagagtctcaagacagtgccaggacaggatagcactcataacatataacactgtgtantgctgttgagtgctggctgttgttgagtgctanctattggttgagtgctttgttgttgagtgctaacttgcttgagtgctanctgttggtgantggcttggttggttgantgctaactggtggttgaatgccttggttggttgaatgcctaacctggttggttgantggaattggttggttgaagttgccttaaccttggttgggttggaatggcctaanccttggttgggttggaaangcctttggtttggtttgnaaatnggccttaanccttggtttggtttggaaatggcctttggtccccttggcccctngggggccccctgggttttttttaaagcccccttttgggatgggtacccaantttttccttncccantttttaaacccttttcccccccaaaataaaacccccccttatnttaanggggcccggcn

SEQ ID NO: 4729 - DNA, 911 bp, Homo sapiens
  misc_feature 466, 469, 535, 541, 546, 569, 608, 614, 622, 640, 652, 653,654, 655, 656, 657, 658, 659, 660, 661, 662, 663, 664, 665,666, 667, 668, 669, 670, 671, 672, 673, 674, 675, 676, 677,678, 725, 734, 735, 746, 754, 762, 765, 779, 787, 818: n = A,T,C or G
  misc_feature 826, 828, 841, 853, 865, 897, 901: n = A,T,C or G
atatccacgtctcagtcggtggatgggtaatgggatgcccgcttcccctactccagatgattgatgaagaaatggaggtgtatggagatgaggtgacttgcccaggatcagagctttaagtgacagaggcaatattggaactgaggtttccctcattcaaaagccagtggtgcttgtttgcactgccacactggagcagactaactgagaccgctcttgatgggtccttttctacgagaggctttgcctgccacctgccagcatcaggtgatcagaagatgtggtatgaagaccattcagcccgggcgcagtggctcatgcctgtaatcctagcactttgggaggccagggcgggtggatcacgaggtcaggagatcgagaccatcctggctaacacggtgaaaccctgtcttctatttaaaaaaaaaaacaaaaaaccaaatactcagggaaatagcccttcagnttncttcacccacttcagaaaaaatagggaaaaggaaaagaacagggattgggaaaaaggaaaaaaagnaaaaangggangggatccgcttttaagcccttanggaggtttttaaagaattaagttcttgggggccaaatantaagtnggaggaancccctgggccttctttanttttaaaaaaannnnnnnnnnnnnnnnnnnnnnnnnnncctttcgaagcccctttttaaaaaactttttaggggggggtccgtantttaccgtnngaattccccgnaccttggntaaggatnccnttggttgaagtttnggaccaanccccaacttgaatgccgtggaaaaaaaatcnttatttgngnaaattgggagctnttgcttttttgnaacctttttagntgcattaacaagttaccaccaccattgcttcntttntgttaggtcg

SEQ ID NO: 4730 - DNA, 819 bp, Homo sapiens
  misc_feature 28, 35, 78, 80, 125, 142, 152, 185, 208, 226, 227, 280, 292,297, 300, 307, 322, 332, 342, 348, 353, 361, 375, 412, 427,430, 443, 444, 454, 470, 471, 483, 518, 532, 539, 541, 565,576, 586, 637, 646, 649, 662, 671, 734, 742, 744: n = A,T,C or G
  misc_feature 748, 749, 756, 758, 775, 781, 783, 786, 788, 793, 800, 810,811, 813, 819: n = A,T,C or G
tcacctctctccccaagaaaaacatgtnaaatgcnagactgtgtgctcttaatgacatctatattaagggatctgaantntccatcataaatgaacatggtacttaccaaatatcttctgataantcattcagtgctcaggntctatgtttnttctcctgtccaagagtgaacaaactacacatnaccaaaatattgtaaggctaagnaataataacggtgactgnnaaaatgggaaatgagatagcgtcaaacgtttgtgacaaataaaagcagtcacngtaaacactggnctttncanccccatnaatgatgactttgtncccaacttgnattcccaacngcatcncaaanagtaaaangagtcacatggganataaaacatcatttttatcacaagcttataacgggtnatttttttctgactntgngttggagggtaanngggcttgctnatattgcatgcagcanngaacttacccgncatatggatgcctccctctatgctagtggtcctcncctttatggcccanggatcanantcatggaaagacaggtatccctgngggaaggtttngggatgaaantggttcaccttaaatcatcaggcattaaaattctcataaggcatgtgcaanctaaatctnttnacatgtgcagttnacaaggaanggggtggcacttcctctgaaaaatctaatgcctccctggtctgccaggaaggtacaacttggnttgggaangnttgnnttggtcncnggtccacatcctggtgngccggngnggntncccanaaggccnccggctggtnncnaattan

SEQ ID NO: 4731 - DNA, 771 bp, Homo sapiens
  misc_feature 385, 406, 576, 648, 674, 735, 752: n = A,T,C or G
gaactgaaagatgatgcacaatcagtagaaactctgggaaagccaaaagcgaaacgaatcaggacgtcaaaaacaaaacaagcaagcaaaaacacagaaaaagaaagtgcttggtcacctcctcccatagaaattcggctgatttcccccttggctagcccagctgacggagtcaagagcaaaccaagaaaaactacagaagtgacaggaacaggtcttggaaggaacagaaagaaactgtcttcctatccaaagcaaattttacgcagaaaaatgctgtaatttcttgggaagattttaatgtacacctatttgtaaagtcatcagaatagtgtggattattaaatatctagtttggaagaaaataatttatataaattattgnaaatttttatgtaaacagaangtcttcaataagtaaagtaactccatatggagtgattgtttcagtccaggcaatttttctattttatattaagacttcatacatttatatatgtaaatatggcttattaatggaatgttaaataaaatgtatacttcaaaaaaaaaaaaaaaaaaaaaaactcgagcctntaaaactatagtgagtcgttttccgtagatccaactgataagatacattgatgagtttggacaaccacactngaatgcagtgaaaaaaagcttatttngaattgtgatgctatgcttattggaccatttagctgcataaacagttacacacatgcttcnttatgtcagtcaggggngggggaggttttatccgcc

SEQ ID NO: 4732 - DNA, 1232 bp, Homo sapiens
  misc_feature 12, 18, 128, 143, 206, 209, 212, 225, 231, 232, 268, 269,293, 296, 311, 330, 345, 407, 420, 423, 431, 442, 451, 457,489, 527, 534, 545, 556, 561, 571, 575, 584, 586, 596, 597,603, 613, 614, 615, 616, 617, 618, 619, 620, 621, 622: n = A,T,C or G
  misc_feature 667, 676, 691, 694, 706, 711, 747, 782, 787, 805, 814, 823,854, 858, 871, 885, 896, 901, 914, 917, 934, 943, 954, 968,1002, 1044, 1047, 1063, 1065, 1076, 1080, 1096, 1104, 1110,1117, 1136, 1141, 1145, 1172, 1182, 1192, 1200, 1205: n = A,T,C or G
  misc_feature 1208, 1220, 1221, 1222, 1230: n = A,T,C or G
gatttgaattcnatacanctacttgttctttttgcaggatcccatcgattcgcccagggaatgctggcttcctcctattgctattccttgcctttcctaatgccttgaatcagtgcattcattcattngttcatttcaatcangaaatatctgtttagcacaaacatatgatatttatttatctaaagtgggaaaaagaaatattnggnatntcttcaagtggtntgggtnncctggcttccctggaggaatttttaaaaaaccgatnnccaaaccattttttttttccaccnagnccaagggttttgggnttggcattattggttattncaaaaaaagggttcnccttaaaaaggaaccaccaaccccctttttttaaccccccggttccaaaattttcctttacnaagggtccggaangtnccaatttnttttttccttnaaaaaaaanaaaaanaaaaaagggaaaattgggtgggttttaaccanaccaaattggtttttaagtaaaaaaaattttttttaancccccancccaaaaaagngttgggttggncccanttccccccanaaanggggggggnanattttttttnnaaaaantttttttttnnnnnnnnnnggggggggggggggcaaaaaaaaattttgggggaaaaaaaccaangggggccanaaaaatggggttccnttnaaaaattttaanccccngggggggggggaaaccccccaatttggaaaatttantttccaaaacgttcaaaaaaaaatttaaaattggngggtnaaattaaacccttttttnggggaaatnggggggccntttaaaaaaaattaaaccctttaaacccttngggnggaatttcccaanttttaaaaaattanccccaattttnggggnaaaatttgggggnaanttttgggaacccttaanttttttttntttttgggaanccatttgggcccgnaaaaaaaaaataatttttcccaaaaaaaaccaanttaaccaagggcttttttttaaaaaaaaaaattggggggccnttnttggaaaaaaccaaantnggttgggctancccngggttggcccacccanccccaaangggggnccccttngggggggttttttttcttnaaaangggnaaaaaatccttttttggagggccaaanccgggggaancccaaaaaanaaagggtnccccnacntttaccaagggnnnaattgtgntt

SEQ ID NO: 4733 - DNA, 835 bp, Homo sapiens
  misc_feature 374, 509, 608, 628, 632, 686, 694, 702, 754, 761, 791, 799,825: n = A,T,C or G
gagcctgatgcagcttgtctgtctgatgcttttgttccccatccacgtcccccccagtgctgaagctgtttcgtgtgtccttacagtgtttcctctgcacttccacttgtggttgataagtggcagggggacaataaatagagttgatgaaagatgggcttgggcagcagtgggcccaagtgaggcagaaatgagaaaaggactcctggggcagaggtggagtgacaaagccttgagcacgagggtgtgaaatgtgaacttggtgctgacctctattgggcagccggggcaccacggaggtggatgtggtgtcagtgagaccagtgagtaattttagcagagatactttagggatgacttggggagggcagcangcttttttaaaatatatatacttcccaaaataacattgcttcagagtagtttcctaactgccctgggacaggcctgagatcctgtcccagggtacttggggggcacatcctgtcttagggagaggtattcacctncccattcccatccccagtcctggctgcttttcctaaatgcatcatttatcccccacattgccccattctaacccatatcacctctttagagataccttncccttcattgagggagcatncctnttataaccattaacttccatattctggctgggtttcttttaaaagcacttgtgnaaaatttnggaagtantttaatttggttaaaaccttcattggcctcttttccttccatttaaaaaggngaacctnccttgaaaaacaaggggacccgggggggantctaatantaattcacctcttggattcccttaanccccctaaac

SEQ ID NO: 4734 - DNA, 880 bp, Homo sapiens
  misc_feature 61, 118, 154, 164, 167, 199, 238, 243, 249, 307, 311, 317,376, 487, 525, 528, 532, 550, 563, 586, 596, 634, 655, 656,661, 662, 663, 664, 665, 666, 668, 669, 671, 675, 676, 677,678, 679, 690, 691, 699, 708, 711, 718, 722, 728, 731: n = A,T,C or G
  misc_feature 747, 748, 750, 770, 788, 795, 800, 809, 816, 825, 837, 863,867, 880: n = A,T,C or G
tgtgatgaaaagtgaagctgataagggtatagtggtgacttagggtgctgatttagagttnggtcagagaaagtctttcttgaggagctgtgtgagggtttgttcctatctaaaggcncagaggagattcaggcccattgaagatgagaaaacnctcctggacnacnttcccactttttttgtaggacactgttttgtnaaaatttacatatatggctaaatagtctgaaactatggnttcantggaancaaccggtatgtgcccatggaagagttttcccaggaaaagaaaataattcattacagntttnctggcnctctgaaaagggaccaggagctgggaactgctgaaggctaagctgctgctatctgtggnctcaaatggagagccgctatgaaaatgctgcttgcaaggggcacattatataattctatggggtgatatccctaattttagaatggaatgaacctaaactcttttctggantatgtttttggatttagccccaaaaaatgcctgggganggngganggacccccttaacttacnagcccatttggcntggttctttggggcatttggccngccagaaganggaaccagcccctttttacctttcatctgaacctgggntggccttttttttttaaaggnnaaatnnnnnngnnanaaannnnnaaaaccttggnnccttttanaactttagnggngtccgtntttncgtaanatnccacacttggataagnntncctttgatggaggtttgggnccaaaccccccccttggnaatgccngtggnaaaaaaaangcctttntttgggggnaaatttggggangccttttggctttattttgggaaccntttnttaggctggccan

SEQ ID NO: 4735 - DNA, 808 bp, Homo sapiens
  misc_feature 214, 309, 552, 578, 638, 693, 705, 728, 781, 800: n = A,T,C or G
tcatagtctaaaactatcacgtctgagttgccttaggatgacagtgctgacacccagtaggaagtatcccatttttatcaggaaagtcagtcacgcgtagggatggtgaggagacgcgtatggatggtgaggaggggagaggagggagacctgctggtgcccttgcaccagggtgaggcctgactcacgctgcttccccccacaggccctgctntgcttgcctgctttttccagaatcgattttgcaagcttcaagattctgttcccctcttcgcacaagtgaggaaggcaaatactcagggtttgaanggagacctgccggcctgagggctggcaaatgtgagggcaggacacctgggatggactcgtaggctgacccaggcccaaagggggctgcctgttcccaactctttcactctgtaacccattttaaaatgagtttttgaatcttgcctcaaattgacctacttggataaaatcagtgcttttcctaacttgattttgtttgacgtggttccctctaagaaaatggtaggaattgaaactatttgnatatgttgaaatttgtaggggttcangacccatggcagaaacacttaaactatttatttacagtatgactattttttttcaaagtnggcaattcttttgtatattttaaggcaaataatcactttaccttttggtgccttncatgcgtcgcantaagcactcttgtcaatcatggnaattgggaaaaaaagatgtccatttagttaaacaagaaaacactattttgtancatgaatttagaatggggnccttttaa

SEQ ID NO: 4736 - DNA, 814 bp, Homo sapiens
  misc_feature 239, 443, 581, 644, 654, 748, 761, 766, 785: n = A,T,C or G
gaatgtctttgcttgaacaccccagtccacaccttcgtggggcatgatgatgtggtcctggagttccagtggaggaagcagaaggaaggtgagtgggagaggcctgctgcccactttccttctgagctctggtgacagcggtgccagtcagtgttgccatggagtccagtaaagaagacatagagagagctgggctttaggaaccagagagccagggctgttgccacctttcgtcatangtgagtaaagggactatataggctgctgttactcttccaaattctgtcctcttccacaattgtcagcgtagtctctcttgcttggaagagatatgctccagtaagagacggaagatagagatttgctgttggattgtttctgggactgaaagactctgggctcacaagtccagggcatttgccccttgccactctgttgatganggagacccaaggtggtctttagtactgcctactacataccctcagttgtcttcacaagcatgtagtgctctgtctcaaaaaaaaaaaaaaaaaaaaactcgagcctctaaactatatgagtcgtattacgtagatccngacatgataagatacattgatgagtttgggacaaaccacaactagaatgcagtggaaaaaaanctttatttgngaaaattggggatgctattgctttatttgtaaccattataagcctgcaataaacaagttaaccaccaccaattgccttcatttttttgtttcangttcagggggganggggngggaggttttttaattccnggccggggggcccatgcatttgggccccg

SEQ ID NO: 4737 - DNA, 825 bp, Homo sapiens
  misc_feature 497, 523, 524, 637, 674, 684, 706, 712, 733, 755, 775, 791,814: n = A,T,C or G
taaactttattctttttgttatcgtttgtcctctggtagtgatcagtggtcagtctttgaaaagaaaggacctatgaactcaactttagttacagcaaagaaatgagtaggagacggagggaatggccagcagccattgaagagggagagcaggctgggcccaagggggacccagtattggcagaaaggaaagctcagggtgtcaagtgggcctgagaagggatcatctggctgaacaagagaggtccacatgtagctctcagcacacacttgtgcattccagcttcagcatttgctcacacgagttccccgcctaaaatgcctgacattctccctctctacttaactcatgtaataaatttttactgaatgcctgtaagtgccagctttctgaacagagttggtcacagataaaggtgtgttgtagagtcattaaaatggtcaggtatttgactggatctccagtcggaaaaaaaaaaaaaaaaaactcgagcctntaaactatagtgagtcgtattacctnnatccagacatgataagatcattgatgagtttggcaaaccacaactagaatgcagtgaaaaaaatgctttatttgtgaaatttgggatgctattgctttatttggaaccatttntaagctgcaataaacaagttacaaccaaccaattgcnttcatttttntgtttcaagtttcaggggggangtggtngggaaggtttttttaatttcncgggccgcggcccccaatgccnttgggccccgggaccccacntttttgttccttttantgagggttaattgcccccttggnggtaaacatgg

SEQ ID NO: 4738 - DNA, 836 bp, Homo sapiens
  misc_feature 57, 63, 78, 79, 89, 92, 95, 97, 118, 122, 156, 161, 163,212, 235, 237, 241, 243, 244, 253, 257, 259, 260, 261, 264,272, 273, 274, 276, 286, 287, 288, 293, 296, 301, 314, 333,366, 404, 417, 420, 462, 470, 474, 477, 503, 511, 525: n = A,T,C or G
  misc_feature 529, 530, 536, 540, 543, 553, 564, 565, 579, 586, 627, 632,638, 648, 656, 674, 680, 684, 685, 713, 718, 722, 727, 733,736, 742, 746, 747, 749, 756, 764, 766, 772, 775, 778, 787,802, 806, 815, 821, 825, 836: n = A,T,C or G
gccatcctacattccagtgagggttgctgaaaaaatcctatttgttggagaatctgnccagangtttgagaatcaganngtgaacctgnctntananggatccattttgcaaaaccangaanacactttatgctgcactagctgcaccgtcctcangcagnanccactcttcagctaaggtggactactgaacaggtggcggatcgcattangcagcactgtggctgagcatctntngaancnnatggtggancaancnnnttnactgggtnnncngaagaccatnnnatacnttnacctnttgggaccatganaactgtttccagcccctantgacgcagcgaaacacatgtatgaaaacaccanccactggtagtactgatcatgatgtgaagtgtggcctntctacagttaacngcncggtgtatttgctatgatgatgacaccttcttcctctgttgncttgacgngcgnccntacggcaaggagcgcaatatatgtantcaagcgngagaagggccttcnctgnnaacttntacncgnaagcccctgntatggctgggnngccctaagtctttnctacaangtacaggaggccccttcataaaactcttcaccccacatggncctgnaaaagnacaaagtggntgttaagnctctaacttgatgtgcgnccgggngcannctgagcttgcaggacttgctgggccttnaaaangccngggcnaggaanttnaagctngaannanaaatgangccaatcnanttgggnccnaanccaaatcanctggggtttttgggngganaaaatcccnggactntttnccggggttttn

SEQ ID NO: 4739 - DNA, 767 bp, Homo sapiens
  misc_feature 412, 457, 478, 523, 627, 639, 652, 660, 674, 714, 761, 765: n = A,T,C or G
tgaagacactgaccttgtcccgctacatctgcgagatgaccctgcaggaataccactatgtccaggagaaggcttccaagctagctgctgcctccttactcctggccctctacatgaagaactcggatactgggttcccttcctggacattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgntcgaatttgcttttgatcgcttttattcatttttcctttctttgncttttcccaaactgataatgntataaatatttatgttgcttggttttatgaaagaaaaaatattgncatatttgactacaaatttaataaaaaaattaatgggtattggtaaaaaaaaaaaaaaaaaaaaactcgagcctctaaactatagtgagtcgattcgtagatcngacatgataganacatgatgagttngacaaccncactagaagccggnaaaaaagcttattgggaaattgggatgctatgcttattgnaccatttaactgcataacaatacacacatgctctttttgttaggtcngggngg

SEQ ID NO: 4740 - DNA, 961 bp, Homo sapiens
  misc_feature 21, 33, 62, 68, 71, 86, 100, 115, 153, 162, 163, 201, 209,220, 253, 259, 260, 266, 276, 279, 285, 298, 307, 315, 336,338, 341, 346, 359, 388, 424, 432, 440, 449, 464, 468, 472,476, 477, 489, 514, 520, 552, 576, 588, 598, 613, 629: n = A,T,C or G
  misc_feature 636, 657, 669, 679, 687, 693, 720, 748, 758, 761, 765, 773,777, 783, 790, 793, 799, 804, 821, 834, 851, 853, 858, 865,869, 879, 894, 906, 910, 914, 923, 935, 941, 949, 950, 961: n = A,T,C or G
ggagatgaaggttggcagcanctggtcatgaangtgttaacaaggggccttcactgggctgngcgganctnctgaagatgtttgcncaagagaagggttnggcctggtacacatnaaaactcctgggacctcggaggtgatcgagcctaaccnggggccatnntacagatatgaagactgagatgaagacaggagaagggncatgctgngaagtccatanactgggcctggctcctggggtaaactaatgggnacaaanntctgangattcctgcntanaccacnaaatggacagggncaaggcccntgatggtnagcccatgcctgacactgacnanttnacagnccaagaacacagngatgaagaataaaaagtggtacaatcggnttcacttgtgccaccaggatactttcaatgattgcnttcctgtnccacaaanttcttttantcttgggcggcgacncaantganggannggggaacttatncatggacgccccctttttcttcgantggganggaccacttgaaaacttcatggaaaggcccanaggtttacattggccccccattgnaccttgagcccnaagcttgggnaatccaggaaccttngggaaatttggggccnccttggnggggcttgacccccccataanaaggttccaagntgggcccccntgccttangggatnaaagcccgttttaaaccaacaatttanggggttaaagggttggccctttttcatngccccccccnttnaagngtaaaaanaaangggggnacccttntanaaaccnccatngggaaaaaaaaaactgnggggccttggggnccccctttggggaatgncnccagnagaaatncccnaggggccttnaaaacctttttcctnggggccaataancctnaaantttgctttnttttaaaaaaanattccntggaacannggggggaaaan

SEQ ID NO: 4741 - DNA, 832 bp, Homo sapiens
  misc_feature 8, 299, 321, 415, 495, 563, 620, 630, 670, 677, 701, 704,721, 728, 734, 738, 750, 765, 768, 775, 807, 831: n = A,T,C or G
gtttgcangctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatnctgttggcgccggccaccgcanagctggagcccttggctgatggacaggtgtcccagaccgacgaggaagatatggggatgacatatgcggagctctcggtctatgggaaactcangaaggtggccaagatggggccctacagcatgttctgcaaactcctcggcatgtggagacacatcttgcaccccgagacangtcgcttgacaaagtgaagcggtttttctccaagtacttccatgaacagacacaagatgaccacgctnacacccgcgtaccacgccgagaactacagcccttgaggacaacaggtttgatcttgngaccattttntgtcaacacaaagctggccttggcaagtttcggtgcatanaaaaatnaagtgctacaagcttcgagccctntanaactatagtgagtcgtnttacgtngatccncacnttgataagaatncatttgttgagtttnggncaaaccnccacttggaatgccgtggaaaaaaagcttttnttttgtgaaaattggggaaggctnt

SEQ ID NO: 4742 - DNA, 821 bp, Homo sapiens
  misc_feature 547, 589, 629, 631, 635, 668, 684, 686, 750, 751, 752, 756,758, 759, 760, 761, 762, 763, 764, 765, 766, 767, 768, 769,770, 771, 772, 773, 774, 776, 777, 779, 780, 782, 783, 784,785, 786, 787, 788, 789, 790, 791, 793, 794, 799, 800: n = A,T,C or G
  misc_feature 801, 802, 803, 804, 805, 806, 807, 808, 811, 820, 821: n = A,T,C or G
cttaatgttatcactcattgaaaagtttcttttaaaattatatatatggcccaatcttgaactatcttattttggaaggttttatctatttttaatttatgtcctcccgcctttctcatacccagctccacaagaaaatacagatctgcagaaaatgatttgaatgcctactttctcactcgtccaaggatgatgctgcatagctagtaccactctagatgcttggaagaaaagttaattcaatcaacagatagtgcattagagtttaattcttttatagaactccatttgagaggggctcttaaaaattaagagcatgcataccaaagtataataaaaaaaattaagaacaaagatgtaatggcttactgcatgagatagaaaacacccatatattgaaaattgagtctttagggctagtttttattttattttatatatatatatatatatatatatatattttttttttttgagacagagtctcactctgtttcccagactggagtgcaatggcatgatctcggctcacggcagcctctgcctnctggcttcaatcagttctcatgcctgtagtcccactgctcangaggctgaggtgggaggatcacctgaatgagccttgggangncaangctgcaatgaaccatgaacacaccactggactntaacctgggcaaaaanantgagaaacccgtttcaaaaaagaaaaaaaatctggaataacctattgggccttttggttaattnnnaaangnnnnnnnnnnnnnnnnncnnanngnnnnnnnnnngnnaaaannnnnnnnnnaanaaaaaaccnn

SEQ ID NO: 4743 - DNA, 881 bp, Homo sapiens
  misc_feature 339, 355, 430, 479, 500, 509, 533, 540, 587, 645, 671, 685,760, 772, 779, 784, 791, 801, 825, 863, 873, 877, 880: n = A,T,C or G
agttttaacttgaaccccttcagtcaggatgaacataaagctctcaagttcttgaaaggatgagacacaagaataagatggggtaccagtgaccagctcctctacctggggtcatggaggaccgaagaccctccaaccttgatgcctgtaaggacaggcgctcctgtaagggatcaggtgtaaagaatctggccatagctcctgtacaaagcctctttgtctgaagtacttgggtgctctttgacggcaggagggaacacaacctgtcggtggctgctggacctcaccacgggggctcagtggacataagatctattgacaggccctggcagtcaccantgggtgtgtgtggcantggctgtggggtgtgagaatgactgcaacaggcacttctcaacaatgacctgctgttcacatgggccctgagcanggaggaagggagagggacaatggaagctttgttccagcattcctcttanaaaggggagagacaatttcangcaggtgtnatggaattggaataaaagcaggangctcaangggtgggtttcttgagtaaaaggacaaaaatcgtgggtgcttttgtnggttcaaccacaaccctttcattgggccagacaccccacattttttttccctactggncttccattttttgccccctttttttncttaccttgccttnccaaaaaaataagaatgcttgctttattaaacccattttggggggcttgcttcttttgggtcaaggaaggggtgnttgcaaaaaatnccttccncccangggattnaaatgaaatngggttgttcccccctggagccttnttaacaacctttttaacccaggtgttcaaaaaaatttntttccccccncccnccnt

SEQ ID NO: 4744 - DNA, 812 bp, Homo sapiens
  misc_feature 133, 307, 401, 458, 478, 545, 668, 689, 696, 729, 746, 758,787: n = A,T,C or G
ctctgcagtctcttaagcagattgactatgatgcatgtcacataaaacagttttctttctgttctattgtggagtttttctggggctggagaacattcttttgttatttccaaacactgtctataattaccanacatgatataaacacataaggtgccaactggaatttactctagaggggactttccctctcagacttccagtcaactcacacttgtgcaacaaagtgcatgctgtcccctaaatatgcaagcagaactgtgtttctgcctatttggtatctatagtcctctacagtcacttctanagagactaaaccaaatttctaccaacttcacagggcaacaatcaatagttttatctcaatgactcttgtatcttcagaccttaaactgattcanagaccatggggcccacaaacctaatcagagtaacgttttcattgagtacacattcanacatgagaatcttcactttncccttttttctcttggtaaaatgttcacaaatgtgcaggtaacacctgctgctactccagccattcnggccctaaatctgcagctctacattttgtatctaggtcttgagaattgggaaatagaaaatttttatctaaaaatgcaggtccttttggttatcaaactcagacattgaaatgaaagtgcagntacccctttctcctcctttgnaatatgnattcatctcttggaaactggtcactattggccncaagtagatgtatattnaactggttatanccacattggacactggttttcataccctnaaccctaaaggaatatggcccaaca

SEQ ID NO: 4745 - DNA, 815 bp, Homo sapiens
  misc_feature 251, 298, 332, 506, 528, 544, 592, 603, 605, 609, 612, 627,632, 660, 673, 694, 696, 698, 714, 723, 724, 728, 732, 735,736, 737, 743, 750, 765, 779, 806, 815: n = A,T,C or G
actttatatggattctctaattttaatcttcaaaatgctatctaatgtctcattaagacttgcatataatgtatcttaagtacagtcattaaatatagtttagggagatttatgttcagatattgcttaaagatgttttaataggcccatttactctgatgatattaatgagctcttaatacagactaagcttctaaaactagtggtaaagactcccagcctgaacacaacaacttggaattaatgcctgntttggacagatgcctgagggtgagtcctgcacacactcgagggtcancgcgagccccttgctggatggagccttgtttcanaaaggggcctcctgtaacgggctctggctgctgactccagagcacccattcttcggccagcctgagtactgtcttttttctcccccaaactgtgcacaggacatgtgctaactaggccgaagtacctctccaaggttatttgagaagcgctgatagccttggcggtggcactgnggcctgtgaggggttaaaggangctgttgctgaaattncgtggaagcatctgccaagtaaggtgtgcacagactggcatcgttacntgaaacaagcntncctntgncaccaagtgaactgnaaaanggcacatgggtgtgctttcatcttttangcattcatcctancttgaaatacatgtaataaangngncctgcttatttcaacntcggaaccnnaaanaaangcnnnaaaaancctcgancctttaaaacttttntgagttttttttcntaaatccaaacttgataagaaacattngtggagttn

SEQ ID NO: 4746 - DNA, 820 bp, Homo sapiens
  misc_feature 538, 582, 589, 608, 628, 638, 648, 667, 675, 685, 688, 699,707, 718, 733, 755, 771, 805, 817, 819: n = A,T,C or G
ccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagatccattactcctcacaggtatttgtgaagtgtcattttgattatnatccatacaatggccacctaatccttgcaaagaagcaggattgnagttttncaaaaggagagatcttcanattgtaaaatagagaagatnccaaatgggnggcaggcttncccatgttaaaaaaagganggaaaccnctggtcttcnttncaagccaattnctgggaanaaaaaaaaaanggcttttgttaaaanaaactggggacaattcaaggancctttttgggggactntaagttgccaaaaaaaaaaaaaaaaaaactcggnccttttaaactntng

SEQ ID NO: 4747 - DNA, 726 bp, Homo sapiens
  misc_feature 2, 3, 6, 667, 674: n = A,T,C or G
tnnaanctaatgcttggctacttgttctttttgcaggatcccatcgattcggtgagccactgcgcccggccaaagacactttcaaatactcatgattggatatgcctctgtgattgacagtgagatttcaaatgggttaaagattgctctgcaaagaggttaactgttgagattgatacaggctatcttcaacatatgtacattgctgtatatgacatttacctaccattgtgcatctgggacttcctgatggaccacaggaattcccttttcttcccattctcttccagatctttcttctacttgaaaccccttatctacaaaaatgaataaacaacccaatctcatttctgatcgtgtcctggaattgatctagggcaaggtctggagaagtggtgggagacagcagacagcttttgttagtcttctaaccccagcactttctcagcctcatctgtgtgttcctgtctcactctgcagacctcacttcacaatgctcttcagatcctttaatgaataggaaattgattttgggtatttctataaaatacagcaaagtcttagaaacttgcagtgtccttaagaagaaagatcccttcttatctccctgccagtttttctttctttatggctcaaacactaactgattttgccatggaggtattgngcttcanactgcttttggtgaactgggttgaggacataacccgttgtctggtatatttt

SEQ ID NO: 4748 - DNA, 797 bp, Homo sapiens
  misc_feature 1, 2, 4, 6, 642, 695, 773, 775, 776: n = A,T,C or G
nnancntgctacttgttctttttgcaggatccctcgattcgaattcggcacgagggaacatgcaaagcagtagccctctgaggagcagagttaaggctagtacagaaaagacttttcctcccaaaacaccttcagtgtttggagaggctattatgtcaataagtaaagaacatgctactgtgaaaaaggtacaggaacaaaaaagagttgccaaaaataaaaaatattattgtaaggtaaaaaatttcataaatgggcctaatagtgggatggatataactgaaaactaagatggtgatgaggaagacagtcaagaataaatataccaaagtagcaaagaaatacctgtgcaagtagaatagcttgcttcaaacagatgagatttgtcctcccaacatcaaaacatatcacaaaactacagtaattaagtccctttgaggccagcactgactgggataagcaaatagataaatgggatgtaacaggccttatttcaaactaataggttgttcaccaactcctagttggataccctgctatccattatgaaaaagaaaaaaaggtaagttctcatcttacaccatacttaaatttcagatgaattaagtattaaacataaaaattaaatgaaacatgggtttncctggggattctaagcctactccaacttggaagctgcaaagttggctttgtgntctacatgggaaaaaaaatagaactgcaaaggagaatatttactattgactacttaaacttaaaatactacatgacangnnctgtaaaatagttaaagatat

SEQ ID NO: 4749 - DNA, 756 bp, Homo sapiens
  misc_feature 4, 5, 6, 7, 8, 9, 28, 29, 37, 41, 49, 51, 56, 608, 696, 698,737: n = A,T,C or G
gtgnnnnnnttgaatctttgctactaanngcttggcnactngttctttntncaggnagcccatgcgattcgaattcggcacgaggggaaggtctggctccagcttgagcccactcacaggatgtcagggggaagtgtgactaaggtcacggccacgccacgtggtgggccagctggatccagagcaggggccgttgtggccacacatcctgagtttccatggtctaatgcagtgggcttgaaaaaaaagggtggatgcaggatgctggctgggactgtggagtgcgtgggcagtaagtcttaagtgacagtgggtggagattacagcatttcatctgcttttcctttgacaccttttaaagatacaacccacagttttcaagggtttatgccaatgtctgctagagggatcttgcagtagatcttaaaccctatagtattcttaagagcacaaggaaattcttatttgggttccatttacaacaaaggtggaaatttaaaactaggctgagaatttgaaatgctgttcacattaagcagtttattagggggttattttgaaatcgttctttaagtaattttaagatgtttccacatctcaaaaggatncatacatttttcttcatttttctttggagaatgtctgttcaaggatgtttaccaggtttgggttttcaaaatttcagcggcttttatngngctggcattccattcgacagattggaatttgccccttanaggaaatgggaatgttttt

SEQ ID NO: 4750 - DNA, 755 bp, Homo sapiens
  misc_feature 5, 6, 7, 8, 9, 12, 13, 14, 20, 28, 62, 89, 543, 545, 560,643, 691, 706, 708, 733, 743, 753: n = A,T,C or G
agagnnnnnttnnntcttanctactaangcttggctacttgttctttttgcaggatcccatngattcgctgtgaagacctggaaacagncaaaaaagacttgccaagctccagactgtccagctggatgaagatatgcaagacttatgaactttatttcctcctcacctctttttggcatcagcggcaaatcttttcatgaagccccaaggacacaaaacattttcccatttaaaggaaaacactctagttttgcaagtatatgcatacaagagactttagattgatctgcatgaagatcacagttaagtatacaggagtagaactgcattattgcagcctttttgttcacttataaatttctcttttaaatagatggagacaaaggacaaggtgaaatgtatcaagtcaaagtgaatcatttagttgactctataattctaaggtcaaaatggaacttgatagttttttaaattaaaaaatgtatacacctaacatagaaaattaaagatagctgcagaccattagaaataatacaattgtntntgtttacttttactncatgggcattgaaaaggttaagaaacataaatggtcatatttttaaaggtaagtacatgcatatatatatgcacacacacctntttttcagcatttttttgaaaaagtcttggggtctcaaacacatttgnctcaaccacattttncnaaatgtgattcttaatacctcaatnttggcttganaaaagtgccngg

SEQ ID NO: 4751 - DNA, 738 bp, Homo sapiens
  misc_feature 5, 6, 7, 8, 9, 10, 13, 29, 56, 614, 627, 649, 661, 666, 683,722: n = A,T,C or G
agagnnnnnnttntatcttatgcctaatngcttggctacttgttctttttgcaggnatcccatcgattcgaattcggcacgaggccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaagctttctggcagctgcctgggtttggccagaccctgcctcccctcccgccggccaacccctagtccccttcctgtctccacttgcattcaggggtggctgctgttctgagaacattagaactgggaagagagatgggagtcacatggatttttggtgggcattattctgaactttcgtatccaagttagtcccccttattccactgtgggcattgcccgtctaagcagttacctgatgcctgctgctgaaanctgctcacaggangcggcggcggccctggcactgnccttgcattagncttgngtttgatgtgttcttgngaattactttgtcagacaaaatattacccgttgggtcangaattcttttactccc

SEQ ID NO: 4752 - DNA, 731 bp, Homo sapiens
  misc_feature 6, 7, 16, 24, 30, 31, 91, 121, 185, 212, 268, 414, 431, 447,450, 464, 505, 520, 524, 622, 633, 646, 657, 682, 686, 690,710: n = A,T,C or G
agtttnnctatgaacncttggganctcaanngcttggctacttgttctttttgcaggcatcccatcgcttcgaattcggcacgaggttttntgttataggtaacaggaaaacaaactaatncaagtggtaatgtgtccagctaaaaatttgggttctgttaaggttaaaagaaaatttgaggtanccagcagtatctgcctcagatgctganaagcctcctgagataagagcgtataccatgtccataactgaagttttaacattctntgccaaacagaaccagaatttaagggcaggagaatttgcaagatagaatttgcaatttgcaagagggaattgcaattctgcaagagaggggcaatttgcaatttgcacagagagggcaatttgcaagagagaattgtggggccctnagagagaatacatccanaggaagagggaaccangcnttacaaattgaatngaacaaggacagatatctgaagggggtttggtagttcccantcaagtatggtacanctangtgcacttccctggccagaccaccctacagtgtatgatccccctggggagcaaaagctgcaagtaacacttttggtgccctataaattctgctgtggngccactatacngatcacagccaantgggcattgtncccttttacacaggatctgggcatncacnccangattgcacatctggcacgantgtgtctggacaggaagacct

SEQ ID NO: 4753 - DNA, 747 bp, Homo sapiens
  misc_feature 14, 16, 26, 38, 45, 56, 330, 529, 680, 696, 743: n = A,T,C or G
ttctttgaaacctnanggcttgggcnactcgttctttntccaggnagcccatgcgnttcgaattcggcacgagggtcattgatagcaagtaagtacttcctgaaggctttccagttcaaaagattacaagccattctgcctgccaaacaaattatattctgaagatgcctgttttgtaacccttgatgtgaattttttggtgtctgaaatttacaaaagaatgaaattgaaattgtaaaacactaaatgctttgggtttattttgaagtaatctgttactttaaaatgtcaacattaggaagccataaaacaagatattatgaaacccantattataaatgttatctacatctaaagtattttaaaataacttattggcagctttattctttttttccttacaagatttagaatctttttggttatatgtctatttttcaattttgttatatttttaatttaagtggccaatgtggttatgaacaagatttgtatggtcagcttctgttctttcctaaaacttcagatnaatatcattttagctataacctaaaaaagtgttaaataaaatgacagatgttaatttaaaagcagccatatgctaatttactttttcatatgatgatggtctaatgggaagttccatatgctttcttttgggcctaactctgaaaaaggtntatgtcagaagttctnggaaatatgtctttagccaaggaattttattccccttaaaatttggntacc

SEQ ID NO: 4754 - DNA, 748 bp, Homo sapiens
  misc_feature 4, 9, 38, 40, 98, 131, 149, 153, 156, 185, 198, 207, 220,223, 224, 245, 246, 252, 257, 263, 264, 266, 267, 268, 269,270, 273, 277, 282, 283, 289, 292, 294, 297, 298, 302, 303,305, 307, 310, 319, 323, 327, 337, 344, 351, 355, 358: n = A,T,C or G
  misc_feature 370, 371, 376, 382, 388, 389, 392, 402, 405, 408, 409, 412,415, 419, 422, 434, 440, 441, 444, 450, 452, 464, 466, 467,474, 496, 502, 513, 516, 532, 539, 541, 547, 550, 562, 567,569, 581, 583, 590, 595, 598, 599, 602, 604, 613, 620: n = A,T,C or G
  misc_feature 621, 623, 625, 645, 650, 652, 663, 669, 671, 674, 685, 687,691, 694, 695, 701, 706, 709, 711, 719, 723, 727, 728, 730,739, 743: n = A,T,C or G
caanctaanggcttgggctacttgttctttttgcaggnancccatgcgattcgaattcggcacgaggctcattccagctggtctatcgtgggcctcanaaggtgaagagggaccgtattctggggcccacnatagaccagctgtagctnattncancctgtaccttggttgatgggtaacctacnactgcatcccatnctgaatatnctttgaaactccncannagtgcttatttaagtgtaaannctcctnagagnactgcnncnnnnnatngtgnatctnnccctgnccntnganngctnnangngcnccactactncaanccanaaagaaaagngtgctgntcataangccncantacggatctganntcatnaggatnacattnnccnaaagggagtnaantgnnggnaantgcntgncactatatgaantacacnncantctgtnantcacttttaatnanntactganccctttctaactatcaggcgtnttattncatgaatcccnccntggtaagatacatttntgaactngntcaaangcnaacttcaatgcngtgananaaatgctctatntngggaacnttggngannctntngctatattngaaacgnntntnaccttgggactggccaagtnaacancnttcaattaccnttaaantntantgtttaaaggntncaanggnnaggtcntgtgnccntnattaaatntaanaagnngnccatatccngttnattcg

SEQ ID NO: 4755 - DNA, 719 bp, Homo sapiens
  misc_feature 4, 8, 551, 655, 705, 712: n = A,T,C or G
aacntaangcttggctacttgttctttttgcaggagcccatcgattcgaattcggcacgagcaccccttttaggatttacattagttctgttccagtaaaggcttaggtaggaagcacaggatgtagagctgagttgaacctattcccctgatcttactaatgaggtgcctgatattcagagagaccaagggacatccccaaagtcaaccagcaatccattagagctgagcctagtaccttgattctcagacatgaatgctacttgttgaattgaaaattgcattcataatacatctcttcatagattcctggccaggaagccccagagaccaaaacagtggttatcaatatttagaatatatcagatttacctggggagctttatcaaaatccacactcctaagcccaatagggggaaactctgatgtggtaggtttagggtaagacctgagtatttccaagaaaacctccctggatgatcctgacacagggagctttcagatcatcctttgagaaaatctgctttagagctcattctttggttcggctntctcttttgagctcactgatatcatccctgtggacactgaacttttctggaagctttctcatctcaggaattggtttgggttactctacaatcagatttccatncaggatgtcacggcagtggctcaatactgcacctgtgtccttctcagccnaactggnctgggcc

SEQ ID NO: 4756 - DNA, 755 bp, Homo sapiens
  misc_feature 1, 5, 6, 7, 8, 9, 10, 12, 13, 18, 22, 28, 35, 40, 44, 47,106, 259, 414, 417, 681, 744: n = A,T,C or G
ngggnnnnnncnntttcntctngctganacccccngtggnttgnccnactcgttctttttgcaggcagcccagcgtttcgaattcggcacgaggaaactgtttaanttttaaaggggtgtattggtgtatgtcactgaaaattccacaggtacagtgggcttcaggcatggtttgattgggatgccagctccgttttgctgagattccattggttctgctttctaccgtgtttcagcccggtttaggtggcaaaacagnggtggaaatgttaggcttcacatcaccgtaccacatagaccaaaatgagagctaatatccaggatgagaatgaacagctcttctaatcaggctgtcataaaaataaggaagcttattttatagaagcctttaccaaacctccttctttgacttgntgntccaaattggattaaccagcccattcctgcggccaaggaaatacacactggttaacccagtctttactaacccatacctttagcaaagagattggattacccaacaacttgattgctctggagactactttggagttggggtatgagatagtagataggagaatgatctgtaagtagatattggataagcgagtaagaaatgcaaactacactgaggtcttgcactggtctaggttttgggacccagatgtaataggacatagntcttttctcgagcctctagaactatagtgagtcgtattacgtagaaccagacatgataagatncattgatgagt

SEQ ID NO: 4757 - DNA, 739 bp, Homo sapiens
  misc_feature 1, 6, 9, 12, 15, 24, 38, 41, 43, 54, 410, 475, 630, 643,648, 665, 684, 691, 717, 719, 739: n = A,T,C or G
ntttgnaanctnaanggcttggcnactcgttctttatncangnagcccatgcgnttcgaattcggcacgagcaaacccctcctttgtactcgcccttcataatcacttttgcttcacacacataacctctgacagccactgatgtgttctttatgactatagttttaactctggaagaatgtcatgtaaatggggctctgtgttttgcagcatcatgcagctgtaacctttgattcagcagataacaatgtgcatggcctctccactcaaggtaatgcctttcagattcattcaagtggccgcatctatcggtagttctttccttttcattgctgagcagtattccatcacaagggtgtaccacagtttgttcgtgcactcatcaaaggacatttaggttgcttctagtntttggtaattatgaatagagctgcttaaaaacagtgtacacatgtttttataggaacataagttntcagttctttagggtaaatgccaacaaatgaaattgctaggctatatgttaagtatatgcctgactatgaaaaactgcccaccattttccagtgcggctgatcactctgcattctcatcagcagtgaacaagggttctagttgctccctaccctnttcagaatgtggnattgncagaattttaagtttancccagtcttaagaagtttngtattgntatcatatcatgggtttaaatttggnanttccctgaccggataatggn

SEQ ID NO: 4758 - DNA, 749 bp, Homo sapiens
  misc_feature 5, 6, 7, 8, 10, 11, 12, 16, 20, 29, 32, 45, 55, 60, 91, 92,113, 132, 147, 149, 152, 155, 160, 167, 170, 171, 173, 174,187, 203, 206, 214, 257, 271, 273, 286, 291, 303, 304, 310,313, 314, 315, 317, 342, 350, 360, 361, 377, 387, 388: n = A,T,C or G
  misc_feature 396, 399, 400, 404, 422, 427, 430, 513, 548, 553, 583, 591,593, 600, 609, 620, 622, 639, 650, 663, 667, 673, 684, 698,706, 730, 739, 748, 749: n = A,T,C or G
agggnnnntnnnttcntctnatgaactcntanggctgggcaactngttctttctncaggnagcccagcgtttcgcgtacaaacaccccaanncaagctttttcatctgctgcntataatcacgagtcctatncttctgcactatcangngtnttntactncctgctnaanncnntgttgtccatttnattaagacagaagttnctnttattgtnaaatttgaactgtatctatgttataatagtaatggtaactcantccaaaggacctantnacaggaagtaacntgtcntacatatcagtnnatatanggnnntnagtagggacatactgtgatcttggnatacttgnaattttttannttcctgggcggttcantgcattgatnnatcacatnatnntaanacatgtatgttgagacanagcangantctgtctcaaaaaaagggaaaaattcctggactacataaattaaaagtccatgaataggattggcttctagcatgccccttcnggtgctcagacacttaatcagaaattggacttgangttanttttattctcaggccaaccttctccagtantgatgaananggccacncagcaactntgacctgccantntggcaaaaatggatcanaaaagtgtaanctaagctgcatcngaangcccangaatgcctctnactggcctgacttncgtcatgngcccatctttgcacaacctgtggnctttggcanggcaagggnn

SEQ ID NO: 4759 - DNA, 734 bp, Homo sapiens
  misc_feature 7, 10, 26, 29, 37, 39, 44, 608: n = A,T,C or G
tctttgnaancttaatggcttggctnctngttctttntncaggntcccatgcgattcgaattcggcacgaggagtatgtgtccagcgccccctgtggtgtgtgagagaaagcagctgcaactcaagtgactaggtgggcccagctggcttcgtgcaggagggcacgtcactgcatacgacccggccaccgtgttctgaaggacagcgccaaagatgggttagagtcactgctgtgggagtcttcgtccccacacagaggacaggctgctcagctccactgtgcaagatgatgcacacccagaccagtgacgtcaggacgatgctgctcacgacagcaatggtgaagatgcctaccgtggtcccatccttcctgcagcctgctgcgggcaggacgctcagctggctgtgagctcgctccgtgcccagggtgttggacatctcacagataccacacggtcttccaaggggaccaccaaggatggggtctctacaagagagcaacagagatcttagtcattctcagggcctccgttgctctggctctgccggtcttctggacaacggacaatccaacatatcaatgagatgcatctgagattctgtctcanagtggcaagctttggagaagacccttcaactcattgactgagtcatctccatgctgggagtggcttccacagggacagtgaacctctgctgacaaaagcccctgctattccttaactgtcctgggc

SEQ ID NO: 4760 - DNA, 743 bp, Homo sapiens
  misc_feature 5, 6, 7, 8, 9, 10, 13, 109, 160, 396, 427, 430, 500, 580,589, 601, 614, 662, 705, 707, 736: n = A,T,C or G
agagnnnnnnttnatcttatcgcctaatgcttggctacttgttctttttgcaggatcccatcgattcgaattcggcacgaggtgatctgcccgtctcagcctcccagangagcacgtggattacaggcatgagccaccatgcccggccctggatgtattntctatcctagaatgtccacctttaaaaatgaagcccagtgaaaagtgttcccccactaaaatgtggactgttttgcttgcagggatgtgtgggtttctggtagatagaaggctagagctagcaccttcccaaattgcagaggaatcaatcctggcttgtctgtgagctggggaggaatggaaaggtaggggccttgagagtccttaattacatagggaatgtcctatcattttgtntattctttaaaaagataatgggattcttttntgntgttgttagtctcgctttgtcacgcaggctggggtgcaatggtgtgatctcggctcactgcatcctctgnttcctgggttcaagcaattctcctgcctcagcctctcaagtagctaagattacaggcatgcaccaacatgcccactaatntttgtactnttagtaaagacngggttttgccatngttggccaagcttggtctcaaactcctgacctcagatgatccaccctntttgggaaccaaggcaggaagattgctggcagccaagaattcnanggtgcaatgagctatgattacatcactgngcttcaa

SEQ ID NO: 4761 - DNA, 733 bp, Homo sapiens
  misc_feature 3, 6, 7, 8, 10, 15, 732: n = A,T,C or G
ttnttnnnanctaanggcttggctacttgttctttttgcaggagcccatgcgattcggaaaaatatagctaacacttaatgtttgaggtctgagcactttacattaaatatttaacctataaaatgaaatgagaacttacttttattatcctcacttatacagatgaggaaaccaagacacccagagattaataatttgcctaaggtaacaaaattagtaagcatcgtaaccaggatttttggtcagtctacacaccttccccgttccctcactatagtgcctgctgcaaattgtactttaagctatagttggacaaaatattaaaatctatctgggatgataggtgaccaaaaaaaaaagtatatttgaaagtatcacagtgttaacagggcagtgaagatgataaggctaagatacagaaaggaaaccagagagcagagtctactgcttgggactgtggctcctccaggcacctttgaccattcccaataaggtaccgtgagaccctgagcactcttcctgtaccacctacacagctctcctcttcctttcctgggtttactttatttttcactatcagcatctgttgcactatattgtcgttatgtcagtatttgtttgttgattacccattctccatggctaggaatgtcagctccagcctgggcaacaagagctaactccatctcaaaaaaggaaaaaaaaaaaaaaaaaaaaactcgggcctttana

SEQ ID NO: 4762 - DNA, 748 bp, Homo sapiens
  misc_feature 3, 5, 6, 7, 8, 9, 10, 11, 12, 15, 16, 514, 560, 656, 662,684, 726, 729, 747: n = A,T,C or G
agngnnnnnnnnttnncttatgcctaatagcttggctacttgttctttttgcaggatcccatcgattcgaattcggcacgagctgaagtgaggttgaggtgggtgcacggagcccccatgccctcagtgggtacaccagcctcccagcacttcctcatgttcaccaacacggaagcttatcagagcttgttgtttcagaactcaattgccagctcactgctgaagagattggtgggtagggctgaaagaaatatcagtgggtctttgtggtattcagccccatcctgagatggcctatccaggggctctataagaagtcacctcattagcataaactcacatgtgaccaaaaggatcttgttatgaataacaaaagatgttcttattactcaggaaatcccaagagtttagatgctctgtgtcagggaagtggggatgcagaccaatttcttattctatcacattaaccagaatcaagcttataaaaatgtatttttttttgtatggtcctcantgtgcctacttgaataatttttgctgatttgattaaaaaattctgnttttccattctcttttattagctgtcccatagttttaatacagccatcatcccaagaccagaaggaagttaagtgctcatttataaaaatgattgnatcctncttttccatctattacttttgngtccattatgcatgtcaagctggtgcttgggagcttactctntgnaccctctattagacagang

SEQ ID NO: 4763 - DNA, 723 bp, Homo sapiens
  misc_feature 6, 14: n = A,T,C or G
ttgaanctaatgcnggctacttgttctttttgcaggatcccatcgattcgaattcggcacgagctttcatggtatgtccataggtgtaaaatgatggccttaatgcttataataataaggtaggtttttgtatgtctaatatacagagaaatttccaaagactttttaatctttgcttagcataaggagtttagtcagtaactattacaaggaaaaaatgatcagttttcatttgtcagttctataagccccaggcaagtttctttcggttttgactttttattaattaaccatatcctaagtgctaaaagccatgagtcatttttaaaatttatctttttttgtatgccatcacttctagttttaccactttgtactcacaaagaagccacaaatggattaatcattatgtcatctaaggaaataaatccatggcataggggtaaatttaaaaaatactttgtactaggattttataatagcttaaatttattgaagggctactgtgtcacaatcaacatgctcagcatttttcatgtgttattttccatttgtaactggcaactacttaggattatttagttaaaatcccttcctttatggaatgagatgtctgtttattacgtttacagccacattacagatctattgacataaactccactatggtaattgtgctcctttttttccccctctctggttcacctgctcaatggtttaaca

SEQ ID NO: 4764 - DNA, 723 bp, Homo sapiens
  misc_feature 682, 715, 723: n = A,T,C or G
cttcttgctaatgcttggctacttgttctttttgcaggacccatcgattcgggaaagttccaggaccctgagacatcttgggattcctgtggtttaggaaagacctttaactaccagctggtagttgtctcagcattcttcaaatagtccggtcttgtttaatattattattattattgttatttaattttattttattgcaactgtacttagagaatagtctggtcttgagaccttttcactgtggtctgttctggtgtacggctcccaccagtgtgaagcagaaggatgactttgctctgttgtcaggacaaccttgaaggaaggagccaaatgtgtggaggtctgtgggaagagagagccacctagcatgtccccactgaaccagtcagcagaaggccttccccaggaggcctccaacagatccctgaatgccacagaaacctcagaggcttgggatcccaggaccctccagcgctcaagatctcccttgccgtggtcctttccgtcatcacactggccacagtcctctccaatgcctttgtactcaccaccatcttactcaccaggaagctccacacccctgccaactacctgattggctccctggccaccaccgacctcttggtttccatcttggtaatgcccatcagcatcgcctataccatcacccacacctggnactttggccaaatcttgtgtgacatctggctgncctctgan

SEQ ID NO: 4765 - DNA, 719 bp, Homo sapiens
  misc_feature 685, 697, 711: n = A,T,C or G
tagctaatgcttggctacttgttctttttgcaggacccatcgattcgaattcggcacgagccaagcagaccttggcattatagatacaggtttctaaaagctgatagcttggctgccagcctcatgggctggatcacccacaacttcatgggcctcttctagtggaagctggagcatttccttggtgaattcttttccctgaggggcaagatccatgccacacagctctctgaccctgtgtgtcacaacccttatggtccatgagcaaaatggttgctagtagtcatttgggcatttctcttctgttttcttatgtgtgtaataagatatacaaagtcgggcttgaagattagaaattgctacttccagtgagtcagtttacttggttttcacatcttcaagttgagtctagaatggagttacctaagaaaaggaaatttgcagccttcagtaccgtgtcctggggttgctagaataactagtgccatatccactctactggctctctagagattgtgtaaaggaggctggccttttggagatgatctgaatacatggtattgaggacaaaccttcttcccaaggctgatttgataatatgtgagtttgtgggtctaacatgtagaaatacactcaactgaatggatgtggggtaatctgggtatttagacagggtggtttggtnggtttaatgggnccaaaccttgtttnctggaaaa

SEQ ID NO: 4766 - DNA, 745 bp, Homo sapiens
  misc_feature 3, 5, 6, 7, 8, 9, 10, 11, 12, 15, 16, 17, 18, 19, 20, 23,27, 41, 57, 65, 232, 263, 308, 363, 381, 446, 450, 489,523, 635, 681, 691, 698, 699, 721, 729, 742, 745: n = A,T,C or G
agngnnnnnnnnttnnnnnnttntaanctaatgcttggctncttgttctttttgcangcacccancgattcgagtgggtagcaaggagttctgtgtaaatacttgggaggcatccaagcggagagttaagtaggcactgaatatttaagttgagctgaggggagtgatctagactggacataaattttgggagtcactagtatacagatggcatgtcatggaactgattganattgtttgtggccttaagatcaagccctgcnagactggagtaataaaactctggtctcccacacagtcagctctgngtggggaaaaaaaagccctaaaacactaacaacggctaaagcttgggcaaagganactgaaaaggttcagccnttaaagtgggagagtattttattattttcaagaaagagggaatggtcacctctgtcaaatgctgntganaagttacacaatgagaatagagaaatgtctatttggatntgacaacatgatggtgactgttttgacaagtggnccaagccacattgggatgcttcgaagagagaataggaagtgaggtgaatatcgacagctcgttagggaaatttgctgctgtaaaatggagagaaccacttaatgcttcaganggaaatggggtcaaaaaaaaaggcttttttttttaatttttttaanaacaggaggnccttcanncatccaggttggagtgcatggngcaaattnccggttaccaaanacn

SEQ ID NO: 4767 - DNA, 747 bp, Homo sapiens
  misc_feature 3, 5, 6, 7, 8, 9, 10, 12, 13, 18, 21, 25, 31, 33, 48, 63,73, 160, 380, 412, 413, 432, 482, 552, 554, 574, 588, 609,644, 651, 667, 685, 734, 741, 742: n = A,T,C or G
agngnnnnnncnnttccnctnttgnaacctntnatggcttggcaactngttctttctccaggnagcccatcgnttcgaattcggcacgggcctagtagtaccctgacctccaggtgcccctgactctgggaaagcctttctgatgatctcaagcttgcanattctgtccctgttctgaccgggggtcacagcctagtggtagaacaggacctcctgctaagatgctggaaggaccctttgggggagctgaggcctggctcccctctccccaggcgcaggtgcacaggcgtgtgggctgtctgcaagcacagatcctgcctcacagcaccattaccacaataactgaatctgtgtttcctggctgctgttaattgtgctanagatttggggcatggttttggggtgaaggttnnaaatgagcaattagccctnaaatgttaaactaataagggaaataaatgatcaagcaaagtctagcctangaggtttcagcaaccgaagatgggctgggacggggctgggatgccgccgacccagcagggagtggcccancnggtttgcttcaatgacccangatgtttccacaantcggaaaggggtgctatcttnctgtctgctacttagaaagttctatcttacccccnggatctnacttacaccaccagancattactggtctacccgncaaggctcttctgctcaagaagacagggaaaggatttgctttccccacnccattannacccc

SEQ ID NO: 4768 - DNA, 743 bp, Homo sapiens
  misc_feature 3, 5, 6, 7, 18, 79, 559, 587, 615, 622, 624, 641, 655, 706,708, 717, 723, 729, 732, 740, 742: n = A,T,C or G
ttntnnnctacttgatgnttggctacttgttctttttgcaggatcccatcgattcgaattcggcacgagaaaaaaacanaaaaaaaccctgttttcagtgttatgggagagaaatgaacaatgggaaacaaccgaggaaagctggagcaggttacgtataaaaataaagtccattcaccaaaaaaggcattacttacgagttaccaggggtgagagataggatgctgaagtggtctagaaattaagctacccagtatggaagggctgacaattcagtgatcgagagcagtgccttagaacagccaaaacaatagcaaactgagatctgcagaattaactctcctgaaaataacaaggaggtactcatttcacgtttccttctatttgatttacaagagggtgtagcttgagggaaaatgcctcacacttgttgaattacacagttgtttctcattcacttttaatcacgttttgagcacctgctaagtaccaggcattttgctaatgaggagcacagaggtaaaagacacatcactactgtatgaaatgcgtagctcantggtgtgatacacaagcacagagaggtnaccagagagcaaggagggcatggaaganaggcctntnacttttggactgggaanggagaaagatgtangacaagaaaatctttcccttaaggagcttgatgctttgaacttgtgccctngnggaatgaanaagttnacccanttngggcttancnt

SEQ ID NO: 4769 - DNA, 743 bp, Homo sapiens
  misc_feature 2, 4, 11, 332, 373, 375, 421, 467, 497, 517, 527, 536, 554,560, 586, 610, 618, 621, 623, 626, 650, 686, 729, 734, 741,742: n = A,T,C or G
gnanctaatgntgcttggctacttgttctttttgcaggatcccatcgattcgtctagactctggtcgtcaggaacgggtcaaggccttcaccatgagaagagcaccaaagggagttaatatggggttgaccagaggtaggcaaaggaaggcctgtgggccaaatctggccagctacctgtttttataaataaagttttattggaacacaaccatgctggggtttgtttcatatttcctgaggctgttttcacactgcaatggcagaggtgagtggttgacacagatgccgtctcaccaaagcctatgatatttactgtctggccctatacanaaaaagcttgctgacctctgggttagactgtcaggtggtananactaaggagggagtgataagtccctgttggccacctgaggttttgnctgtgtcaggaagctgcagatgggagatgtccaggcagtggctcanaagaacccatggaggacccattaagggaanggttggtatgtggacaccanccacgcccangtgaaccanctgtgcagtcaaatacanaacttnccgtcccttacaccttccttctctgnggtttcaattttagtgaaagtcanccacaccncanangtngaaccaacccgtgcagtcaaaatncaaaactttccttgcccctttaaaccttcctttttncctggtttccaatcctggtggaaggtccataagccccagtccntgaanccaaggnng

SEQ ID NO: 4770 - DNA, 787 bp, Homo sapiens
  misc_feature 5, 6, 8, 9, 16, 22, 25, 40, 49, 50, 60, 62, 63, 68, 86, 89,94, 95, 119, 123, 125, 131, 132, 133, 150, 158, 161, 162,165, 166, 174, 177, 180, 184, 185, 186, 196, 197, 205, 214,216, 217, 218, 221, 225, 236, 247, 255, 264, 266, 278: n = A,T,C or G
  misc_feature 289, 300, 305, 308, 313, 327, 330, 343, 344, 350, 357, 359,363, 364, 366, 368, 373, 382, 399, 418, 430, 433, 434, 438,453, 455, 464, 467, 471, 474, 483, 484, 488, 489, 500, 504,506, 534, 555, 582, 588, 594, 597, 612, 622, 624, 625: n = A,T,C or G
  misc_feature 630, 632, 635, 638, 656, 662, 679, 701, 702, 712, 713, 732,733, 734, 741, 748, 749, 751, 758, 764, 774, 781, 786: n = A,T,C or G
ggggnnanngcccttnctccangcngtaactctcgggaanggcccggcnncttgttcttncnncaggnagcccatcgcttcgctcnacnacatnnctgggccctttttcatggggattnatgncnagtgtnnngggacaggaccattcantggctggnttnnaannttgatggngtnaantgcnnntagaataaanngaacagancaaaataangnnnggntagnaggaagatggnatgcacatganaagataanggcagcagnanaggtgagggaangagtggatatnggggaatgacnttatnaangccangaaactagaatctnagngacggaaaagctnnaaaagntctgagncncttnncnanacggngggtacccnggggtcgaacaaaccgncttctttgacatgttgtancatactgaacanggnntccnaatcctgcggccaangnaagacacgnagnctanccnagtcgctanngccnnaaccaatggcnattncnaggcgtgatctaacgcactacagcttgnactcctgggctgaggcggganaatcacttggacccaggaggcatgaanttgcangtgagnctnagaacacgccaatgncatacgcctngnnccccnanggnccnaaaacccccggtcttaanaaaaangggacccaagaaagggnggaatcccccaaccccggcccnntagaaccatnntcaccctaaaggggaaggnnncttttanggaaaannanccgggcntggggnaaaaaaacanggccttntaggnc

SEQ ID NO: 4771 - DNA, 736 bp, Homo sapiens
  misc_feature 2, 7, 10, 15, 22, 27, 37, 39, 40, 45, 47, 696, 701, 708: n = A,T,C or G
tntttgnaanctaangcttggnagctngttgttcttncnncaggntnccatcgattcgtctgtggttggaagcctgaatgtgaatcgctgcaaccagaccacagggcagtgtgagtgtcggccaggttatcaggggcttcactgtgaaacctgcaaagagggcttttacctaaattacacttctgggctctgtcagccatgtgactgtagtccacatggagctctcagcataccgtgcaacagttctgggaaatgccagtgcaaagtgggtgtcattggctctatatgtgaccgatgccaagatggatattatggctttagtaagaatggctgcttgccctgccaatgcaataatcggtctgccagttgcgatgccctcacaggtgcttgtttaaactgccaggaaaatagcaaaggaaatcactgtgaagaatgtaaagaaggattttatcagagtcctgatgccactaaagaatgtcttcgctgcccttgttcagcagtgacatctacaggcagctgctctataaaatcgagtgaattggaacctgaatgtgaccagtgtaaagatggttacataggcccgactgcaataaatgtgaaaaatggctattacaattttgacagcatcttgtagaaagtgccaatgtcacggccatgtgggaccccagttaaaactcccaaagatttgtaagcccnaaaantggtgantgcatcaactggcttcatacacccactg

SEQ ID NO: 4772 - DNA, 753 bp, Homo sapiens
  misc_feature 5, 6, 7, 8, 10, 11, 12, 13, 16, 17, 24, 34, 35, 43, 62, 101,524, 677, 738, 744, 747: n = A,T,C or G
agggnnnntnnnnttnnctactgnaacctctaanngcttggcnacttgttctttttgcaggnagcccagcgattcgaattcggcacgagataacctaggtnttagaaggataggaacaacaaacatcatgatcttacacacctgcactttctagcaccagctcctggagaaaaatcgagaggctgaatggtgtctgttaacagattatagtcagtgaggcctctttcctcagatgttgtatcttatcaatggcagacattttcaacctgaaagacacatgctcattacaagacttagtagtgctctaaccctgttttcacttatcagtccaagacgtagccgacatcaaagtattcagcttattacagaattgacttcctcaaagtttctctcagtgtttatccaagatgtaattcacttagcatctttatctcgctgcacaggactagagttgccttcgaaaaaactcaggataccacttggctatagatcacagtacttgttcctcgtatttgcgttaactngtgtgaatatgcagcctccgtgagatatttgcatactgcttctgtgaacacacaggacaacagactgtcttccgcagtcatacactcagtcatattctcaaataggtattccagttcaaatgtataaaatcagtagtcttacatgttacagantgggtgggatgttcctttgccaggggattaaaaaaaaaaaaatcccaagtcttaatactgntttctnccnacgaat

SEQ ID NO: 4773 - DNA, 754 bp, Homo sapiens
  misc_feature 1, 3, 5, 6, 7, 8, 9, 10, 11, 15, 16, 18, 19, 21, 22, 37,60, 258, 272, 284, 290, 297, 317, 471, 504, 549, 552, 556,565, 574, 581, 583, 614, 632, 633, 671, 678, 679, 683, 686,693, 706, 708, 709, 711, 714, 729, 738, 739: n = A,T,C or G
ngngnnnnnnntttnnanncnnttggaaacctgtgcnaggctcttgttctttttgcaggnacccatcgattcgattcggcacgaggtggaataatatcttttgaaataactaagtccactaaattatacagtatgctattctggttctaagtacatattagtcccttggcaaatctgttctttcaaagcataccttccccaaatgagcctacctacttcttaaaaaacatataacacaatgtggtagtagtaggtgtnaggaaggtaagttntttcataggggnatgcanacatatnattgaaatattacatagatntaaagacttagggaataaaaatagcagcaacaaatacttgatagatttatcctacttgggagaaatattttgtagcagagtatttagtatacttagaagttgatttagcaattaggctttaatgaccttacaaagtgaacataactgaacacangtatttttccaatgcaagatgaggatgaaaatnttacattttaacccatctggctaaagtttagacttagcaaaaatnaanatgntgcctttgnccaagtatngattcangngactagacatatatgggtgtgtaataagganggattggactgaaatatnntttgcagggtttcacatgtaaaactgcacttgccctgnaaggatnntggnaanaatctgngtttttcctcagncnncnttnagaacagtaaggggncctaacctnntttaacccgtaaatg

SEQ ID NO: 4774 - DNA, 788 bp, Homo sapiens
  misc_feature 2, 3, 4, 5, 6, 7, 8, 12, 14, 15, 17, 18, 19, 20, 28, 30,32, 35, 38, 44, 175, 499, 542, 588, 622, 642, 648, 652,658, 676, 677, 680, 695, 696, 700, 715, 717, 719, 724, 730,733, 734, 743, 744, 759, 786: n = A,T,C or G
gnnnnnnnaagngnntnnnntttgatancntnttnaancttaanggcttggctacttgttctttttgcaggctcccagcgattcgaattcggcacgagcccgccacatggcctgtttctttccttgctgctcctgcagcacagccctgactcgggggctttgcgtgtcccctcancgctgcagggcccactccttcctctgtcctggtctctgcttagccagcgcacggtcagggaggcatgggtggccagcccgcaaggagccaggcctcccagcaccccttcccttgtgtggcctcctcccacatgggatctcagccggtcctggcttcaactaaacaggacgtggcaggcgtgatgccctgccaattccaggcctaagccttgacacagcctggcagcttctgcttctgaattgcaggaccccaactgtcatgtaaagaagtctggctgctttgctggaaaggccaaatggagagaccacgtgagaggccacatanacaggccttgtggagagggaaaggtgctgagactacctggaangggagcccagttgaccaaacaccccccactgagcccatcccccagncattccttgccaggacacccaacatgtaagtgangcatcccgggccgttccaancttggncaancgccantgggactgtaacttgcannagnaaaaattttgctttnnaacnaaaagtacttggccnancntgaanccccanttnngtcccacannaattccttggagagnataaacccaaattgaattggttggttnca

SEQ ID NO: 4775 - DNA, 460 bp, Homo sapiens
  misc_feature 4: n = A,T,C or G
ttcnaccagctcttgttctttttgcaggatccctcgattcgaattcggcacgaggcttgttctggggaaagctcatataagtatggattttattcctcaactagtaggataccaatactggtattgaaacttggggaaaataactggagataccagtgcagctatttaaagctgtagcaagggctgcaatcttgcggagattttaaagagaagttttaaagtttctaatactgatgcctctttttggtaaatacaagttttataaatcctgccctgggatcctgattccccattaatcaagatttgtcagacttcaccttctataattagaaaacacagttataagaacagtcaattttttaaattttccaaattaaaaaattgcaccatgattttgaacaagcacttccaattacattacccatcttgtatgccataggtgggagtataattgtcacag

SEQ ID NO: 4776 - DNA, 719 bp, Homo sapiens
  misc_feature 2, 7, 35, 628, 666, 668, 698: n = A,T,C or G
anctaangcttggctacttgttctttttgcaggancccatcgattcgaattcggcacgagattttaagtgtgcagctcagccgtatttagtgtattcacaatgttctgcaaccaccagcctcctgagtagctgggtgtgcaccctgcacccagccagaagtggaatatcttgttggggctgggcttagagctggagctggtggccggctctgctcgcttacagaattctgtacggtttctgatttctctcagcccatctgtccttcacttgcaagcatctgatgactgctgcatgtaccataaaaacatgcaaatatataattcttggctttgaggaggtgaccctatgaaattgacttaaaaaagttgggctggatatagtggctggcgcctgtaatcccagcactttgagaggctcaggccggagggtcgcttgagcccaggagtttgataccctgtctgagagagaattagctgggcatgttagtgtgcgcctgtggtcccagctactcaggaggcggggcgagagggatccttccagctgagatgtgagggttctttgagcccaggaggtccatactgcagtgagccatgattgggccactgcattctagcctcagtgacagantgagactgtttaaaaaaaaaaaaaaaaactcgagcctntnaactatagtgagtcgtattacgtagatccngacatgataagatacattgat

SEQ ID NO: 4777 - DNA, 742 bp, Homo sapiens
  misc_feature 5, 6, 8, 9, 10, 11, 12, 39, 47, 49, 688, 742: n = A,T,C or G
agagnntnnnnnttgttgactctaatggcttggctactngttctttntncaggagcccagcgattcgaattcggcacgaggcctggcgaattttttttgtatttttggtagagtttcgtcatgttgcttaggatggtctcaaactcctgagctcaagtgatccacctgcctcggcctcccagagtgctgggattacagtgtgagccaccatgcctcacctagggtgtttggtttttaagtgaaacatgcacatggtaaacattaaaaccgtctaaaaggctggaccatgaaaagcaaggctcccttctcccacccaatccctgaattctccctggagagtatccctcctaagtgcacgcacttccactctgttccatttctgcctgttaaaactacttagtgcagcttagtgtagtggaacctgcttcagaataacccatatgggtcttctttattctcatgaaccacagagcatttcatgtgttggatatattgtctcctacttacggacatttggggttgtttctgtttttgtttgttttgtgacggactcttgctctgtcacccaggctggagtgcagtggcacagtctcgctcattgcaaccttcacctcctgggttccaacgattcttccctctcacctcccaagtagctggggactacaggtgcctgccaccatgcccactnatttttggattttttggtaaaacaggggttcaccatgtttggccaggcttggtn

SEQ ID NO: 4778 - DNA, 799 bp, Homo sapiens
  misc_feature 6, 7, 8, 10, 11, 13, 17, 18, 19, 96, 117, 145, 348, 351,373, 378, 387, 392, 394, 401, 525, 542, 590, 622, 647, 648,664, 673, 700, 705, 714, 717, 726, 742, 747, 754, 758, 762,765, 772, 775, 776, 782: n = A,T,C or G
agtttnnnanntnaacnnnttgctgccatagcgtggctttttgcaggacccatcgattcgaattcggcacgagggggcccccatttttctcaaatnccctgagcctcaagaggtggnggaagagttgaagaagtacctgtcgtanggagatttgggtagaagccctcatgctgagctttgtgtccctggtgatgttggaacattaatgatggaacatggccaaacttcagtcatgatcctgaaaccatggcttcaggatcatgactgaagtcatggtttcttccctgccagaaatgaaggttcagttatgaggcaaccctctagtaaggcattgtaaaagttactggnttnggtttaataaaagttgaaatanagtanatgaaaganaaaananaaactcnagcctctagaactatagtgagtcgtattacgtagatccagacatgatagggatacattgatgactttggacaaaccacaactagaatgcactgaaaaaaatgctttatttgtgaaattcgtgangctattgctttatttgnaaccattataagctgcaataaacaagttaacaacagccaattgcattncatttcatgtttccaggttcaggggggaaggncttggggaagggtttttttaaattnnacggggccgccgtggnccaatgccnttggggccccggtaccccaagcttttnggttncccttttantgnaaggggttnaattggcccccccttngggcnttaaatncatngggncantaacctnggnncccccnggggtgggaaaaatttt

SEQ ID NO: 4779 - DNA, 834 bp, Homo sapiens
  misc_feature 5, 6, 7, 8, 9, 10, 15, 16, 22, 29, 41, 43, 52, 54, 58, 603,606, 608, 610, 611, 612, 614, 615, 616, 617, 618, 619, 620,621, 622, 623, 624, 629, 631, 632, 633, 634, 636, 637, 638,640, 641, 642, 644, 645, 646, 649, 650, 651, 652, 653: n = A,T,C or G
  misc_feature 654, 655, 656, 657, 658, 659, 660, 661, 662, 663, 664, 665,666, 667, 668, 669, 670, 671, 674, 676, 677, 678, 679, 680,681, 682, 683, 684, 688, 689, 690, 691, 692, 693, 694, 695,696, 697, 698, 700, 701, 702, 703, 704, 705, 712, 713: n = A,T,C or G
  misc_feature 714, 716, 717, 718, 719, 720, 721, 722, 723, 724, 725, 726,727, 728, 729, 730, 731, 732, 733, 734, 736, 737, 738, 739,740, 741, 742, 743, 744, 745, 746, 747, 748, 749, 750, 751,752, 753, 754, 755, 756, 759, 760, 761, 762, 763, 764: n = A,T,C or G
  misc_feature 770, 771, 772, 773, 774, 775, 776, 777, 778, 779, 780, 781,783, 784, 785, 786, 787, 788, 789, 790, 792, 793, 794, 795,796, 800, 801, 802, 803, 804, 805, 806, 807, 808, 809, 810,811, 812, 813, 814, 815, 816, 817, 818, 819, 820, 821: n = A,T,C or G
  misc_feature 822, 823, 824, 825, 826, 827, 828, 829, 830, 831, 832, 834: n = A,T,C or G
agagnnnnnnttgannctaatngctggtngctcgttctttntncaggagccnancgantcggtaaattcctgggttccaggctcaagccttccactgtatgctccatgttaccagctatgccttttgaacgggagatgttgcataaataattgttgagtatgcactttagattctttgctaacatcacatttggtgaaactataaaataattcccatgaaaattggattgcttaatatcataactgatatttaataatatttaatattgctctaaaatttctggctaaaatgaaaatattcaaccatcaggaaggagaaacaaaactattactgtttgtaaacagtttatcatcagtacttacctaaaaatcctggagaatgagctcagaaatatttctaagagttgagacagtttagcaaaatgaacagatacaacctcaaaccaaaccaaactagaaagctcagaggacacagaaatgccagtactgagctggcaacacctctgttgtttgtgaaaatgttctctggaacacatggacacaggaaggggaacatcacattctggggactgttgtggggtggggggatgggggaaagggganaantncnnngnnnnnnnnnnncccantnnnntnnncnnncnnnttnnnnnnnnnnnnnnnnnnnnnnnttnannnnnnnnngggnnnnnnnnnnnannnnnnctttggnnncnnnnnnnnnnnnnnnnnnnannnnnnnnnnnnnnnnnnnnnccnnnnnnaaaaannnnnnnnnnnntnnnnnnnntnnnnnaaannnnnnnnnnnnnnnnnnnnnnnnnnnnnnnnncn

SEQ ID NO: 4780 - DNA, 748 bp, Homo sapiens
  misc_feature 5, 6, 7, 8, 9, 10, 19, 36, 44, 46, 49, 683: n = A,T,C or G
agagnnnnnntttttgaanctaatggctggctactngttctttntncangatcccatgcgattcgaattcggcacgagtggaagctctcaggccaaggtgattgacagagatggttttgaagtaatggaatgtataaaaggagaccagtatattgtggacatggccaacaccaagggtcatacagcaatgcttcatactggctcatggcatcccaaaataaagggagaatttatgacttgctcaaatgatgcgactgtgaggacgtgggaagttgaaaatccaaagaagcaaaaaagtgtgtttaaaccacggacgatgcaaggcaaaaaagtcattcccactacgtgcacatatagtagagatggaaacctcatagcagctgcctgccagaatggaagcatacagatctgggaccgaaatttgactgttcatcctaagttccactataaacaggctcatgactcgggcacagacacttttgcgtgactttttcctatgatggtaatgtccttgcctctcgtggaggtgacgattcattaaaattatgggacatccgacaatttaataaaccacttttttcacctcgggtcttcccaccatgttcccaatgactgactgctgtttcagtccagatgataagctcatagtcactggtacatctattcaaagagggatgtggcancggcaaacttggtttctttgaaccgtaggactttccaaagggtgtatgaaatagacatcccagat

SEQ ID NO: 4781 - DNA, 747 bp, Homo sapiens
  misc_feature 3, 5, 6, 9, 10, 11, 20, 22, 51, 593, 663, 680, 684, 730,738, 744: n = A,T,C or G
agngnnttnnnctttgaatntnatgctggctacttgttctttttgcaggtngcccatcgattcgaattcggcacgaggtaagatcctgcctcaaaaaaaaaagtttatgttctcaaagtgctcataatctagtggtagtacagtatttgagatattagagcagtttctcctccttttgcaactaaggacatgtatccttaaagcagaaggaatggcagagtcgtgtaataaaccctcaagtaccattacttagcttcaacaactatcgacactctactgttcttgtttcatttatgcctcacctccttcccatcccccacttgaatattctcatcctttttttacagtttttaagataacaattacataactgaaatgcacaaatcttagctgtacagttttgacatatggatacacctgtgtaaccaatgactgtatcacaacatagagcatttcatctccccagcaagatccatgtgtcttttcctagttaatgcctctttatttctgagatggttattgctctgcttttgtttttcatgttaggctagtcttgcctgttctagaatttcatataactgagaacatacagnaatgtactcactagtagtgtctgactttttcacaaaggataatgtctggcggtattcattcatgctgggngtatgcatcagtagttnattntctttttactattaagtagtgttctaaggactattttaatagcatnccacaaanggggtntga

SEQ ID NO: 4782 - DNA, 747 bp, Homo sapiens
  misc_feature 5, 9, 12, 15, 16, 20, 22, 52, 53, 61, 90, 524, 561, 687,745, 747: n = A,T,C or G
agttnttcncangannactnantgggctgccctactcgttctttttgcaggnngcccatcnattcgaattcggcacgaggtgtgggtcantttcatcaagtactttacaaggtaatagaatatcacaaggcaagtggaggcagggtgagatcacgggaccagggcgaaattaaaattgctaaatgaagtttcgggcaccattgtcattgataacatcttatcaggagacagggttttgagatcaaccagtctgaccaaaatttattaggcgggaatttcctcttcctaataagcctgggagcgctatgggagactggggtctatttcacccctgcagtttcgacagtaagagacggccacgcccagggggccagttaagagacccacccccaggtgcgcattctctttctcagggatgttccttgctgagaaaaagaattcagtgatatttctcccatttgcttttgaaagaagagaaatatggctctgttccgcccggctcaccggcggccagagtttaaggntatctctcttattccctgacaatcgctgttatcctgntttttcaaggtgcccacatttcatattgctcaaacacacatgctgtacaatttgtgcagttaatacagttattacagggtcctgaggtgacatacatcctcctcagctgacaggattaagagattnaagtaagtaaagacaggcataggaaatcacaagggtattgactgggggaagtgataantn

SEQ ID NO: 4783 - DNA, 810 bp, Homo sapiens
  misc_feature 3, 5, 8, 9, 13, 14, 16, 17, 21, 24, 32, 50, 52, 53, 55, 64,65, 73, 80, 93, 108, 117, 129, 130, 154, 156, 161, 166,167, 181, 187, 210, 223, 225, 247, 248, 251, 252, 256, 259,268, 269, 273, 292, 293, 294, 309, 315, 320, 327, 338: n = A,T,C or G
  misc_feature 339, 343, 344, 348, 363, 380, 381, 383, 393, 398, 401, 402,414, 422, 428, 430, 494, 498, 523, 536, 542, 545, 555, 565,580, 597, 600, 602, 603, 604, 607, 610, 615, 618, 623, 626,633, 639, 645, 660, 673, 676, 680, 698, 703, 715, 751: n = A,T,C or G
  misc_feature 769, 775, 780, 794, 799, 801, 806: n = A,T,C or G
agncnttnnccanntnnactnctntggctgcncatactcgtcctcgcccnannangacagggcnnggcgaatncggcacncagaggcaggtgngttttttaaaaggtnaacacaccngttatgccttcnngtacgggcatgcgagccagaagantntgcanctgcnnggagagatgaagcnaaactntgcaacattcaactgcattaaanaaaaatgatgccnanagggcctttgagcaagaaatgnnggnngatnaangacacccgnngccngaactctgcgcgggacatnnnggttatggctctgtnagctcntaacnctgcagntgacccagacnnctannggcnggactaggggatgangcggctcactgtgggcnntncgtgagaccncaggncanncatgatgactgnaaacagantcccananactctactggatcctcccttttccttgctaacacatgaaactgatccaggatacacagcgcaanaagnatctgaatggcagtgaattctcttnaacataacccgcnatggcnatnggggcttcantggaatagangggtacaggtcaacnggggttgaccctgcggnttngnnnggncancggcnttntgagncanaaatacncgtaangccaantttacagccatgaancaaggatcccccnttngggntttggggatcatcacggnattgntgttggtggcantaacgctgaaatggaaaagggaaccttgccccttanatgaccctttggggaaancccctnaaaanggaatcgtaaaagnccaancnccaangtcg

SEQ ID NO: 4784 - DNA, 749 bp, Homo sapiens
  misc_feature 5, 6, 7, 8, 9, 10, 11, 13, 38, 46, 48, 51, 54, 64, 572, 711,749: n = A,T,C or G
agagnnnnnnntnttgactcctaatggctgggctactngttctttntncangtngcccagcgantcgaattcggcacgagataacttctaaggaaacaaaccaccctcacatgcactatctcatttgtatttctgtcaattctgaaaggccagcatttggccagtattatttgaatctgtattgtattttttaaccagaagaatgaaggtttatagcttcattcttttggaagaggaggctggagaccacaggttaaatgcaggtgcatcgctcttggccggccctggaagggtcctttctccctccttttacactcgcagacaagcttgtggatgctcaataaggacagctgccgtttggacagagattaatcatttatttgtgaaggttttttctgccttgctttcttgttcttttttaaatcttcacattgttttgatcccaaaatgtttgtgttgtccttactcaaaactaggaaaaacaattatgtggtaagaggctcagagccacttacttaaatctcactagatttatttgtgagaacatctgttttctgatatttagacacttnctcttccattgctgtttcctatgactcatgcacagttatttgttcaggtttcatgggaatttcccaagtgtatttacctttgtttgggtttttaaaaatgtaaattatattggcccaataaatgagtatgtgttgtcanggggactgtggctgggtcattgcatgtggaaggggaan

SEQ ID NO: 4785 - DNA, 740 bp, Homo sapiens
  misc_feature 3, 5, 6, 7, 8, 9, 10, 16, 17, 45, 48, 649: n = A,T,C or G
agngnnnnnnttttgnntctaatgcttggctacttgttctttttncangttcccatcgattcgaattcggcacgaggggccatgtacctcccggacaccctctctccaccgaccagctcaagtccacactgcagaccctcccagagattgtggcaaaggaagcacaggtgaaagtggccgaggtggagggcgagcaggtggacaacaaggccaagctggaggccacgctgcaggaggaggcggccatccagcaggagcaccgtgagaaggagctgcagaagcgctcggaggtggcgaaggattttgagcccgaacgtgtggtagctgctccccaaaggccggggaccgagccacagccagaaatgcctgacacagtcctgcagtcagagaccttgaaggacactgccccggtgctggagggcttgaaggaggaagagatcacgaaggaggaaatcgacatcctcagcgatgcctgctctaagctgcaggagcagaagaagtcactcaccaaggagaaggaggagctggactgctgaaggaggatgtgcaggactacagcgaggacttgcagggagatcaagaagggaactttcaaagactggtgaagaaaaattccgtggaagaatctaaagccagcaagagattgacnaaaagggtgcagcaaatgatcgggcagatcgatgctttgatctccactggagatggccacagcttgcagctggcccggcaacggatgccct

SEQ ID NO: 4786 - DNA, 746 bp, Homo sapiens
  misc_feature 5, 7, 8, 9, 34, 42, 44, 60, 646, 653, 655, 674, 686: n = A,T,C or G
aggtntnnnttttgaccctaatggctggctactngttctttntncaggttgcccagcgantcgttttaccctcctataatgcattttctttggatattctcctagattctcagggatatttccatattttactattcatgagtttagaagagtgtttactttcctgagttttcatttccttctttttcttctgtcataggtaatttacagagcaaatagccaccagagaggataccgtaagggatgtggaaaatgagttcctttgcgcttatccagtgaggttgattttcagtcaatgagcattcagtatatgcctgggactctggctttattttttagctttgtgatgccaaacccatcaatgaacttctctgtatatttgattcatcatgaaatggtgacactgagggtggctgatttccaggtttacatcagttgccccaggggaagtgcctggcccttgtctggttgttgctgctctaactttgccctgttaattgaagaaatgcggctgtaaacacttctggggtgttgctggtattttctgtcctcacagtttacagagaaacccatattttcagcctcttcctctgctttctgtcttttctggaaccatcttcaccgacctggtgtaatcttcattggngtgtgantntgcacagatgtaacatctnctcaaagcctantgcccaccttccaacttcacgaaaatctggagctcaggaccaccattctttccaaaccct

SEQ ID NO: 4787 - DNA, 743 bp, Homo sapiens
  misc_feature 4, 5, 6, 7, 8, 9, 10, 12, 581, 583, 588, 713, 731: n = A,T,C or G
agtnnnnnnntnttgactctaatgctggctacttgttctttttgcaggatcccatcgattcgaattcggcacgaggggcaggctttgagaggatcgactgcaattttgaaagaagttgtaccgtgagtaaaatgcgatcaaacagcattgcatgcttcagagaaatctttcttcacaaaaggaacaattggtgcagcaaaattaattttcttattttaagaaattgtcagccgggtgtgagccaccatgcccggccgacataggctattttttaaaatgcaagctcttctgaaccatataatatgatgttttaaaatatagactctgaagacaaagacctgggctcagaatcaggccccaccacttattttcaatggaatcttgtctgaatcttgtaatctttccaagcctcagttttttcatctgtataatagggataaaaataatagtaaacaaataaatgtatttcttttgaatatctagtagtattttaaaaatcagataactagaattatataactctatgtgctttattttttacttgtttgctgggaatcaaagagcttagttttgttttttgntntttgnttttttttgagaccggagtctcgctctgtcactgcactacagcctgggtgatagaatgatactctgtctcaaaaaaaaaaaaaaaggaaaaaggatgaaatcacacttggagcaaaaaacccaangcatatttaaagatttgngtattgggttaa

SEQ ID NO: 4788 - DNA, 754 bp, Homo sapiens
  misc_feature 4, 5, 8, 9, 10, 11, 14, 22, 31, 40, 87, 93, 154, 214, 292,299, 388, 390, 442, 453, 463, 471, 476, 498, 501, 507, 511,542, 575, 601, 634, 636, 648, 682, 687, 700, 701, 712, 740: n = A,T,C or G
agtnnttnnnnatnggaaaccnttatggctnggcctactngttctttttgcaggagcccatcgattcgaattcggcgcgagattgcncattgnttttatctgtaagttgtctttatcagtggttctcaaagtgtggtcccctgctagtatagtntcagcctcacattggaactggttagaaatgcagacttctcaggatccacctaattgcagnagttaattttaacaagcccttcggtgatcctgaaacatgttacagtttgagaaacactgctataatacgtgtcatttnaaattgnttcaggttgtgggggtagggaataagactaccaatttattcatcttctgtgcaatattacctgtttacctaactcttagagatattaananattttgaagaatgtgtcccatgagattataatggaactgacaaattcctatngcttagtgatntcatagctgncatgaagncttantgctgtaccttactcatgtgtntgnggtggngatngtgtacacaaatcttctgcactgccagtcgnctgaaagtatagcacatggccgggcgcggtggntcacgcctataatcccaacactttgngaggcttgatgcaggcagatcacaaggtcaggnanattgagaccatnctggctaacaccggggaaaccctgtctcttctanaaatnccaaaattagctnngtgtggtggcncacgttttgtaatcctggctacttggangctgaagcaccaga

SEQ ID NO: 4789 - DNA, 749 bp, Homo sapiens
  misc_feature 4, 5, 8, 9, 11, 12, 15, 20, 21, 47, 87, 90, 202, 398, 415,438, 567, 626, 664, 673, 674, 676, 722, 724, 732, 740, 746,747: n = A,T,C or G
agtnnttnntnnatnaactnnttgctggctacttgttctttttgcangatcccatcgattcgtctcaccgtgatcaagttgaggggnttncggctcccttctacagcctcagaaaccagactcgttcttctgggaaccctgcccactcccaggaccaagattggcctgaggctgcactaaaattcacttagggtcgagcatnctgtttgctgataaatattaaggagaattcatgactcttgacagcttttctctcttcactccccaagtcaaggggaggggtggcaggggtctgtttcctggaagtcaggctcatctggcctgttggcatgggggtgggacagtgtgcacagtgtgggggcaggggagggctaagcaggcctgggtttgagggctgntccggagaccgtcactncaggtgcattctggaagcattanaccccaggatggagcgaccaacatgtcatccatgtggaatcttggtggctttgaggacattctggaaaatgccactgaccagtgtgaacaaaagggatgtgttatggggctggaagtgtgattaggtangagggaaactgttggaccgacttctggcccctgctcaacactgacccctctgaatggtnggaggcagtgccccagtgcccaaaaatcccaccattantggatcggnncntatgaaaaagaagcctggaaaaagtattggggccaatgtgttaagngnggaatcancacattcntactgnnat

SEQ ID NO: 4790 - DNA, 749 bp, Homo sapiens
  misc_feature 3, 4, 5, 6, 7, 8, 9, 12, 13, 14, 21, 55, 610, 672, 719, 742: n = A,T,C or G
agnnnnnnnttnnntctttgngcctaatgcttggctacttgttctttttgcaggnacccatcgattcgaattcggcacgaggacttgatttggtaatgaaaggacaaatagctttcataacatgaacatacaaaaatagatgctttgctgttgttcagttttctcaagacttactgttttaagcttgtaaaattaatgaacagtaaaatagcagaaaatagtgatacattggatgattttaatagttttattagtgagatatttgaggtattcgaattactacaattctttccaatcctacaagttaaaaattttgttatggttgctgacttttaaatgctgtttattctctgaaggcagttttatgatgcatttagaaaaaaggtaagagagatgtaggcattatactggttcatcttttacctaatgcatgaccagtatactagaggaagttgtgatggaccagagtctttttgttttgtaatcaaatgaatagttccttcataaccaggacagctagtgtgtgcttgagaatgtctccctcactatatgatctgggatattctgcattaaaaggactcccttcccagtattgggagaaagagagatnaattgacacatttttactctgactccttcatttatctttccacataccaggatcattttggncttttaaaatgtccaaggttccaataagtttaaatggtattagtggncttctacatttgatcagtaatgnagatggc

SEQ ID NO: 4791 - DNA, 741 bp, Homo sapiens
  misc_feature 5, 6, 7, 8, 9, 10, 20, 23, 36, 44, 46, 49, 51, 52, 285, 361,364, 365, 372, 404, 405, 409, 410, 420, 429, 438, 495, 506,518, 519, 530, 533, 547, 549, 555, 566, 570, 624, 631, 657,661, 699: n = A,T,C or G
agagnnnnnnttttgactcntantggctggctactngttctttntncangnngcccagcggttcgaattcggcacgaggtccatctttgtagctgacatgacacattttaaaaatttcacattaaaatgaaggcatctaatggctccattatgtcttttagagtggtctggcccagctaattgcatattgaaatacattagatttgtcataaattactttcctttattgtcttttctgtcaatcttaggacattaaatgtatatgtttgaaattgtgtttaggtnggttatctgagcatttggttcatatagtaaagagagtgttataagttcactgtaagccccaggggctttgggactnatnnggtttanaacattgcactaggggaaatgaattgttaagnnatgnnacttctctanactaatgantcatctganttaatacttttcatgtgaagcatttttaaagaaagcaaaccagcctggtgcggtggntcacacctgtnatcccagcactnngggaggcagangcnggctggatcacgangncaaganattgagacctnctgnccaacatggtgaaaccctggctctactaaaaatacaaaaattagctgggcatantggtacntgcctgtagtcccagcttcttgggangcanagcaggagaattgctttgacccgggaatggaggttcantgacccaaatcgcgccactggctctacctgcacaaatgagat

SEQ ID NO: 4792 - DNA, 847 bp, Homo sapiens
  misc_feature 2, 3, 501, 565, 566, 568, 569, 570, 572, 573, 574, 575, 576,577, 578, 579, 580, 581, 582, 585, 587, 589, 590, 591, 594,596, 597, 598, 599, 600, 601, 602, 603, 604, 605, 606, 607,608, 610, 611, 612, 613, 614, 615, 616, 618, 619: n = A,T,C or G
  misc_feature 620, 622, 623, 627, 630, 631, 632, 633, 634, 635, 636, 637,638, 640, 641, 642, 643, 644, 645, 646, 648, 649, 650, 651,652, 654, 655, 656, 657, 659, 660, 661, 662, 663, 664, 665,666, 667, 668, 669, 670, 671, 672, 673, 674, 675, 676: n = A,T,C or G
  misc_feature 677, 679, 680, 681, 682, 683, 684, 685, 686, 687, 688, 689,690, 691, 692, 694, 696, 697, 698, 699, 700, 701, 702, 703,704, 705, 706, 707, 709, 710, 711, 712, 713, 714, 715, 716,717, 719, 720, 721, 722, 723, 725, 726, 727, 729, 730: n = A,T,C or G
  misc_feature 731, 732, 733, 734, 735, 736, 737, 738, 739, 741, 743, 745,746, 747, 748, 749, 750, 751, 752, 753, 754, 755, 756, 757,758, 759, 760, 762, 763, 764, 765, 766, 767, 768, 769, 770,771, 772, 773, 774, 775, 776, 777, 778, 779, 781, 782: n = A,T,C or G
  misc_feature 783, 784, 785, 786, 787, 788, 789, 790, 791, 792, 793, 794,795, 796, 797, 798, 799, 800, 802, 803, 804, 805, 806, 807,808, 809, 810, 811, 812, 814, 815, 816, 817, 818, 819, 820,823, 824, 825, 826, 827, 828, 829, 831, 832, 833, 834: n = A,T,C or G
  misc_feature 835, 836, 837, 838, 839, 840, 841, 843, 844, 847: n = A,T,C or G
cnntttaattccatcagctcttgttctttttgcaggatccctcgattcgaattcggcacgaggggtgcttctgtatatcctgacaacagtggccagccattaaagagttttgagtaggggaactggatttgtggttttagaaagatcatttggcttctgtgtgaaagaggccaaaaccaggagcagaaagaccagttaggaagctgtgacagcagttgagagacgatgttgtcaaagtctgcagcagaacagaacaggggtgaccccacatggacatcatctctgctcttcagtcacctgtagtgcagagttttgaagtaggtctgagcatggaacccgtagtggttgggaaggaaatgccatttgcctatggggtgattaagatctttttttttttcctcaggcggagtctcgctctgtcccccaggctggagtgccgtgacgtgatatcagctcactgcagcctccgcctccctggttcaagcaattctcctgcctcancctcccaagtagctgggattacaggcgcccaccaccacgcctggctaatttttgtatttttaanngnnnannnnnnnnnnnccntntnnntcntnnnnnnnnnnnnntnnnnnnntnnntnntttnttnnnnnnnnntnnnnnnntnnnnntnnnntnnnnnnnnnnnnnnnnnnntnnnnnnnnnnnnnntnannnnnnnnnnnncnnnnnnnnntnnnnntnnnannnnnnnnnnncntntnnnnnnnnnnnnnnnntnnnnnnnnnnnnnnnnnnannnnnnnnnnnnnnnnnnnnannnnnnnnnnntnnnnnnnttnnnnnnntnnnnnnnnnnntnntcn

SEQ ID NO: 4793 - DNA, 743 bp, Homo sapiens
  misc_feature 5, 6, 7, 8, 9, 10, 11, 12, 13, 16, 19, 23, 57, 483, 629,688, 719, 724: n = A,T,C or G
agagnnnnnnnnnttnttnaccnctaataggcttggctacttgttctttttgcaggnacccatgcgattcgaattcggcacgagcccaccttctctctctcattgtctgattgaaagcaccaggtctcccacattgctttcatctttgtgctgtttgttgtccctttccatatctgtatttatgctacctgttagggctcttgccgaagcaggggtgggaacaagaaccacagatatacttctgtggtttgtgaagcattgtgtggagggctgtgtacacagagtacctggggcagttgtcacagccactctgtgtggtagctgctactgtgcccatcttagaaatgagaaggctgaaggacccacccagggccacacagccagtatacccaaaagtcatacatttgtactctgttgctgtctcctgtcctatagtaccacgcactagggctcctgtccatgtgcgtaagaatgaccgcctanccgtcaataagatgatcagcaaggtcacacggcatggcttaagtctccctttgcctactgcatgatgatcccgggtggccagcaagcagctggaagaggaggatggcaggtaacggctctcatctctcaccactagatgatgcctnactcatcctaccatgctgggccaccccaacgttttcttgccacctatggtcttttgtancccgtgacagccactgtttgacttcatcganacttnttgcgcaacaagcacgaaa

SEQ ID NO: 4794 - DNA, 740 bp, Homo sapiens
  misc_feature 4, 5, 7, 8, 9, 10, 12, 25, 47, 88, 634, 685, 703, 735: n = A,T,C or G
agtnntnnnntntgaagcctctaangcttggctacttgttctttttncaggacccatgcgattcgaattcggcacgagggcagatgtncttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgcgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcacttttgggcctttgggctctggaacctgctctgggtcattggtgagacttggaaggggcagcccccgctggcttcttggttttgtggttgccacctcaggtcatccttttaatctttgctgacngttcaatcctgcctctactgtctcttcataccctggtgggggtcccccttntttctccatggacagaanaccaccactggggatggggaattaaagttganaacat

SEQ ID NO: 4795 - DNA, 744 bp, Homo sapiens
  misc_feature 4, 5, 6, 7, 8, 9, 11, 13, 18, 19, 34, 36, 44, 46, 61, 122,254, 319, 513, 566, 626, 681, 689, 702, 715, 742, 743: n = A,T,C or G
gagnnnnnntntnttgtnnctaatggcttggctntngttctttntncaggctcccatgcgnttcgttcaatagcatgttaagtagatattatctgacagacctacaagtctcacttatccgngacatcagacgaagagggaaaaataaagttgctgcgcagaactgtcgtaaacgcaaattggacataattttgaatttagaagatgatgtatgtaacttgcaagcaaagaaggaaactcttaagagagagcangcacaatgtaacaaagctattaacataatgaaacagaaactgcatgacctttatcatgatatttntagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgcagtagtaatgttcanaaactgattattcggatcagaaaccattgaaactgcttcaagaattgtatctntaaattctgctacttgaataactcagttaacgctgttttgaacttacatggacaaatgtntaggacttcaagatcacacttgtgggcaatctgggggagccacactttcatgaantgcattgnatacaaaattcanagttatgtcccangaataggtttaccatgaaaccccattnnc

SEQ ID NO: 4796 - DNA, 764 bp, Homo sapiens
  misc_feature 5, 6, 7, 8, 9, 10, 11, 13, 15, 23, 29, 31, 33, 43, 51, 53,58, 155, 170, 182, 189, 219, 228, 244, 247, 252, 264, 273,280, 287, 290, 307, 323, 325, 327, 339, 347, 348, 349, 355,356, 360, 361, 368, 371, 378, 380, 386, 390, 397, 403: n = A,T,C or G
  misc_feature 413, 417, 418, 434, 437, 442, 444, 446, 447, 454, 456, 460,461, 466, 475, 476, 485, 487, 488, 494, 496, 498, 512, 532,536, 543, 548, 569, 571, 584, 585, 586, 593, 600, 604, 606,611, 612, 613, 622, 630, 633, 641, 644, 652, 657, 662: n = A,T,C or G
  misc_feature 670, 673, 679, 680, 694, 695, 703, 705, 706, 712, 716, 718,728, 729, 731, 746, 749: n = A,T,C or G
agagnnnnnnntntntttgtctncctaantngntgggctactngttctttntncaggnatgcccatgcgattcgaattcggcacgaggctcattccagctggtctatcgtgggcctcacaaggtgaagagggaccgcattctggggcccacgatngaccacctgtagctnattccatcctgnaccttgnatgaggggtagcctcccactgcatcccatnctgaatatnctttgcaactccccangantgctnatttaagtgttnatacttttnagagaantgcgacnatncaattgtgagatctccncctgcccattgcctgntngnagggcacctctnctccaccnnnatgganngggnngcagctnaanggccctnanacgganctgntttcatnaagatnacattacacngagnngagctaactggcctgnatngaaangntnnttatgancnaagnnacaanctttttaanngttcctganannacttgngncnctagaacaatagantgtccaattacaaagatccncacntgatgcnatacnttgatgagcttgactacaccncngctttaatgcaannncaaaaantgccctntttngnaaatnnnacatacatncgttttangantaaccatncanaaagttgnattanaccangttgaacnccncaatgnnccttcaattttaannggctaggntnngctganggtnanggaccgcccnntnttgtttgctcggccnggnaatgggattggccct

SEQ ID NO: 4797 - DNA, 748 bp, Homo sapiens
  misc_feature 5, 6, 7, 8, 9, 10, 18, 21, 39, 49, 54, 555, 614, 721, 746: n = A,T,C or G
agagnnnnnntttttttntcnactaatgcttggctactngttctttctncaggntcccagcgattcgaattcggcacgaggtgatgctggtgatcaatggactggaagccaacagcagagacttagacccaagaagggagcttgaggtacaagaaaacttcagggtagacaggaaggaggcgtggtgaaagtgatgaaaggggagagtagaagggtggtccagggtcagacagggagttagatttaatccttcagggcactttcattacatcatagctgccattttgtcttttatctgactcaataataagtcagtaataagtaatgttttaattaaaggtaaatgcttggcaggtaggttaaacttcattgagtcccaatcctgtcataattattgtgtatacctttctcagctttttgtctacttgaaatatatttcttcttcctttgagcagccaaaatggaagtgttggatgtgttggctctgttggtaggctcctgttggatgcctgttgtcactcataaatgtaacaccacaaccataattgatggcanagttgagttgcaagcttttaggactaattgcaaagtctaaactaaaacatttcctgganctgcctttaaataataataataataccttgtatagatacagtgctttacaatttacagagcacttccacatacatcatctcatttaatcttcacaattaacaatgcnttttgaatgcttagatatttcctangg

SEQ ID NO: 4798 - DNA, 748 bp, Homo sapiens; identical to SEQ ID NO: 4797
  misc_feature 5, 6, 7, 8, 9, 10, 18, 21, 39, 49, 54, 555, 614, 721, 746: n = A,T,C or G

SEQ ID NO: 4799 - DNA, 749 bp, Homo sapiens
  misc_feature 5, 6, 7, 8, 9, 10, 11, 17, 18, 25, 268, 271, 326, 335, 516,521, 524, 561, 588, 597, 600, 659, 669, 730: n = A,T,C or G
agagnnnnnnnttgttnnctacttnatgcttggctcttgttctttttgcaggctcccatcgattcgaattcggcacgagcgcataaggaaagctggaaaataacctataaataatggcaaaaaaaaagcaaacaataggaagaggaactatataaaaggaacatttggagcatagaagagagttcatggaaatgtaaaaaatgatggtaccctgggtttgatatagtaagtaaaaaactaagggtaagagggtcatgaaagcatctanaantaggagggaaagccagtcaaattcacaggatgaagtcaggaagataatagagcantgcccgcangatcctgagggaaagcaagttccaatctataagtctgtaaccctcacacctgatggccccttgaacatattcagggcttcaaaagattgatctgtcatgcaccgtctgccatgatactgtgtgaggatgtgttcttcttcttaaacattaaatcaagaaagaatcatcagtggacccagtnaatancanatcagcctaggataagatgccctagaagatggtgaanggaagtctcagaactactgttcttcancaggcagcnaanacacctgatccatattggagtggtgggatgcgagcttcaggaagggatgccacaagggnaaagtggaanggatgatgactgtcttcaagaagttacaggtctttaagaatttacatccaacattactttngcttcgaagccccggctga

SEQ ID NO: 4800 - DNA, 749 bp, Homo sapiens; identical to SEQ ID NO: 4799
  misc_feature 5, 6, 7, 8, 9, 10, 11, 17, 18, 25, 268, 271, 326, 335, 516,521, 524, 561, 588, 597, 600, 659, 669, 730: n = A,T,C or G

SEQ ID NO: 4801 - DNA, 750 bp, Homo sapiens
  misc_feature 6, 7, 8, 9, 54, 536, 714, 721, 728, 746: n = A,T,C or G
agtgtnnnnttttaatccctactaatggcttggctacttgttctttttgcaggnacccatcgattcgaattcggcacgagaagagaccatcatctcatcaaagagagttaaaagtagggatgttctctgcaaggcctcttctgatatgattaattgattgtaaattaagtaatcaaggcatactttgttgatttgtcatatctgggtaaaaggtttatggtttatttaataaatgaaactgcaaaatcagttttctacatttctgttatatttttgttaaagcacttaaaagaatttctgctctgtccaggggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccaggtaagaatttggtgtatatttcattggttctgagagcactttaaggttgagatttaacacatcacataattattntattccctttttttttcctttaatagcctgctccacccagagaagcacactttgtgagaaccaatgggaaggagcctgagctgctggaacctattccctatgaattcatggcataataaggtgttaaaaaaaaaaaataaagggacctctgggctacaaaaaaaaaaaaaaaaaactngagcctntagactntgtgagtcgtttacgtanaacc

SEQ ID NO: 4802 - DNA, 743 bp, Homo sapiens
  misc_feature 3, 5, 6, 7, 8, 9, 19, 689: n = A,T,C or G
agngnnnnnttgatccttnctaatgcttggctcttgttctttttgcaggacccacgattcgaattcggcacgaggtaatttgtaaattctgtggtacttttcaaatgtatatcatttactgagtctgattatcacacggcctggcatataataagtactctataagtattggctgatttctaataggtctgaaaatttatcctttagaattttttcttcagttggtttagcgagtttccctttgatgttgaaaatgtttttttttaaaaatctaacctagaccatcccaaatcatgaattactgttgtgtgaaacagtgagactactgtttttatgccacaggtttataattatgcaaataaatactacatctttgcattcattttggttttacttaccgaattttcattccaggaatgtctgaatctgaacaggctcttaaaggtacttctcagattaaattactctcatctgaagatatagaagggatgcgacttgtatgtaggcttgctagagaagttttggatgttgctgccggcatgattaaccaggtgtaactactgaagaaatagatcacgctgtacacttagcatgtattgcaagaaattgctacccttctcccctgaattattataatttcccaaagtcttgttgtcctcagaccttattgctttaaaatataataatgntttcattacttttattatttggaatgatttagtaaaagttgactgaatctggtt

SEQ ID NO: 4803 - DNA, 743 bp, Homo sapiens
  misc_feature 5, 6, 7, 10, 19, 21, 24, 40, 49, 52, 53, 54, 55, 68, 70,78, 111, 115, 123, 130, 154, 171, 182, 190, 195, 209, 213,244, 251, 253, 257, 288, 384, 410, 427, 431, 439, 447, 454,462, 463, 464, 472, 541, 557, 563, 570, 585, 594, 639: n = A,T,C or G
  misc_feature 642, 647, 651, 675, 691, 707, 711, 725: n = A,T,C or G
agagnnntcntttaatctnantgnactcttatggcttggntactcgttnttnnnnaggcagcccatgngnttccaatncggcacgaggccaaatgcacttttgtgtatccnaagngaaaagangagaggnctcggatgaccatgcttagttaanggggagggtgacctttnatatgcaagtngggaaatncaganaaagtgaaaggggnccanaatgaaaacacatgaaataagataagcaganatgaaangnggcnctagaactgtaagaagcatttgaacaggcanaacagtgctggagactttaggagagggctcaagctgccatgtggccggtcctcaaatagttctagaatgactagcatatctttttacaaaactatnagcaacttgagggcaaaaataaagtntatttatcttgcatccngaanaataaacntggtgctnggcattnggtaggtnnnctttatgngtatatatgaaaagcatattttcattttattagaacattgtggtaaaaattctattgaaaaccatgctntaatgtagatagctcnacttanttcggangttccaaactttttngttcaagtncccatttatgctcctaaaattggtctgccagtctaaaatacttanttnatgtnggtnatgtctatcgatatttaccatttnagaaattaaaactganagatttgaaaccattntttnaaacccttacatgntaacataaaacgtatttt

SEQ ID NO: 4804 - DNA, 726 bp, Homo sapiens
  misc_feature 26, 36, 446, 497, 541, 555, 558, 585, 596, 597, 621, 646,665, 674, 700: n = A,T,C or G
cttatcttctaatggcttggctactngttctttttncaggatcccatgcgattcgaattcggcacgaggtgaccaccactccattcttgtctcctgtgttctcggttcagaccacccacaaaggcagcttcaaagccaaatcctcaggaagggggatctgcccgggctagctagtcacgtgtcaggcacagtcagctctgttgaggggtgtgcagtgagggctcagtgaggccacagagctcagatgtggctatgaagactcctggttggtgggggatggcagttctcacagatgagaggtatggatgggctgggtgcaatgactcacgcctatgatcccagccctttgggaggccaaggtgggcagatcacttgaagtcaggagttcgagaccagcctggccaacatggtgaaaccctatctctaccaaaatacaaaaaaattangtgcccatggtggtgggtgcctatattcccagctcccaggagactgagcangagaattgctcaaacccaggagcttgaggttgcagtgagtcaanatcacaccactgcnctncacttgagcgacagaataagactctgngttaacaaaannaaaaaaaaaaactcgagcctctanaactatagtgagtcgtattacgtanatccagacatgataagatncttggtgantttggacaaaccacactagaatgcantgaaaaaaatgcttttatttgggaaa

SEQ ID NO: 4805 - DNA, 747 bp, Homo sapiens
  misc_feature 3, 5, 6, 7, 8, 9, 10, 11, 12, 15, 22, 629, 717, 741: n = A,T,C or G
agngnnnnnnnnttntcttatntacttaatgcttggctacttgttctttttgcaggctcccatcgattcgaattcggcacgagctgagtctccttatagatgaggcagcagaggccttttacaaatacctctcttgttccagttacacaagtcataatttactgagcacgatggtaaaatcctttaaaaatgtagtaaaaagaacagagtatgcatatgcaaaggaggagattggggaaagcaaattagaagtctatgcattctgtagacagtgaaagctggttcaagcagaatgaataagaaagtaatttaaaaagaaggcatcacttattgactaaggtcaaacaggaggaatacacataaaaaccagaaactaacttcaagcagaatgaataagaaagtaatttaaaaagaaggcatcacttattgactaaggtcaaacaggaggaatacacataaaaaccagaaactaacagcaattatgatgataatattccaaaaaaaatcttgagtgaagaagaagaagaagaagagtaatagcaaacccttgtgataataagtgccaggtgtgtagtatgtgctgctattaaagtaaatggatgttcaattatttaatttataattctggnttcatggatagtcctttaagggaagtgctattttgatgttcatctttacatgtgaagaaccggttaagagagattactgattctccanggtcactcactgatgggtggtggnaattgg

SEQ ID NO: 4806 - DNA, 750 bp, Homo sapiens
  misc_feature 3, 7, 10, 13, 14, 20, 26, 46, 48, 51, 53, 54, 405, 573, 674,692, 705, 744: n = A,T,C or G
agngttnccntannaactcntgaaangctgggctacttgttctttntncangnngcccatgcgattcgggaaccaggggctgcagaacctttccctccccaatgaggaccccctctggacgcccctccccatggagaacaccaggagccacagaccccagaccacagagcacacaggggagggcacggggcggccggggcagggtgtctgctgcctcgtttatgggatttgctccgcgtctagcacactgctgcctgcagtgctcctgtcccctgcagtggctactctgggcctacgggcctaatcctggttggcatgaaaatgtcctgaggctactgtgacaaatttccacaagctgagtggcttaaaggaacacatttgttctcttacagttgcaggggccanaagagtctaaaaacagtcagcagggctggttcctcctggagcttagaggggctgaatccgtttcctgccttttttagtatctggagggcgcctgcatccccttgcttatggccccttccatcaccaaagccagtagtgtcacatctttcactctccctgacctgactncgcctttctcttagaaggaccctgtgtgactttggactactagataatttagggtcatctcttcatttcaggaacctggaatttaatcccacctgcaagtnccttttgccaggtaaggncacaaattcacanggtcttgaagatgaaagatgttggaccctttttgagggncatgat

SEQ ID NO: 4807 - DNA, 462 bp, Homo sapiens
  misc_feature 2, 10, 13, 14, 19, 23, 25, 49: n = A,T,C or G
tnttcatctngcnnttggncttntngcacgatccctcgattcgaattcngcacgagacacattcttccatttgtcagtaagagtaataatttgactgttttattggattttagcctttttgatttcatatagctgtatcttaatatatcattgtttttaatatgtctacattgaatacttattacttgtgcaatgaaaaataataattaaagatgaaagttaagcctgttaccactttcagagaacaacgtgacgttttggaatttaaaattttttcagtagatttgagaaaaacttgggttaaaatgaagatttatgctcagaactgagattccagggtttaagtctggttttaaagctgtcttcaagattttaatgtattttctgtgtgtataggatgctctcatttctgtttttaaaaatgaaagggatcgctcctgtaatcccagcactttgggaaga

SEQ ID NO: 4808 - DNA, 828 bp, Homo sapiens
  misc_feature 9, 17, 22, 28, 30, 127, 591, 627, 629, 643, 647, 664, 667,747, 756, 802, 821, 826: n = A,T,C or G
ccccctttntatacccntcctnctactngntctttttgcaggatcccatcgattcgctttgtcccaatatttgtgacaccagtgtaatgacttggttaagttgggttgaccaggttcctccactggncaggttatactttttcattctgtaattaatgtatcgctatatattttatatactttgaaactgtaaacatcttgtcctcatcaaaccttcacctactaattttagcagtcattgctaattttttaaactcccattctttctacatttagtagttggcattctactataaggaagaattttccctttttccttatttgtgtatacttatttattaatatttattatttattaatatatatgcaagtatagacacttgcattcttattgtattcagtggattatgatccattgctattttctgtttgggctaaattgtcccatattccatcagtgggaatgccttcaagttaactattgtgtgcctttgacatgtgcccaacatggtgaaacccaatctctactgaaaatacagaaaaattaccttagcatggtggtgtgtgcctgtaattccagctactctgaangctgagtggggagaatcacttgagcctataaggcanangttgcaatgagccnagantagcgctactaccactncanccttgggtgacagcgtgagaacctgtctcaaaaaataaaaaaagaaaagagaaaaaggaaaaaaaaaaaaaaaaaactcnaccctctanaactataggggaggcggtattacgtagatccagacatgattaaganacattgatgagtttgggcnaaccnct

SEQ ID NO: 4809 - DNA, 810 bp, Homo sapiens
  misc_feature 3, 623, 670, 729, 761, 770, 801, 808: n = A,T,C or G
ttnattccatcagctcttgttctttttgcaggatccctcgattcgaattcggcacgagatagtaaattagtcatagaaaggcaaactcaaataactttgaacacagctctttgactatccacctgtgtgtaaacaaacaaaactacaaagaaattttgtacttcacttagttggtagtgatctggtatagcaattctgaaaatattttctgtgtattgtaggattaaacaaataagtaaatataatgatattcttgggagctgggatcctcactatgagagaagaaagataaaaatatggagtgaaggaaggcaaagaagagctccatgaattggaatgagagattccacagattacttattaattacaaagataaaaaaggaacctttatagtggagaaacttggaaacttggtggataacacaacttttcgtttttttggagacagagtctcactccctcacccaggctggtctcaaactcccgacctcaggcgatccacctcaaagtgctgggattacaggcatgagccctgcgccaggcctatttttaaaaatcagatctctcctttgctccaatgtttttatcatggaaagagacaaatcactcatattttctttttncagacaatactgctttctgtggtgtagcccaaaagactcgtcttttncatgttcaggtaatttattctttgggagagcactgtaatcatatatcaatcgtattttnaaagtgactttattatttaatgtcaagaagtnccttggttntgaaagtagttttttttaattaaaccgccancagatcnat

SEQ ID NO: 4810 - DNA, 857 bp, Homo sapiens
  misc_feature 3, 4, 5, 21, 31, 34, 446, 633, 693, 724, 730, 739, 746, 768,774, 794, 796, 801, 820, 845: n = A,T,C or G
ggnnncccttttgaaaccccntaaagctacntgntctttttgcaggatcccatcgattcggaagaaactcccatgaagttcaaaggagcagcagatatgcagggtgcatctagaaatgaaaatctgaccctttgtccctctccttttcatctctcttttgtacaggccttctttccttctgtgcaaacagacccttgtcatagtcatagtccatcacgctgttaaatgatttccagcactgctctatgatgtgctgtaatttcagggagtagtttattttctacaacatgttgctctgtagcacgtgtatttcactactgagtggtagttctaatggacatattcttaacaaaatagtcccagcattacagaatactaggttagaatacatacccaaataaataaaatgttacagacacagtccaagctcgttctctcctgacttnctttctcccgctacagaggaaaattaccccgaattggcacatctcattcctatgcactcttgttaaaaataacttatagtttgcttctgaatttatagaaatgggcactataatccatatgtcttttgaatctttatacatttgatttggagaaagtatttatgtttgatgccatgtggctttaggncatttattttaattttggttatttttttgagatgaaagtctcggtctggcacccaggctnggagtgcaaatgggcacatgggaacctttgncctccntggggttcnaagcaanttctggtcttcatacctgtaantcccancaccttttaaagaaggcccnanggcgnggggaagggatcaatttgngcccccttggaattttggaggaccnagccctggggct

SEQ ID NO: 4811 - DNA, 814 bp, Homo sapiens
  misc_feature 634, 680, 704, 731, 750, 751, 755: n = A,T,C or G
ttccatcaagctcttgttctttttgcaggatccctcgattcgcttcagacctgtgtttaaattttagctctgtgatctggtagcttttgaccttgagtaaattgcctaatgttactcagtcttagtttcctcatcagaaaagtggtaaggatgataaagtagttcataaacattcattgagcactaagtatttgcaagatactggaggtataaagatgaataaaacactgttcatgtctttgaagacttcctagtcaagtggtgaaattaaacataaaaacaggacattttaatattacgtgcaaagcacatagtgggcaatgtgttggtttgaagaaggatttttgaggaagtggaagctgaactgcagtttgtagaataagtaagagtttagtcaggcaaagcagatagacaaggtcattttgggtggagcgattaatataggcaaagtcatgcaatcatgaaatagcatgatatgtatgtgaaataagagtacttttgcattgtaggggcattaaacaggtgagcagtcactggagatgagattggaatggtgggcagggcctaagtccctgagctgcaatgtcattgaagctgaggacattgagaatttaaagagatagagtgagtctgnggcctttgctcataactctcattttgaaagactaatgtgtgacatnccacattttaggggtaggaaggcntactggaaggattaacccaaagttggntagaaactgggagaaagannaacnccctcaaaaagttgcttgagagctaaattaattgaatgtggcttgggaaggatcaattt

SEQ ID NO: 4812 - DNA, 825 bp, Homo sapiens
  misc_feature 712, 737, 807, 810, 812, 821: n = A,T,C or G
gattcccatacaagctcttgttctttttgcaggatcccatcgattcgaattcggcacgagggaaaagtaaagagatcaaaatgattttatatgtattttttttgtactcagagaattacattttcactacccccgcctgtctcagggaatagcctttgataagaatcccatggagatctctggaactctattacagtgtgttcagatttgttagttcatatgtaaatttcagagctagagcttcaaaactagagtattgtaatctcaggaacataagattatccaagaagcctgaaccttgctcttttcatgataaatgacatccaaatttcctttgtctaggagataagcatagatcccttttatcatgcttctctgagattttcacagaacaaccctgcaatttgattttgtttgataattttgctttttggcttttcagtgaggactctattttccattggaactgactcctttggggataataagctttcacttaaaagaacattccattagatagttctaacttcaatgaacctaaaagtggcttcttaatttgaataatctggataacttttgcaaatgggtcaaaacagcacaagtattatacatcaaataaaaagttcattacaatatttgtactcataaagtcaaaatctgaccctggttcgctttgtgcctctgtcagcctacttacaggggataaaaggtncacaccaagtccagtggttgccaanggagctttggttattagaaaagaagcctgggtccccctcagttctatgccggtgggggggggcccgggtnggnancatggccgncatg

SEQ ID NO: 4813 - DNA, 877 bp, Homo sapiens
  misc_feature 3, 5, 31, 96, 154, 768, 793, 828, 839, 842, 867: n = A,T,C or G
ggncntttaaacctttgtacaagcccttgtnctttttgcaggatccctcgattcgaattcggcacgaggcaacaaaagcatacaagatcttttttnaggaagtggaggagctgcagggaccgaccgggagctttcccagtaagcatcagttcanaaacaaatttaagtaaagaaatggaatctgtaatgaaagatataaaaaataccactcagaagaaatatagagactatagcaagaccccgggctcaccagacaatgattttctctttatgtactctgttgctagaaccaatttagaacttgaattgattcatcgaggaggcaatttgtgttcaggtggtgcaagcacagctggcaaaaggtcttgtttaaatcagctgtttcatgtattagccttgcacatgcggctttatagcattgactctgagtataatccctggagaaagctcacccagttagaagagatgaatccacagctgggatatgaagaacaacagcctgaggttccaattctttatcatgatgtacatcccttttgctcatccagatcttaatgatgccacaacccttacgcaaaagaccactttacctgcattgtgaaggtctttttaccctactgtacacacaggctcttgcagcactctcaagttaaaatgcagccgaagaaaatagggtcagccctgggaaacaccccgggagcctcttcaaaaaagaagtaccattgtggatggccagaaaaagtctttaccgaaagtatttaacttggnggccttttggtggaataaaggtggnaacctatttttaaaaagggaaaagttttttccccntggaaggaaanggnaccttcaggggaatggtggccaatngggtttaacc

SEQ ID NO: 4814 - DNA, 912 bp, Homo sapiens
  misc_feature 1, 3, 8, 9, 24, 26, 42, 64, 70, 75, 76, 82, 83, 88, 113,121, 135, 136, 137, 199, 231, 247, 272, 311, 345, 428, 431,432, 447, 460, 462, 474, 490, 499, 506, 508, 513, 515, 518,526, 533, 542, 550, 572, 575, 582, 586, 587, 592, 593: n = A,T,C or G
  misc_feature 595, 600, 610, 612, 615, 624, 630, 640, 667, 677, 688, 697,707, 710, 714, 716, 719, 720, 729, 734, 741, 748, 752, 784,787, 791, 807, 812, 819, 826, 828, 830, 831, 836, 844, 847,852, 854, 863, 869, 883, 888, 900, 901: n = A,T,C or G
ngncttgnnccttgaaacccccgncntggcggacccatcgantcgaattcggcacgagggtcancaatangcganncttttnnatccnggcgagagacacgccaatagggggnatttaganacgtggggctccannnattttctctggggacaagctcattccttcctcattttctcagaactttggtgttaacagccngttgcctaatttgtaggggctgactttgactnagcagatgccttctgnagatggaggaaataacgacccagcnccttttaattcacccaagctgaaaccaaatgcgaacccngagcagcctggattcattgacgagccagcaccantgaacccacccaaaccaaagccaaatccaaaaccccaagccggcctgaattccaccgggggatgacttttgatctccacaganggnntcttcatggggaacnaaaaacaggggangntgcactcgattnctggaagtggtatgcntcaggagcnaccgtgnantgtantncancccactcntcaaatncataaactntgggagantccttcaattcactgggcaaanccntatgccntaanngctanncnctgangggaggctcntncantgcaaaaanccaaanatccaacctngggaagaattcaagtcaaagacccaanaaggaggccnggcaatcaagnctccttggncaccgaatcnttnacangncanngcttacccnggganggcaccntatggcngaanctctgtggggggcaaaccctcgtggggacctnccntggnttccccagggggtgcncacanatattangcacctnantnntttanctgcccantgngcgtntnttatggaanaaaagnaaatcaaaacatgnggganagggaaacccannaaaaaaaaacc

SEQ ID NO: 4815 - DNA, 816 bp, Homo sapiens
  misc_feature 563, 579, 620, 690, 696, 700, 736, 775, 790, 807: n = A,T,C or G
ttgattccatcagctcttgttctttttgcaggatcccatcgattcgctacgaccccatcaatttggcctataacttgaaagagaattctatcctgctagctaaagttgctcggagtgaccagtgagattgttccacagcatgtatattataaaacaaatattaggcagatagcttataatgactttttaatatttatttattcatttattttataataagcagacattgggacaagaaacttctgaaaatatttatagttctctgaaagaaggtgtcttcccttccttctgggagttaaggaatgttttgacaaggaagaaagatgggtgaataagagtgtattgtattaataactaacattaattgaatatagaatatgtactaggggctgtaaaaagctctttatattggattatggtatttaatcctcaaccttatgagcctgatgctattaatgcctctattttataaatgaagaaattatgtcacagaaggttaaataatttattcaagggcaacttgccaagtgagcattaaacccccagagtgatcctctccctangtgcagagcaaagttncaaggggcttggtatgcaccagtctcagatgattctattgngggtggctgccagaatcaagcttgctgtgaaaacactgattggaagaaaaaatagtccccaccagctatngctatnggtncctgtgcatgaacctgagaagaaagccaagccgccntaaaagatgtagagtccaaaccttttgctgcagcttccntggaatacgggcatntgcacccaaaacatggnttaaggggg

SEQ ID NO: 4816 - DNA, 817 bp, Homo sapiens
  misc_feature 6, 486, 517, 661, 668, 680, 720, 726, 728, 775, 809: n = A,T,C or G
attcanatacaagctcttgttctttttgcaggatcccatcgattcgaattcggcacgagaggaagagtatggctcctgaacctacacagagctctacagtagtcgcatctgcccagcaagtgaagacaacgcaaacttcaaatgctcctgatgtaaatgatgcaattgtgaaactattcaatgattttgatgttaaggaaacctcccatcatttagtgatttctcatctagatctacacatatgtgatgacattcatgctaaagaaaaagagtcaaacagacgtattactggaggggcaatgcaactctcttttacacagctaactatagattattatccttatcataaagcaggagatagttgtaatcattggatgtattttagtgatgcaaccaaaacaaaaaatggatgggccaatgagttattgcatgaatttgagtgcaacgttgaaatgcttaaacaggctgtgaaggatcataatgtangttcacctcctaaatccccaacacatgcctnttcccagcacacacaaacagagaaggactccctctgaaagggacatgcagaacaccttcagtattatctcaacaatcaaaagctaagctaatgtctagttctggtgtgggtagacttgcagatttcaatatatcccaggtcttntacagcnggacaatgtcgntctttcccccaaaaaccatgatttgctgcaataaaaaatncctttntntttccacaagaaaaggtcagctgtcttttttagaattcaccagaatntttcctattccaaatgggaaaggatttttccaanttccatct

SEQ ID NO: 4817 - DNA, 804 bp, Homo sapiens
  misc_feature 5, 582, 597, 626, 663, 735, 739, 748, 772, 785, 799, 804: n = A,T,C or G
attcnaatcagctcttgttctttttgcaggatcccatcgattcgaattcggcacgagcaaagccatatactggtgaatatatactgggtcaagcaccacatgttagttttggaatgtgtatttcccagcgaatagaatttactgctccaaaaagcttttttggcataaatcacaatacttacagaaatataattgtatcattgaaaaaaacaaagctcaccttcctaatgatacatttcacaaactgcacattagggcaatttcttacttatgaggaggtcaaagaaatactctgtcaatatagtataactgcttatttcaaattgtatctaggaatgaataactactattatttaaagtactactgaattttgaggaactgatcaaagaattagtattattaataaaattgtactatttgcaatatatttgccttggcacaaatgcagagttaaaaacataaaattataaaaaaaaataatagtgattggttgttactactttaaaatcctactaatttccattagcactaaatcaaacagcacttatctgttgtatacaagtaaaattttgaaagactcngacacaaaatgaaangctttttaaaaatgtctttgccataacanggtatatgaccccttgctaattggtatatttccttangggcactttgaggctctttcaaaagacatctgcgcaattagggcttaaattagaagtagaaatattttggcngatntttactatntcacaaaaaggcctacctactggntttataataaaanccaattctcaagtnttctn

SEQ ID NO: 4818 - DNA, 789 bp, Homo sapiens
  misc_feature 16, 540, 645, 654, 671: n = A,T,C or G
ttttgaaacccatcanctcttgttctttttgcaggatccctcgattcgtccacacctcacgttcagtcacagccctcagctatcttccctccggccactgggctacctctccttcagtcccagaagacaagtctcaccaacccagggagtcaaggaccagcaaaccaaagtggataatggactttttcattcctgtttttcttggcaggagagaagcaaggccactaaaagaggagatggtggagacggaggctcagcagtggtcttgaggggtaaaggacttagatgcccagatgaagagggaaagctgacatctgcagggaacccactttgaggctgaggccatggcaggacagctgctgtggggtgcagaggcagaagatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggangtcaagcgtaatgtccttctgataaataaagcccttgctgaaggaaaagcacctagatcaccttatggatgtcgcaataatacaaaccagtgtacctctgccttntatcaaganacttgggtgctttgaanataatcctccccttttccccaaatgcagctgaacatttacagtgggttgccttagggattcattcaatatgtttcctactaggaatccaactttaacatttttaatctcaaatattat

SEQ ID NO: 4819 - DNA, 871 bp, Homo sapiens
  misc_feature 540, 598, 632, 659, 709, 712, 725, 729, 743, 744, 745, 746,747, 748, 749, 750, 751, 784, 805, 808, 823, 851, 865: n = A,T,C or G
ttcccatacaactacttgttctttttgcaggatcccatcgattcgaattcggcacgaggttgggcttagaagatggggctgagtagggagagagggtgctgcctgggagctgagccatacaagtgactgcacaggttgacatggaggattaggtggagtgaggcttccaagcagggaggggaatgatggtggggcccaaatgaggagccacatcgaagtagatgagagaatagaaggtgaagtaagggctggcgttgggtagggggagacgccagcagtgatgctgatgcccaggctgtaggtgtataggtgccatccacctggtaaagagagagctgtagcgcaggaatgaggttgcacatgtagaagaagggaaggatacaggggagagaagtgtcttctagtcctaaaaaacagcctgtgggctggcatggtggaacaaacctgtaagtcccaacacttcgggaggtcaaggtaagaggatcatctgcttgacccaggagttcaagaacagcctaggcaacatagtaagatcccatncctacagaaaaattaagaaattagcccggatgtcgtggcacacaccttgttgtctcancttacttggggaggcccgatcttttggagccccngggaaggtcaaagtcttccaatgaccnccattgatctttgcccacttggacttttaaaccctggggccaacttgacntgnccaaccattgttntttnaaaaaaaaaaaaannnnnnnnnaacttcgaagccctttttaaaaactttttagtngagttccttatttacccttanatncccaacccttggttnaggatcccatttgattgaattttgggancaaaacccccaacntttgga

SEQ ID NO: 4820 - DNA, 779 bp, Homo sapiens
  misc_feature 1, 5, 11, 17, 93, 542, 657, 688, 710, 746, 757, 767, 779: n = A,T,C or G
naaanaaaacncttttnaaactacccggtctttttgcaggatcccatcgattcgaattcggcacgaggcctaaagtaactgaagatccatctnttcgtatacgtgcaagtcacaagggatgcgatggcttggcttgggctcagaggcctgacactagttattataaaatgtactttcagcagtcttctgggacttgactaccttgtggattgtactagaaatgtcaggtatggtgactgctctgcccaccactctaaatgaaactgtccccccacagtctctgttgcccaggtgtcctatgtccctcgtcacagctgaatggaccaaggcagatgtgctatcaaggacagccaatcacaagtgagcagtaatctctgatatgctttggtgcaaaaagctgagttgagtcaacagttatttaaatttgtgtgcagtcacttccgtttgctggggaatggcgtggtgagggaagattgatataagttacctcatatctgggttacatggatatatatcctacagttgcttaaaatacatttcangattctttggtttgcagcatgtgttttggaaaggacagggagaggaaattaagaagtggagtgaaatccaaggacccttcacctgcccaaaaagtgacgggcttctggtgtcaancaggtgacagctggcaaggctttgccctganggtcgacagacaaaacaagcantgcacatagggaagacacaagcaaaggttgagctcnttgccatatanagctgcatgnaaaagcttaacn

SEQ ID NO: 4821 - DNA, 1005 bp, Homo sapiens
  misc_feature 70, 113, 185, 243, 255, 322, 324, 337, 344, 346, 361, 383,391, 392, 422, 460, 487, 492, 544, 551, 555, 606, 611, 617,619, 643, 658, 680, 688, 693, 713, 721, 728, 738, 743, 754,763, 771, 779, 782, 784, 789, 796, 814, 820, 828, 830: n = A,T,C or G
  misc_feature 833, 837, 849, 855, 872, 882, 895, 898, 913, 934, 939, 955,972, 974, 984, 1002: n = A,T,C or G
gatcttctgtcatttgcttttctgagttttggccctcctgtcaatctatctggtcgggtttacttttctncatcttcaagcaggggtgtgtcttcaagcatgcatgtctgtgntttgattcggaattgataagttataatagaagcatgagctgctgggaaaatatacctcctgatttgtgtggntttatttgttcatcttgcaggttttgagtagtttttggtggatgtgttgggagatttnaatgttacttanctggtattatctctactactttgggggtcaatattgaattttttcactgaatcccagcccaacactntntttttttttggcnctaattncntcgaaaaaaaatggngtttggatttaagaataaagangaaaagtnntggtttttttagccagggttcttgtcctancaggaaaaaggcttttggttccttaagaaaccccatanccaatttggggaaatttttaaaatttnaaatncaaaaaggccctttatatttattgggaaaaccatccttggccttaataattnaattccnggcnaaatcctgggaaaatgggaaaaagtttaggaattggaaaaaaaaaaaaagnacccnccgggntncccaaccaaataaaaatacccccnccccaaaaaaaccanggccatagaccccacctctggnaaatttcnaaaangggggcctttaattaataangggggggnaaaaaanatttttcagnccctnttggaaacccntttgggggnggcccggnatttaccngtnanaaatncccccanccttggaattaaggaatncatttngggtggananttngggnccaaaacccccnaacttnggaaatgccaaaggggnaaaaaaaaangcctttaatttgnggnaaaaattgggggagnccaattggctttaatttgggnaaccntttataaagcccgcanttaaaacaaggttaacncnccccccaatngccattccatttaaaggntcc

SEQ ID NO: 4822 - DNA, 790 bp, Homo sapiens
  misc_feature 4, 5, 6, 7, 8, 9, 10, 11, 14, 15, 16, 17, 18, 19, 20, 29,35, 40, 42, 113, 275, 280, 290, 332, 342, 361, 392, 424,430, 501, 518, 564, 663, 736, 743, 746, 759, 761, 763, 769,770, 773, 774, 776, 778, 779, 780, 783, 786, 789: n = A,T,C or G
tttnnnnnnnnttnnnnnnnttttgaatntgaaanccttnanacaagctacttgttctttttgcaggatcccatcgattcgaattcggcacgagatataaaagcgtttagaanaagaagcaaaagagacccgcacattccacccagggagggcatggagaaagaacagtgagtggaaggaaaacaggtctgtgctgcctcaagcatagaggtctttctatggcaggcacccggggcagccaaaaggacactgtccacagccaggccagagtctanctgtnacacacatangcaggtgtgttgcatacctcaagcatgcgttcacgagttgtnatacttaagngaatttgtttttttacagnaacaacctatagttccatttaaaaagggatngttatttaattttaattaaaacatatagtagntgtttnctcactttggtttatgtatccattttcaacagctttgttgaggtgttgtttacacaccctcaaattcactngttttaagcatacaatntaataatttttagtaaattcagaattgcgcaaacatcacaatctantaatagaaattttctttcactccaaaagaaacctgtgctctatttagcaactccctgttcccgcccagtaagcccatatgtgggcaaaagttgactganacttgtgatttttaattgaaatatcacaaaacttattgcattttttttttgagacggagtcttgctctgtcgnccccagntgnggggaaggggctncntncccccnnctnngngnnnggnggnccnt

SEQ ID NO: 4823 - DNA, 462 bp, Homo sapiens
taacatcagctcttgttctttttgcaggatccctcgattcgaattcggcacgagcctagacacctcgtattggggaaagtcttaagtggttggagcccatgacatttgggtatgatgactagattttttgtacagctgagcctcaataaactcatgcgtacacttgtgagaactcaaatcagaaatgggcacagaaactggattacatttctgtgctctgaaatcccacagagttcataaaaatacacatgtatacacaaaagcaacaaatgtaagttacattttattatggaaattgatattagtgaaattgacagctttctatggttaaagattatcctgtaggtgagccaaggttctctgtttttctgatttctcttattcattccctataatttcagcattttcgttctcattgacttaatattcctgagggtattattgtgaatgtctttgtttatg

SEQ ID NO: 4824 - DNA, 475 bp, Homo sapiens
  misc_feature 3, 5, 184, 371: n = A,T,C or G
acntngatcaagctacttgttctttttgcaggatcccatcgattcgaattcggcacgagatctttaaagaaagcatccacagtttctgtgccatttcattgacaggttttattttaaatggtagaccatccaacagagggatagggagctgcagcggtgtgctgcttagactcaaaaagagaantctcgctgactcatgcaggttgaggttttgtctcattcccaggaatgcttggactcccagaggcagtgaagccacacattttagcagaattacctcagcagtgtggtgcatgatcatgaacttcaagtttacctacaaggaagatttcattgtccttctgtcactagccaaacacttcacagcctanactcctggactacataaaggcccatacaaaagtgtttgtgtgcatttgtgtatgtgtgagtgtgtgtgtttgcagtgggagaggacacttatctttgctctccc

SEQ ID NO: 4825 - DNA, 460 bp, Homo sapiens
  misc_feature 204: n = A,T,C or G
ttcattactcttgttctttttgcaggatccctcgattcgaattcggcacgaggcggagcttgcagtgagcagagatcgcaccactgcactccagcctgggtgacagagcgagactcctctcgaaacaaacacaaaaaaaagtttcaaagacagaaagtggaagttacaaggctttttaaggccttatcttggaagtcacagcancatttattttgcattccattggtcaaactcaagtcctaacaggcctaagggggtcaagtaaaaggtgggactcacaggaagttccatatacattacagcttcacttgcagtacagaggggaagggaaatcctactgggacagaacctcaagtagcatacctggttgtatattgtgcctggaagaaaagatggccagaagtatagatctatagatggatggtgattgatggatggtttgactggatggtcagggatt

SEQ ID NO: 4826 - DNA, 463 bp, Homo sapiens
  misc_feature 11, 23, 133, 159, 223, 299, 301, 342, 344, 355, 362, 392,399, 405, 412, 417, 432, 433, 434, 436, 437, 444, 450, 452,453, 454, 456: n = A,T,C or G
cttcgtttgantcccgttccaangcaggagcccatcgattcgaattcggcacgagactttgcatttgctcgttttgttcaacttttccttccttctctgcctgccaaagaaactgtaataactgtaataattnttatgactttctcttcaatgacagtnatcttcctttaccctaattccttccctcctcatccttcaaatccccttcctcatcattcaaagnctaactcaagctagcctttcctccttattttccccttatctttccaatccgtatggagatttctcacctttcctgntngaggttgcgccagaatggcgaggattaaattgtaattgctntntaatagactgntgtgtcngcccactagatttcaagctctctaaaggtnaaagctntttctnacatcanaactngagtcctttatggannntnncacatcngaaggncnnnanttatttg

SEQ ID NO: 4827 - DNA, 457 bp, Homo sapiens
  misc_feature 263, 406, 435: n = A,T,C or G
tattcatcaactacttgttctttttgcaggatccctcgattcgaattcggcacgagtctagctcagggtctctcatgaggtttcagttatgatgttggcttgtactgtgtcgtctgaagcctggctggctgaagcatctgcttccaactcactcatgtggccatttcccagagcccagtccttactggctttttgccagggaggccttaatttcttacatatgggcctctccatagggcagcatgcactttgcagctggtctnccttacagtgaatgatccaagagagtatgagagagtgtgccacaatggaagccaggtatctgttataacctcatcttagaaatgatataacatcactctgccatattttgtcagttgcacagacccctggtacagtgtgggangtgacaacacaggatattaataccaggangcaggaatcattgggaccgtct

SEQ ID NO: 4828 - DNA, 465 bp, Homo sapiens
  misc_feature 85, 86, 109, 218, 234, 380, 387, 391, 404, 421, 458: n = A,T,C or G
ttccatttagctacttgttctttttgcaggatcccatcgattcgctacgatgaccccctcttcaggctgccatttggtagagggnnagggagtggctagccatcgagtnagaccatgctttgcacccaccatcagcaaggctcaagatagtgcctggcgtgctcagaataagccttcccttctgcagggatctcatctccatctgtgggaaccaggtntgaggctctgaacagntcctgctctggcaagacacctccacatctttctccctcaaacattcatagcctctctgccattttatgcttctggtacaccagaaataatatcacaatgccctgcatcactgacccggctggataattccttttcaatatgtcctncttgcangcanaagatcttgccanaagactgagaacccagncttccaagatggccacagctgcaccaaagatcacaangtaattg

SEQ ID NO: 4829 - DNA, 463 bp, Homo sapiens
  misc_feature 51, 109, 141, 191, 213, 230, 237, 245, 249, 288, 306, 312,315, 369, 381, 399, 429, 459: n = A,T,C or G
attcatcagctcttgttctttttgcaggatcccatcgattcgaattcggcncgagattccagcatccatcacagataacagacagcactattcatgaaatcccaacaanaacacacgccaagttcccatatacaggtgcanggcatgcttcatttaccattgaatttgatgacagtaccccatggaaggtnactattagagaccatgtgacanagtttacttctgatcancgccacnagtccaanaagncttctcctggaactcaagacttgctggggattcaaacangaatgatggcacccgaanacaaanttnctgactggctagcacaaaacaaccctcctcaaatgctatgggaaagaacagaanatgattctaaangcattaaaagtgatgttncagtgtacttgaaaaggttgaaaggaaatnaacatgatgatggtacgcaaagtgattcanagac

SEQ ID NO: 4830 - DNA, 464 bp, Homo sapiens
cgtcattcagctcttgttctttttgcaggatcccatcgattcgaattcggcacgagatcatctagaatcccagcagtttccttaagttgcctactgtcaattttccatttctctcgtccaaattcacatggagacatcatttttacacacttgtaatcaattgtaggcggagtctgggggtcctagcacttcccctaacatcatctcatgatacttagacttttaaagaacccttgagtaggccctgtgataaaggatgttagtgaaaaaaataatgagaaacagggacttggcttagagaaagaagcctgcgtcagatcagtaggcccccctggggctgtggaagcatgcagaaggtcccttaggaagtgatgttggaaatggccttgggccagccacgttatttctctggacctcaggtcacccatctctgaaatgggagcattgaactggctgatccctga

SEQ ID NO: 4831 - DNA, 458 bp, Homo sapiens
  misc_feature 1, 7, 80, 148, 150, 155, 165, 173, 180, 190, 215, 254, 271,426, 458: n = A,T,C or G
nccttcntctcttgttctttttgcaggatccctcgattcgaattcggcacgagggaaaacggaaaaaactcaagagtganaactaagtggtgtgtgaaaatgtcattgtgcctgggtggttgaagtcattaaatcagagagccaaaantncctancagagtggancgaaaaangaccggncagacagtgngaataatatatcactgatgtaaaancaactcatatgatgcttgtaaatgtggaaactataactntccctggaggggtatanagatgagttcaattaggagggaaactgagtgacaggaggacaaaattggaagggagatttttactgtataactttgtatcttttaaattttgttccaggcgcatttatcatgtattcaatgcatttaaacagaagaggagaaggacggcccatangatataactattggttaaaaccatcttgtctn

SEQ ID NO: 4832 - DNA, 457 bp, Homo sapiens
  misc_feature 2, 5, 6, 12, 16, 17, 18, 19, 20, 80, 152, 200, 203, 245,256, 304, 398: n = A,T,C or G
gnaanncctttncccnnnnnttttgcaggatcccatcgattcgaattcggcacgaggcaatatgtagtttgccataaaangaatgcatgtcttattcttttccatagttcttcattaatgagacttgtagccaagaatagaattggaagatnccatctcctggggtagtcaaaaaaaatctccttgggtaatactggaancanctaattttcctaatttggttggtccctcttaataataaaatnctatgggaatnactctttagtagttggcctggttggaagctctgggaggagcaaagcancctctccaggtgactggctgactttccacctgaaggagtattactgcaagaattacaaagcaggtaggactctggcttttgatgagcaaatggntgaaaagtgcctccttcccagtcttccttttgccttcattttagtttaaagcttgaagt

SEQ ID NO: 4833 - DNA, 471 bp, Homo sapiens
  misc_feature 4, 5, 10, 23, 25, 89, 209, 236, 243, 293, 334, 367, 369,391, 397, 410, 416, 431, 450, 451, 458, 460, 461, 467, 469: n = A,T,C or G
aagnnacttntttgaaacccccngntctttttgcaggatcccatcgattcgggcacatcttctactagctaacttggtccttttttttnaaaaaataaaacccttgcgtagttctccctcaggggatgcctaggattttggatgagaacgtattggctcaatgtgagtggggcagtggcaggcatccatttcccttccccccattctgncacaggtgcccatctgcctggcagtanaatccantgctcatgttggtgactccagagccccttccttgctggtgcctgcctgangcattggtgtatgtggcgtcctgggaaggggattttagttnaatgaatgatacgtacctcttgctttcctgggntntgcgagctttaatcccttgatngtctgntgggaggcttganagacanactgggaactgtgtnagaaagcatgactcgtatnncgattgnanngaaatnanct

SEQ ID NO: 4834 - DNA, 466 bp, Homo sapiens
  misc_feature 3, 6, 9: n = A,T,C or G
tgnttngantcagctcttgttctttttgcaggatcccatccgattcggaataagtgaattggaagatagctacacagaatgaagcatagaagggaagagatggaaatacacagagctagagggtaacacattgatgctacagacagaacacctaacatacttctggagttctgtaagattagaggagagaaaatagagcaagagaaatgttgcaaggatttttccaaaaggtataaaatgtatccctgaatatatttttagtaatctcaacttcaggcatgataactaaaaccaaattaacataaaataatacaggacgcaaaagaccaatagaaaatctgaaaagtagctagaggtagaagatagagtatgttgaaaagaactgtattctaaatacaacctgattttaacagaaaacatggaagcaggaattcaatggattaatgggaatcatgtcttcaatgtg

SEQ ID NO: 4835 - DNA, 778 bp, Homo sapiens
  misc_feature 3, 5, 6, 8, 9, 10, 20, 580, 613, 650, 691, 760, 775: n = A,T,C or G
ggngnntnnnccctttgaancccttaatacaagctacttgttctttttgcaggatcccatcgattcgacagggtagtgcatgtgacggtgtccaagacgcacagcagattttcattcacaaaaaaatctgaccacaagagctaaacggaaataccttccgctgtccttcccaagtcacagagcaaacacctcagttcccaggggtccgcatcagttctggtggaggcggtgactgtgagcgtgaccagctgggctaattcgtcctgacatttagttgggacagctatagtttcctacctctatgaccagagagtgaagcgtttcactgaagaactgtggccggcgtctccaggaaaggaaggagcctcgctttctccagggcaggggcagcgtggggcggggcaggccgggtgtgtctgtggggagtgggcgcgtgctcacactctttaagctgcgactgcttcctttaggacagaatgaagttcttcgaggaggccgatgaagacagaatatggataaggccaaacctacacaaaatccttctacatcttcatatcaaaacatgttaaacataaacctncaaatacctacagggatacaagcacagggcttnctaaacaggcgggatatgcaacctcgttctatcccangcccacacagaaagtgttgggggaatcactgaaggaaggangagaaagaactcagaagaaccataagagagcaagacatggacaggaaaccaatggcccacgccccgcangaagacttaaaactncag

SEQ ID NO: 4836 - DNA, 905 bp, Homo sapiens
  misc_feature 560, 561, 562, 563, 566, 567, 568, 569, 570, 571, 572, 573,574, 575, 576, 577, 578, 579, 580, 581, 582, 583, 584, 585,586, 587, 588, 589, 590, 591, 608, 627, 630, 650, 667, 670,684, 704, 725, 727, 728, 738, 739, 740, 763, 770, 773: n = A,T,C or G
  misc_feature 800, 810, 816, 821, 844, 871, 876, 889, 897, 904: n = A,T,C or G
ttattccatcaagctcttgttctttttgcaggatcccatcgattcgcctccatgttattagtaattctgtattccattttgttaacgcctggtagatgtaacctgctaggaggctaactttatacttatttaaaagctcttattttgtggtcattaaaatggcaatttatgtgcagcactttattgcagcaggaagcaggtgtgggttggttgtaaagctctttgctaatcttaaaaagtaatgggtgatttaaaaagaaaaaaggaaaaaaatctttggctgaatatgttcattgcttgtatttttaaaacaacagaatttccagtatgaaacaggctgaaagagcaggaagaaatgttctttgtataataatgggaagtttggaatataaaagtttatatattatttatctattggagaactggtgtacaggaggaacattttcttactgtgttgctgttttccatcatgtgttatcctaagagttggggttttttaaaatctgtttcaccaggggaaaataaaagcatccctaatgttcttcctctaaaaaacccannnnaannnnnnnnnnnnnnnnnnnnnnnnnncctcggagagagaaaanaacctttctccgagccctntanaacctataggggagtccgtnttaccgtagaatccccnacnttgaataaagaatnccatttgggttgaagttttngggaccaaaaccccccaaacntnngaaattgccnnntggaaaaaaaaaatgcctttttnttttggnggnaaaaattttgggggaaaggcctttttnggctttttanttttgngaaancccctttttttaaagcctggccnaattaaaacccaaggttttaacccaanccaancccaatttggccnttttccanttttttnt

SEQ ID NO: 4837 - DNA, 790 bp, Homo sapiens
  misc_feature 4, 17, 22, 183, 242, 517, 592, 669, 688, 721, 733, 764, 774,777, 779, 786: n = A,T,C or G
gaancccttttgaaaancttanatacaagctacttgttctttttgcaggatcccatcgattcgaattcggcacgagatattattttaattttatataatagcatgtactgctttacacatttttataataagtcaccacagtattacactataactacgttataagtgcaatagatatgggtncaataaataaaaatagttgaggagaaaaaacctttagaccattcattataacgtgccanactgataaggggaaaaccccccatgtcacatgagagaaataaaacccactgccatttctctgtgcctgggtaactgagttgattgtattcaccagaaggttcttgttctgccttttagacctgcctgggtcatttccctgttcacaccccagtgactaagctgaagagatttatcatgatgcctgctcttttctgttggccttggtcacttccatgtgcatgagcatctccatccaaaagtggccttcttctctagccccgatgggatgtcagtngcccatgtttctaatagaagacccatgccaaagccactttgacaactctccactcgcaagaatgctgtcggcctntagctaaactgttatggtccactcaacgctgtacactgtgtggccactttccttccgctttctgtcattgcagggangttgtaaggcaacacccanggggcttgacctcttcaaggactttgccagcancaaaaacccaancttgggtacaccctggcttaaaaacccacanccccagcaanttncnagctttnaatg

SEQ ID NO: 4838 - DNA, 898 bp, Homo sapiens
  misc_feature 8, 613, 637, 639, 640, 644, 645, 646, 649, 650, 651, 652,653, 654, 655, 656, 669, 670, 701, 707, 747, 760, 781, 812,857, 879, 881, 892, 895, 898: n = A,T,C or G
tttaattncaatacagctacttgttctttttgcaggatcccatcgattcgaattcggcacgaggacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcaccactgaaaaatctcgttgttttaaagtncaatttgtaaatatttcaaaaaanannaatnnnttnnnnnnnnctcggagcctctnnaacctttagtggagtccgtatttaccgtagnatcccnaaaccatggattaagaataccatttgggttggaagttttngggccaaaacccncaaacctttggaaatgccctngggaaaaaaaaaaaaggccttttaatttttngggggaaaaaattttgggggaatggcctattttggcttttttaanttttgggttaaacccccttttntntaagggcctgngcnaan

SEQ ID NO: 4839 - DNA, 833 bp, Homo sapiens
  misc_feature 2, 4, 5, 9, 19, 677, 679, 715, 794, 799, 807, 821, 833: n = A,T,C or G
gncnntttnataccatcanctcttgttctttttgcaggatccctcgattcgaattcggcacgagaatggatgaatttttgtttgggttgaagaatctctctgagaagttgacacgtgggggcaatggtttgtttctcttgtatttctgaagttgcaaataatcatgtaagcagttcaaccaggagtttacaccaaacttttaataggcgatatatcattattttttttcccattggtttggataacatccactttaactggcagttagtcatacttagctatttttgttaaagcaggtgatttattgttattttatatttatgacatgattaataagtgaatatggaagattttacattgacttaggggatcaaagttttcattatattaacacctttaattgccatgagttttctatttctagcatgcatattttgtgttcattcaagtgaagaaaacagtcttttgtgttctcaggtactgcataagccgaccacagtataagacttcttgtggcatctcttcattaatttcttgttggaatttcttatacagcacaatgggagctggaaaccttcccctattacccaagaagaagctttacatattctgggctttcaacctccatttgaagatattaaggtttggtcctttcacggggaatcaacacttatgangntggtttaagacaaattaaatgacccctttccatgtnaaaaaggatgctcttatggttctatattaaaccctcattggggaagaataaaaaccaccagggagaaaacctgcttcanggggnccctgtcnaaagttaaccccgngggtttggaaan

SEQ ID NO: 4840 - DNA, 838 bp, Homo sapiens
  misc_feature 3, 5, 525, 604, 633, 655, 703, 766, 800, 810, 825, 838: n = A,T,C or G
atncngttttaattccatacaagctacttgttctttttgcaggatcccatcgattcgaattcggcacgaggagaagcagagggacaaggtgtcatccaagtgacctacctgcctcagcctcccaaagtgctgggactacaggcatgagccactgtgcccggcctgttattgttgtgttgtcctgcttttatggtgcttctttttctttatttgtaatagtttcccctcccactcccactgttttcttaacatggagaaactttttttttaattgttcccagtgaatgctgtctcttcccatgttgactccattcacttgccatgaattgacttagtgccagacctctgtgccttcttcatgtaaccagctcaccttagccttcttgtagagggcttatgatcttagttggattaagttaacaagtttttgttcagaaattggaaaatactagtcaccattactttcatctgtacttgaaaatttcgtctctcagacatccatcatctctaggtgttggtgacaangcttgacatctttctaacagttgactttggcttcttaaattccttgaactaattgagagttttcttaagcagagcttanaaggagtacttgcagcccccaaaacaaangcaggtttttaaaattattggnctataagtctttggttattccagctgtcacccaaaatggggattttangcatttacaatcggtaaaagggcaaaaccccaaattaggggatggacaaaatccctcactggnggatgactctttaatgcttaccctcaagactttnttaagagtgnggattatcaaccagngacttcattggcn

SEQ ID NO: 4841 - DNA, 777 bp, Homo sapiens
  misc_feature 21, 23: n = A,T,C or G
tgaaaccttttgaaacctttnanacaagctacttgttctttttgcagggatcccatcgattcggtaaaaaccctctgatgcaaaaaaaagtattaactttcacaagctgtttgtactcaaatacattttctcagtttcagatcctctgctgttttattgagtggaaagttgagctaaaacggttcaagaagaataatgttgcatttccttatgtctcaggaaacactttttatggtaacttgtcagattgtctatgaacaaacccacttttttagacattgataaagtcttcttttcttcacgtgatattttatacaagagcacttcagatgtattagatgtgactgattttaacaaatcctattagatttgtatcaactagttacatgttctattcacagtcttttgtgaatcattgcctttttgtttgaaaagatggcctcttttgagcctttgtttggatacattcctgtttttgtgacaaaagaaaaactttaaaattgtcccaagcagaaaaataatggctatcagaagtatgttttgtttcagtgtgagttactgttactgtatttgtttattgtaaacgtagacatttagcattcactgcagttttcaataaaaagtaattaaaatttgttgagttctgaaattcaagtacatctcactaatgtaaaagttctctacttgagatgtttaaggcaagtgcgttgtcaattaccaatttccaactcttgttctacagggtctatctgcctattcataccagactcaagaatg

SEQ ID NO: 4842 - DNA, 772 bp, Homo sapiens
  misc_feature 7, 16, 28, 31, 89, 569, 642, 772: n = A,T,C or G
tgaaccntttaaaccnttttgaaatccnttnggcttctgcaggatcccatcgattcggctatgtgctgacaaatgtggcctactttacnaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccactttgttttccttcacatgcctcttcatggttgccctttccctctattcggacccatttagtacanggattggcttcgtcatcactctgactggagtccctgcgtattatctctttattatatgggacaagaaacccangtggtttagaataatgtcagagaaaataaccccgaacattacaaataatactggaagttgtccagaagaagataattatgaactaatggacttgagacttggcaatctgccaaggggagacacaaaatan

SEQ ID NO: 4843 - DNA, 801 bp, Homo sapiens
  misc_feature 86, 411, 601, 608, 652, 728, 730, 741, 745, 760, 768, 776,785: n = A,T,C or G
tttaaaccttttgaaaccctttttaaaaccctttaaacaagctacttgttctttttgcaggatcccatcgattcgaattcggcacnagtaacagtcctatattgtttcctgggcaagttaaatagtcctaattggccctgagttgttagagaatgtttgtgaaccactcacacagaccttgacagataggtttttgttttttgcttttttgaagtacatgatatagacaggaacacagatttttaaatggtagctgttactaagtgtgggagagagctttgactctggcagtttgggatggcctttcaaaattgacaagtgtggttgtaagggttagagagtaagttggtgatgaatgatacactactctttggagaataaagagccaggtgtgagggtagagtgttctangattaggagacttggatgtgtttgaaacctgaggagtaagaaattggtggagagaagggactctgagaggatgccacagtattggctacagctttttcatcttccccaattatccagtaaaagcagagctccctttaatattgggagcaatattaatatgtttactcttatcacttgtatttatcattgnattagangtcctaacaagtacaattaggcaagaaaaagaaatgtttccagnttaacaagaggaaataaaacttttgtggtttgcaggtggaaatgaaaaatcctaaggactcttgtagaaaaaactntntttgaaaattnccanaacagcccaataatnttttgatngggaaaanaaaaacaanaatgggttttattggt

SEQ ID NO: 4844 - DNA, 777 bp, Homo sapiens
  misc_feature 3, 6, 8, 9, 10, 13, 17, 18, 19, 20, 28, 32, 170, 171, 197,201, 206, 231, 239, 248, 259, 261, 266, 301, 328, 375, 389,428, 547, 656, 677, 689, 765, 770: n = A,T,C or G
agnaancnnnttnttannnntttgaaancttntaaacaagctacttgttctttttgcaggacccatcgattcgaattcggcacgaggtcttcactctgcgacaacaagcttcttgaaggcaaagaccatattttaagtatcttttgtgtcctagatgcactgagtaaaannccagggatgccgcagatcataaattngtgntaatnttcaaaaatagactctaaaatttanatttacanaaacattgnaaagatactgnanagttnctgctatcctacactgtttcccatattattaacgncttacatccctgtgatcatttgtctgnattaataaaccagtattgatacattatcacagagaccatactttatnaggtttccacaggntttttccttaatgttctttcactatcccaggatcccatncacaataccacattacatttagtaattatgtctccttagctcctcttggttgtgacaatttctcagactttccctgtatttagtgaccttggcagttttgaacattactggtcaggttntgtttgtttgtttttttgagacaggatctccctctgtcaccaagactggagtgcagtggaacgatctcatctcactgcagcctcaacactctggggtcaagtgatcctntgacctcaatgtccggagaanctgggcccaganatgtgtgccatcatgctctctaaaaatacaaaaaaataacccggcgtgatggtggggcctgtatcccagctactcnggagntgaggga

SEQ ID NO: 4845 - DNA, 787 bp, Homo sapiens
  misc_feature 13, 14, 15, 16, 17, 25, 28, 739, 747, 777: n = A,T,C or G
ttgaaaccttttnnnnncccttttnaanttgtagaatacaagctacttgttctttttgcaggatcccatcgattcgaattcggcacgagacactgttctaaaggtgttgtgtgaattttcttttttatttattaccacaatctgtgaacaaatacaaatatctttccagttagtgcattccctcaaattgaacttctggctgcaaggaaagctaggaatgattatggttttgttagtaaggaaaattatcaaaatgggatattaggttggctactagcagtcttggcctcatgctttcagtaaatagtgtgcacttcagatcatgtggcattggagaaaggaagaacatgttaataatataacatgggttaggtcatggagtcttgattattgtttcctaatggtactgtttgacttcataggctacaagacaaatttcttcaagtgtaaatttttcgattgaagaagacataaagcctttgagaatttactgtatactcagcactttgcccgggtgtaggataaggatcaaaatcatgaaagcctaatttctttccccagagacttatgaatgtggctgaaaagaaaaagtacaacacatgcaaaataattatgaaataatgatgtatgacaggaatgcagagaagggagagatcagtgtgcatgaattaatgagaaaaacctcatggagaaggagcagcataggttagatcttaaggaatgggaaatattgcagcanatgaaaangactgccagggtaggttataatatagtagnggaagaaaaa

SEQ ID NO: 4846 - DNA, 780 bp, Homo sapiens
  misc_feature 3, 6, 7, 8, 9, 10, 11, 12, 13, 14, 15, 17, 24, 705, 750: n = A,T,C or G
aanccnnnnnnnnnncntttgaantcatagaaacaagctacttgttctttttgcaggatcccatcgattcgaattcggcacgagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttctttttttttctangttttgcaggcatgaaatagtgattatatctgtggaaaagcatangaaggcattctcctttttcatttttttcct

SEQ ID NO: 4847 - DNA, 797 bp, Homo sapiens
  misc_feature 13, 16, 31, 35, 647, 735, 750, 772: n = A,T,C or G
tttgaaccctttnaancccttttgaaaatgnaaanacaagctacttgttctttttgcaggatcccatcgattcgaattcggcacgagtttagatggagctcataattatacaaactcatctcgttcacaaatccctagggctcaatgttaaagtcagccattgtttaaggcagaaattcaggtttagatatagtgtagcaaagattttccattatatgagatatcgatcctattaaacataaaacttttctcttggctttctattttactgtcttttgttgccatcagctgtatgccccttaattttttctagtaataccttggaatttaaaaatgaaattacaaatgtttatgttttagtgtttttaaaaataattcgattaagtatgctatgatagaggagcaaagttgttattagtaatatcaatgtgcttacaacttatggaaatgaaaaatagtctttagtcctagcagcctttctgctgtagtaaaatagtttgtgcactttaaatcgctgtgaggttacatcttcaaaggactgagtggcataagccagggaggtcttagaaatcttacaaaaggaaaaaaataagaaattattcctcatcatatgaaaattatttactaacaatgtatgatggtttaancttcttttaaattcttcactttccactcctttttgcttctttccttttagttggactattaccggagttaccttacactaatgttgangtatttggggttcanaagaaaaataggccaagtaaanggaaaattggaaaatagtttccaat

SEQ ID NO: 4848 - DNA, 816 bp, Homo sapiens
  misc_feature 2, 3, 4, 5, 6, 7, 8, 11, 12, 13, 14, 15, 16, 17, 18, 19,23, 24, 25, 26, 27, 28, 46, 50, 52, 59, 62, 64, 72, 619,771: n = A,T,C or G
gnnnnnnnggnnnnnnnnntttnnnnnnttaatgaaccctttgaancccntntgaaaanccntngaaacaanctacttgttctttttgcaggatcccatcgattcgcactgtggagtccctgcaagtcagcaggaccagggctgtcttcctgcaccatctggatttggttagctctctctgggcagtggggccgagtctcatttcctccaacaataatgttatataggcaatgatcctgggctgccctaacataattgaaaattatgtgtattgtaggcttggagtgctgaaatgtgggctcataaaaatatgtggtgcaggtagcctatggagattggatgtggcacacaatgaactttatgtaaagtaagaactataagtctccatgttaatattgtattatgagtatgacagttcttgggtgggtcctcagggcaggtctgtcaccttcaacaaagcccgagtttcctaattctacagagctggtatttggatgtaatcaaatcggttttgcaggtggccaaagatgaaaacttgtccaccaatccagctctccccactgagggatagcatgggatgtagatgggtttgactccatttggcatttttgttcacggntttttatgagatggagaggtgagtgttggtgggtgtccattttggttggcctcaaggaaatgactctattgagtggttttgaccaatgcactcatatagttatgtggtaagtgaaggatgggggtcctgtacacaaccacccactagttctnttctccaccaaaaaggaataaaagttttgctttcattctcaaaaa

SEQ ID NO: 4849 - DNA, 786 bp, Homo sapiens
  misc_feature 3, 4, 5, 6, 9, 12, 13, 14, 15, 16, 17, 18, 19, 34, 637, 723,766: n = A,T,C or G
ttnnnnccnttnnnnnnnntttgaatttctttantacaagctacttgttctttttgcaggatcccatcgattcgaattcggcacgaggctggaggctgtcagaaggatgctgggggtgaagacaccctggggtcctgacaaccattgggagtgtctggtgctcctgggtgagagagagggccagttggaaaagcctgcaggcccagccctggggcagaactgagtgtggcgggtgctgggcacaggatattcccccaggggcttagcttcatgcattcaggcttaccttgaggctccaagcttattggtggcataagctctgcagatccctcacctgccatcagcctcatctgaatctttgtctttcctcagataagcccttaggcaccagcttagacacctccaagaaccaggccccgctgatgcaagatggcagatctgatacccattagagccccgagaattcctcttctggatcccagtttgcagcaaaccccacaccccagctcacacagcaaaaacaatggacaggcccagagggtgaagcaaacagtgtcccttctggctgtgttggagcctccccagtaaccacctatttattttacctctttcccaaacctggagcatttatgcctangcttgtcaagaatctgttcagtccctctccttctcaataaaagcatcttcaagcttaaaaaaaaaaaaaaaaaaaactcgagcctntaaaactatagtgagtcgtattacgtagatccaacatgataanaacattgatgaatttggaca

SEQ ID NO: 4850 - DNA, 825 bp, Homo sapiens
  misc_feature 680, 740, 744, 769, 781, 809, 821, 825: n = A,T,C or G
attccatcagctcttgttctttttgcaggatcccatcgattcgaattcggcacgaggggaattcgaccaacatggagaaaccccgtctctactgaaaatacaaaatagccgggcgtggtggcatgaactaccacactcggcagcatattttaaaatgcagttatttctgaaagtttttggttttacacaattttttttttaggtaataagatgtattgtaaggattatgcttacgtatggtacagagtatacttcacattgttcctgtcttttttgtgggggagggaatgaccgaaagcattgggaatgttaaaggcaaatgagtaaaaagaaaactaaaaaacgattacttcttcaaataatgaggaaagcgtttttaaaatttttgtctgtttttaaaaagcaagtttcatgttagatttcttaccacactcaattatttcctaatataaaatagatataaaatttgtgatttgttactttttatgtaagcatatatagtccagtctaaaatgaccaacttccaaatgtgttccagaaaagaatcatgacattttatagctgaaaaggacctaaaaatccagtccttttaatataacatatggtaactgactccttgggagtataaaattaattatttaagaaccaggtaagatagtagccagagcctagaaccaatnactcagatgccccttatccattctaatattccacagcattttctagaaacctcacttaangcanttaatgtggatagggttttacctcnaaaatagtcaancccccaaatgtagccaaatacctaaggnggccttttttgnttcn

SEQ ID NO: 4851 - DNA, 787 bp, Homo sapiens
  misc_feature 5, 6, 7, 8, 9, 16, 27, 34, 37, 291, 517, 562, 702, 762: n = A,T,C or G
ttagnnnnngtttaancccttttgaantttttanaanacaagctacttgttctttttgcaggatcccatcgattcgaattcggcacgagggcagctggtgagtggctctctgcgcacagtgttcgggactaccccgctccccatggcctgcccagcgctgagtgagagccagcccaagttcggccacttcctcgagttcatggatgagttctgccaggagcccacagccagtgactcacaaggctagagctgtgcatgggggctgtgtgcaccacccggcctgtgccccanctctccccgagggctctgtgccctggaccgcacctcaaggttgaccagccggccacaggcctcagagctcagctgggccccacttgctggccacaaggtggcatccccttgtcaggatctcccctccttggcccaggcatgacctggtgcctggcccagcggcaataaagagtgggtgcacagggcaatagactgggtgccacatgcattctttcttggaacccanccacagcaacattgtcacacttccctctaaaaatggttttccagntcagatgcaacagggatacatttgttctctgttgtatgagaaactgacaccaaggggatcttaacaaattcctgaacaatggcttcaaaaaaggatatttttaaaaaccagatcttgtgagtacaagccctaatgtgcanggacagggtcatcctgtatattcgttctttactcaaactctttcttggttccttcattangaagcatgaatggttgaatgtgaac

SEQ ID NO: 4852 - DNA, 464 bp, Homo sapiens
  misc_feature 6, 9, 226, 264, 368: n = A,T,C or G
tattcnatncagctcttgttctttttgcaggatccctcgattcgaattcggcacgagagtacgagagcaaagaatgcccagagatgacactagtgatttcttgaaaaactcattattggaatctgatagtggcttttattggggcttacggtgagacatatcctgccattgaagatgacgtcctccctccaccatcacagttgccctctgcacgggagcgcaggangaacaaatggaaaggactagacattgatagcagtcgtnctaatgtagcaccagatggtctctctctaaaatctatatccagtgtaaatgttgatgagcttagagtgagaaaatgaggaacgaatgcgaagactgaatgaatntcacaataaacctattaatacagatgatgagagttcactggttgaccctgatgacatcatgaaacacataggggatgacggatcaaactctgtagc

SEQ ID NO: 4853 - DNA, 766 bp, Homo sapiens
  misc_feature 538, 638, 692, 756, 766: n = A,T,C or G
tttgaaacctttgatacaagctacttgttctttttgcaggatcccatcgattcgaattcggcacgagatgcctagtggtctctgagtgtaggattcttgaacctgctgatttgcatttcacctgtagttctacagtaaaaaatgattttatataacttttggtatataagtctcaaaaagtgtgagtcagaagagatgaaacattatatttaaaatttcatatcaaagcttctaatacaacgttgctagagccatggcttggaaataaatcaggaaaaaaccctcaaatacagaatcagttgtgttaatgcactagaacttgccttctgctttaaagccataattaatcatttaaatgctggataaaaaccatgtgttttgtctttagaaaaggtgttgagtggacttcaaggtttagatctgtgctgtcccatacagcagccactagtcactagcgggcctggctattgagcacgtaatatgtggctattgagatgtgctctaattatcaaatacacaccaggattcaaagacctantacaaaaaaagaatataaaatatctcaaaaatattattgtattgattacattttaaatgataatggttgggacatattgggttaataaaacacatctctnaataaactttttaaaaaaaacttttcaaaatgcatctatgaaaacatttgaaantatatattatggcttctgcttacgacttggatcatgtttatgttgggccacatagtttaaatcntttatatctn

SEQ ID NO: 4854 - DNA, 784 bp, Homo sapiens
  misc_feature 6, 8, 9, 14, 15, 27, 681: n = A,T,C or G
ttgaancnntttanncccttttgaaanctttatacaagctacttgttctttttgcaggatcccatcgattcgaattcggcacgagaagacacttcctctccggaaagccagtcatattcatcccagcgtctttcttggtgtctgtgcatggataaagcctccccattcccccgtgccccccaccactttgtgtcctttcactttgcttcacttatgtgcccaccactccagggctccctgaggtccaggaattccatgccattccctttcacatggctgagagccccagccctgtggatgagctgtcctgagtgggcactcagtaatgtgggcgtaactgaaccaagctgaagagggaaggagcaaaaaacaaccagaagccctcagattcagagtcatgtcgttaaacactttttaaaataaaaaattagctgtgcaaactgaaatcaatttaaactattttctttgactaggcaggaaagaggaggctgctacatattaagaactcccacttaagccaaaccttcatgtttccaatctccaagcaggcattgagggcctctgggctgcgtgtgggagagccaggaagaaagaagagtaggccctgcctttaaggtccttcctgcctaaagcaatctataggcagctgtgttctaacaaaaacttttatttataaaacangcagccagccagcctgcctatgggcagtagtttgccaacctgtgctgtaaattaaaagaagcttaagagatctgtcagatagtgataatgtatgcacattatt

SEQ ID NO: 4855 - DNA, 781 bp, Homo sapiens
  misc_feature 4, 6, 7, 8, 9, 14, 15, 16, 18, 19, 27, 700, 702, 768, 779: n = A,T,C or G
tttnannnntttannncnntttgaaanctttatacaagctacttgttctttttgcaggatcccatcgattcgctcagccaccgtctccttacctgactcctctgggaaagagtttccctaggttaagccatacagggatagggtaggagatgccatttggatctaggagcagagggcagagcctcagcaggaagagtgtctctttgagaaggagacacagtggagcaggtgtgtaggttcacagggccagctatgggtagagtcgggtgtacatttttagaagccacaattcccaaaaatctcctgactataacatcagtgcacagagccagtcaaatggaggaggagtgggtccaggcaattcaggaagaaggaaagtaacaaatgagtggttgcaggaggacactttttctgtcgaggtcactaaacaaaacattgtctcctccccttaacttcagaaacaatggagggtaaaagtgtcgcctgggccctgggggcaaagacggtagataacttctctgtcgtgttctccagaagggcccaacaattacaaggttctacggttctaaattccaatctagtcttccacatcattttgaaggtataatattacttgtcaaagtgggatgatagaagatatgtgtggacataaattgttgtcaaggaaaaaaacttaaataagaaaataagagaaaaaatntntgtatgtacagtggttactagaaatatgccttttaaatatttggcatgtggattgtggcctcatcntcactcagtgnga

SEQ ID NO: 4856 - DNA, 785 bp, Homo sapiens
  misc_feature 4, 7, 14, 17, 26, 29, 35, 662, 675, 687, 695, 699, 703, 705,724, 729, 742, 748, 764, 774, 785: n = A,T,C or G
tganccntttgaanccnttttgaatntcnttacanttgctacttgttctttttgcaggatcccatcgattcgaattcggcacgagattcaaagtacatttgacaacccactgcaagttgtggcatacatgggtgccatgaaccatgacaccaactacagctttcaggttcaatgtggcttaattgtgggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccactatgctacctcttatttacctgaaaggaggacacgcaggatgggcagtcatgctggtgactcttgtactcccttgagggacattggtggggggggggcgtggtcccangcaggatgcccantctttgactganattggaangcantgangnttgagggtgccaaaaattncccanggttcacccaganggggangggctacatgccccanctgtgtgcangggaggacacn

SEQ ID NO: 4857 - DNA, 782 bp, Homo sapiens
  misc_feature 12, 16, 21, 23, 47, 51, 52, 54, 66, 70, 72, 76, 79, 85, 91,93, 110, 115, 118, 122, 125, 127, 150, 156, 158, 160, 166,169, 175, 176, 187, 188, 192, 202, 205, 225, 230, 234, 235,238, 246, 247, 261, 269, 273, 277, 278, 283, 295, 297: n = A,T,C or G
  misc_feature 310, 316, 325, 346, 351, 355, 358, 367, 375, 394, 426, 429,437, 440, 464, 469, 479, 494, 513, 520, 547, 548, 552, 566,569, 591, 594, 597, 616, 618, 633, 642, 663, 686, 693, 722,724, 757, 780: n = A,T,C or G
acctttaaacancttntgaantncttgcacgatcccatcgattctanttcnntncgcaggcagccnccancncganttnggcacnagctcnanagctgctgcttttcccntgccnganaacnttnantttagtcctggattctgtcacanaacatntnanctgccnttntccctnnggagaattganntggnaacctacttnagnggcatgaaaaaacctagacntctcngaannganaaccaatnngcccttattgagantactgatngatngtannaccanagggacacccgngnatcaatacatacnggctgntcttgcctntttcaagggtggtccaaacgnccatnctanggntcggatcantatgggtntgcccaagcgatcagaacncgagccatttgcttagctgcgggaatgaacanggntcttgganacnggcatctatatacaccccctttcnttttnccccttgatnggaagcttctctganatgacactctcaaagatgngttctgnagtgacttattgccaaagcaccacttnncctngttgagtttaagangancacatttgggctaaggggcctntgnttngatgtaaagtgatctcctngnggtctacatttttcntaaataatnccttatgatccaccatgagtntgaatactttgcttgggacatangctgccnatcattgcctggaagctgccacaagtacngnagtccctggggcaaatagcttcaaattttttgnactctcaagcccatgtcacatantt

SEQ ID NO: 4858 - DNA, 794 bp, Homo sapiens
  misc_feature 2, 29, 33, 35, 39, 209, 367, 498, 503, 607, 641, 655, 662,690, 717, 745, 750, 759, 784, 794: n = A,T,C or G
gnaacctagaaacaagctatttgacttcntgancnttcnaacaagctacttgttctttttgcaggatcccatcgattcgaattcggcacgagcagagatctgcaaattacagcccacatgccagctgcttgtttttgtaaataatgttttaccggaatccaccactcccacttgtttacatatcatccctggctgcttttatgctacantgaagtgggaggggttgagtagttgaaacaaagaccttattgcttgcaaagtctgaaataaacacactcacacacactgatttatgtatagaatatgtatacaaatatatcttttatttatctatttttttgagattgagtctcgcttgttgctctgncgcccaagttggagtgcggaggcaagatcttggctcactgcaacctctgcctcccaggttcaagtgattctcttgtctcaacctcccaagtagctgggattacaggcacatgccgccatgcccagctaatntttgnatttttagtagagatgaggttttgccatgttggccaggctggtctcaaactcctgacttttagtgatccgcctgcctctgcattccaaagtgatgggattatangcgtgagccactgtgcccggcctacaaatatatnttttacagcacatntcaattnctattaactgcattttcaaatgttcagnaggcacccactgggctttgtatcgggntgtactgggcccacacaaatctaaaatngctgnatccttggnacctcctacctcctggtaccttatnagaataagcn

SEQ ID NO: 4859 - DNA, 786 bp, Homo sapiens
  misc_feature 8, 41, 44, 404, 490: n = A,T,C or G
tttgaaanctttatacagctacttgctttttgaagaccttncanacaagctacttgttctttttgcaggatcccatcgattcgaattcggcacgagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacntattatgcagtatttatatcttttgtatgtaaaactttaactgatttctgtcattcatcaatgagtagaagtaaatacattatagntgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaacccattctccaatctcagtagttttttcgaaaggctgtgatcatttattgatccgtgatatgacttggtactagggtactgaaaaaaatgtctaagcctttcagaaacatttttagtaatgaggatgagaactttttc

SEQ ID NO: 4860 - DNA, 783 bp, Homo sapiens
  misc_feature 10, 14, 18, 26, 27, 41, 703, 713, 750, 782: n = A,T,C or G
ttttgaaccnttanacancctcttgnnttgaaaacctaganacaagctacttgttctttttgcagggatcccatcgattcgaattcggcacgagaggacctccagttaaatttgaatttcagatgcctatgaatagttttcagtataagtatgtcccatgcaatacttgggatacgattgtgctgaagtggttttcattgtttgtctgaacttcaaatttaactggacatcctgtatttttatttgctgtcttgcaacttggttctgagagagagacccgagttcttcccattcacactgtgtgttgggcagggcatttgggccacttgatgttggctaggtaggttctcatcttgagaaaccaaatttctgattcccagctctgtgccggtactgtgcctttttccactcaagatcttaaaactttgcctaggaagagaagggtcgggaaatggtgggatggggacttgagtgttaatttctgagtcttcttcctggggtggattgcttctgtgccatggtctttgtttcccgttgtaggtgctgaccccatatgctgtctcgactgcaatgacaaagtatctaaatacaaatgtgataaccaagactgctgatgagtttgcaaaaagtcattgaattatgtcacaattggaggtgaaacctgtggctgccttgcccatgaaatcttggcgggctttctgancctgatcccngcctgggccttctacagcggtgcctttcaaaagctgntcctgaccactatgtggcatacctgaactcant

SEQ ID NO: 4861 - DNA, 786 bp, Homo sapiens
  misc_feature 8, 10, 11, 12, 13, 14, 34, 102, 105, 158, 173, 176, 181,182, 202, 214, 231, 257, 291, 306, 315, 325, 329, 335, 337,346, 352, 354, 361, 362, 374, 389, 430, 442, 443, 444, 463,464, 466, 467, 506, 515, 528, 529, 531, 536, 538, 546: n = A,T,C or G
  misc_feature 550, 556, 561, 573, 574, 576, 587, 601, 614, 624, 660, 667,682, 713, 715, 733, 738, 741, 748, 760, 771, 781: n = A,T,C or G
ttgaaccntnnnnncttttgaatttgaaaccttnaaacagctacttgttctttttgcaggatcccatcgattcgaattcggcacgagggtaacttctctganagngttccttgtaaggctcttatgaacagtcgccatatatatatagttgatgggcngggaagatctgggangtnagcannaagagcctttagttccgccncatagaacaaantagaggtcacaggttcnatgccctgagatatggaattgaaatnttagacttcagggtcatagactcttggaaggaanactagagtacattcntgaccctcncccttaattncttnacaggngngaaaaccangagctncngaaaatnngttattcctcanctccagggctacctncgatctgtgtttgctctgacgaatggaatttatcctcacanattggtgttctnnntgtcttaccacctaattanntnnctgctaccaaaaaaaaaaaaaaaaaactcgagcctttanaactatagngagtcggattacnncnatccngncatgatangatncattgntgagnttggacaaaccnnanctagaatgcancgaaaaaaatgctntatttgcgaaatntgggatgctnttgctttatttgtaaccattataagctgcaataaanaagttanacaacaacaattgcnttcattttatgtttcaagttcagggggaggngngggaggttttttaatttngcggncgnggcgccnaatgcattgggncccggacccancttttgtttncttta

SEQ ID NO: 4862 - DNA, 759 bp, Homo sapiens
  misc_feature 1, 2, 11, 97, 113, 282, 586, 595, 608, 617, 638, 660, 668,671, 719, 734, 744: n = A,T,C or G
nnttactatanaatacaagctacttgttctttttgcaggatcccatcgattcgaattcggcacgaggcgagctgaagtacacaaagtttcaaggccngaaaatgagcactcanaaatgataacaagagacaagtagctccaggtgctccttcagctccaaggagagggcgtgggggtcatcggggtggcaggggaagatttggtattcggcgagatgggccaatgaaatttgataaagactttgactttgaaagtgcaaatgcacaattcaacaaggaaganattgacagagagtttcataataaacttaaattaaaagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaatagagaacggagaccaacctgggctgaagaaagaagattaaatgctgaaacatttggaatcccacttcgtccaaaccgtggccgtgggggatacagangcagaggangtcttggtttccntggtggcanaaggccttggtggtggcaaangtggtccttccttgccctcgangatttccncgntggattcaaaagaagtcgtgggggcccggagtttgcggattttgaatntaggaaagacaacanaagttgtgcntagtctacaaacaag

SEQ ID NO: 4863 - DNA, 757 bp, Homo sapiens
  misc_feature 7, 8, 12, 16, 18, 91, 132, 176, 194, 237, 247, 253, 272,278, 279, 291, 293, 307, 312, 315, 333, 345, 370, 397, 403,421, 444, 450, 454, 455, 468, 492, 508, 525, 541, 546, 554,598, 605, 621, 622, 627, 639, 642, 644, 651, 666, 668: n = A,T,C or G
  misc_feature 682, 687, 711, 712, 718, 725, 737, 754, 756: n = A,T,C or G
gaatccnntacnatananacaagctacttgttctttttgcaggatcccatcgattcgctcggacataaattatttcattcacaccatcttnccttcccacacacacaccctggagcaaacactggcaccgcntctaacaactcaaggctgtgtcccgaggatgactgctccagctntcttacgttctgcctganagcctgccaagagaatcaactgtttgatagggcccatctacangctttgtganagagtnggggcctaattttgttaanctccannttgtaaagccananagcctaatcgcgtngacanccnccttcctgcttttcaaanattatctgcttncctgaatactgcctatgcctccctnctcctcccttattctccctactgcagnagtgantatggatgaaattatgtncttcctgtattaactcaggtcancttggnttgnntttggcaccgggnacaagtgctgttgggtctgcttgnaccactattccccaantgccactggtagcacanatcaacaaatcctttnctctnagctcatntgttgagaaattatcaggagccatgggaagaaattactattttnatcatgntagaaatatatttcanngtgtnttgaagagtgtnaananttgaaantgggaaaaggatttnangctgcacttgggangcaanatgatgaaccttactatggcactnnggactnaaagtangatgagccccantactgacccccaggccngnt

SEQ ID NO: 4864 - DNA, 765 bp, Homo sapiens
  misc_feature 12, 16, 18, 162, 193, 201, 279, 283, 284, 293, 294, 296,327, 416, 420, 422, 436, 465, 469, 470, 485, 488, 492, 495,573, 575, 597, 603, 620, 623, 646, 659, 667, 674, 694, 726,727, 731, 742, 756, 758, 764: n = A,T,C or G
gaattccttacnatananacaagctacttgttctttttgcaggatcccatcgattcgaatcggcacgagactggcattctgctgttctcaggagctccgctttgatggatggctgggcagcctgtgctgcatggaccaccagtggttgttgaggtggtgaantgtgtccccgctaactccactctgggcagtnaactgaanagggagcaaagcccatgaaatgggcctttgtggcagtggtggaggtagagtgacccacaacaaacctccccacttgtncctnnccattcagnngntccagaggcagtgagcttggaatcttaacangagagatcttggggtggggtgtggactttccacaaaggcattacctacatgcacgttcccttacacatgtagccttccaatctcatacntaanancacttatttaagtnaaatatgcctatttcaacagcaagaactntggnntggggagtaaagatnttnttanttnactatttagtattaactgagtaaacatttaaaaaggactggatgggggtgggcacatggggctggggtgcatttgctntngctctacatttatgaaagaccncaaatncattatgtgacattttntgnaaacaagggtatatatactacancagatacacaggngctagaanaaaagtncatcataaaacttcacactnggggttgtattacaaaaccacatagcttcatnngganttatgatgtcnggaaaaattattanancttgtnt

SEQ ID NO: 4865 - DNA, 790 bp, Homo sapiens
  misc_feature 3, 5, 6, 13, 16, 17, 20, 25, 27, 40, 185, 220, 253, 259,277, 280, 307, 310, 316, 335, 365, 393, 412, 434, 446, 521,525, 537, 580, 619, 655, 661, 719, 733, 741, 747, 785: n = A,T,C or G
ttnannccttttnaannccnttttnanttccttactatanaatacaagctacttgttctttttgcaggatcccatcgattcgaattttgccatcttttatcaggctttctgtgtcgaggacgctacccacatagagtagaagctaaagggaagggatgtgaagtgacctcaccctcagcttctanctcatggtgtcaaggcttgtgtgatcttagacacntctgcctcttctgagcctgtttcttcatctgtnaaacanggatgggaggttgtggtnaanattccacagcaacactgcacacgcatnaantacctnggccagggatgactcggcngacctcattttccctctgcctcctgcctanagctgttagcaagcatccatcatgcggntcacacaagagctcccccnggaggttacagaaatgaaggcngcagccccagtncttgggtagcctgtttccccttgaaggaaacagactcaatatcagcaacacagagtgaatgacgccagggtggcnaacnggcctttcctgnagcaaatgcgggaggcttcatggagatgacgtgttatgaacancactcatcttacgctgggagcagcacatgcccccggcanggagccagtccctgtcttcaaatacagtcacactgngggttnaacaatgtgtaaatttgggggcgatacaaacattcagtccataacacccctatacccnaacccttaggcaancactaatntacatnttatctttacagatgacctattctggacatgtcatatnaatgg

SEQ ID NO: 4866 - DNA, 781 bp, Homo sapiens
  misc_feature 4, 5, 6, 7, 11, 13, 19, 584, 610, 690, 756: n = A,T,C or G
gagnnnnttgnancccttntgaaatcttttaacacaagctacttgttctttttgcaggatcccatcgattcgaattcggcacgagggtgtgcggctgtaatttgagctattcgggaggctgaggcaggagaatcacttgaacccaggagacgaaggttgcagtgacccgagatcgtaccactgcactccatcctgagtgacagagcgaaactccatcttgggggaggaaaaaaaagaaagtaatagggaggcaaatcagaatttgtgtgggagtaccccctagttctggctcttgttagtatactcaacctgtcaggctattctgagagcgaaagctcctgctttgggctagtttccattcagaatggtttttgataggtatgaactagtctaagcacaagtatacttctgtgtaagtagcatagctcctctacttggcttcatagcattggacattaatagagaaaatgaaaaaggagggtatggtacctgccttgaatagcatttgatttttaatcctacatttatcagagccccagtttttaaaatgtttaatagccagatgtgctgtttgccaggcttanaagttggtacttctgtgaatgaaaangtgtgactgagtcacataaactggtattcagctagcccagtcatcagtttattccatattcaagggaaaaccaaggctgnttttcctctttatactttgaagatgatggcatttaaaatcaagtaattggggctgggtgtggtggnccacatgtgaaatcctaatgctttg

SEQ ID NO: 4867 - DNA, 779 bp, Homo sapiens
  misc_feature 2, 8, 634, 671, 677, 690, 703, 722, 725, 732, 736, 759, 767,769: n = A,T,C or G
gnttatanatacagctacttgttctttttgcaggatcccatcgattcgcccctttgccttccaccatgattataagtttcctgaggcctcctgggacatgcggaattgtgactcaattaaacctgttttctttataaattacccagtccccagcagttctttatagaagtgtgaaaacagactaatacaatcctgaagcatttcatcaaagaattgtaacaggagatgaaacatggcttcaccagtatgatcctgaagaaaaagcacaatcaaagcagtggctatcaagaggaggaagtcaaagcaaagcagaccagtcaagagcaaaggtaatggcaacagtttttttaggatactcaaggtattttccttgttgactttgtggaggaccaaagaatgataacattaatttgcctattgagagtgttttgggaaagttagccaaagctttagcagaaaaacacctgagaaagcttcaccagacagttcttctccaccgtgacaatgcttttgctcatgtctctcatcatcaagaacaattttgttagagtttcaatgggaaatctttaggcatccacctgatctggctccttctgacttctttttggttcttaatcttaagaaatctgtcaangggcccccagttttctttaagttaataatgtaaaaanggctgnattggatgtgggntaaagtcttccangaaccttaagttcttttanggnggtcctnaaanggctggggggcatttttttaccnaaaggggncnttggaaattg

SEQ ID NO: 4868 - DNA, 774 bp, Homo sapiens
  misc_feature 6, 20, 22, 27, 32, 40, 43, 44, 46, 49, 50, 55, 454, 713,733, 746, 749: n = A,T,C or G
taatcncttggtttctaatncntgggnctcgnactttctncannanccnntgcgntgcgaattcggcacgagcccagccctagatactggcactactgaggaggatcgtttaaaaattgatgtaattgactggttggtatttgacccagcgcagagggcagaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactganaaagtggctcatgaacacaaagaaaagaaatatgaaatggattttggtatttggaaagggcatttggatgccctaactgctgatgtgaaggagaaaatgtataacgtcttgttgtttgttgatggagggtggatggtggatgttagagaggatgccaaagaagaccatgaaagacccatcaaatgggtcttactgagaaagcttttgtctgccaatgttgtgtttcctgcttcatcgatattgcacagtacttgtcaantttcaaggaatgcccttcanttagcagaatatnggnattcctttgagcgcccacaaacttg

SEQ ID NO: 4869 - DNA, 734 bp, Homo sapiens
  misc_feature 2, 537, 642, 687, 694, 710, 711, 726: n = A,T,C or G
gnttatatatcagctcttgttctttttgcaggatccctcgattcgaattcggcacgagctcatcacactgttgtatacttcgtagctattacttctttaatccccaaggacttgtttaacaaagtgttcttcagtttctacttcctagttcctttgtggaactggtaaaaatttaaaatatcttaacataatattttatttcaaatgataaacagtaaggtaaaatgtggtttttcttggacaacttatggtagaatgatgtctagaatatttagttatgtcatttaatactttttttctttacaatttaaaaaaaaatttattttattttagattcagggggtacacgtgcaggtttgttacatggctagattatgtaatgccgaggtttggcctgctagcgcagccatcatccaaagtgaccctagtacccaataggtagttttcaacctgtgtgcctcctcttctaccttctcttttggaatctctagtctattacttccatctttatgttcacatgtactcattggttagctnccacttacaaatgagaccatgtggtatttgatttctggttctgagttacttcttttaggatagaggatgaaaaagagtgtacctccacttcatccatgtgctgcnaagacatgattcattcttttatggtggatattttacctttttgcnagggganagattaaattggccanntatgaaaaatgctgnatccctat

SEQ ID NO: 4870 - DNA, 837 bp, Homo sapiens
  misc_feature 18, 368, 369, 370, 372, 375, 376, 378, 384, 386, 395, 398,410, 413, 414, 426, 427, 431, 435, 444, 450, 454, 455, 456,457, 460, 461, 464, 465, 471, 472, 475, 483, 484, 490, 493,501, 506, 515, 516, 519, 520, 525, 526, 529, 537, 543: n = A,T,C or G
  misc_feature 549, 552, 558, 567, 571, 576, 578, 586, 587, 589, 591, 592,596, 600, 601, 602, 621, 641, 659, 660, 662, 672, 673, 677,678, 687, 688, 690, 706, 707, 716, 722, 723, 724, 725, 736,738, 740, 741, 753, 760, 761, 768, 776, 777, 778, 779: n = A,T,C or G
  misc_feature 784, 785, 786, 787, 789, 794, 795, 796, 797, 798, 800, 803,806, 808, 809, 811, 812, 813, 819, 821, 822, 823, 824, 825,826, 836: n = A,T,C or G
aagtttaaacctgctctngtctttgcggatccctcgattcgaattcggcacgagggggttgggggtgggaccctgggatggggggagaagcagctgtttctggagagagaaggggtcatggtggccccagactgtagagatttttatgtgtttggatacatctgctgtgtggaaaaaaaaaaactacaaaaaccctaattttgtacatactgtatttttactattgaactgtattctagtggctgttcatgctccaagactttagttaccgagacatgaatactatccatgtaataagcacttgcctggaataaaatataaaactgaaataaacctgcactgaaacctgaaaaaaaaaaaacaaaaannnanaanncntaaaanancccaaaaanaantaaaaaaaaaanccnnggccctttaaanntttngggngccgtttancttaancccnnnnttnntannaccttnnttnatttgggnnaacccncantttaattnccggnaaaaaatgnnttnnttggnnaanttgggaancctttngctttnttngaaccntttttaagntgcnataananagttaccnncnannttgncttnnnttttaaggtttcaagggtncaagggggaaaggttttggnaagggtttttttaaattnncnggggcccccnngggnnccccaattnncnttttgggcccccgggnncccccaagntttttnnnntcccccttttnangnnaaagggggtttnaatttgnnccccccntttgggcnnnnaaaannnngnggggnnnnntnaanccntnntnnncccctngnnnnnnaaaaaaattnc

SEQ ID NO: 4871 - DNA, 787 bp, Homo sapiens
  misc_feature 3, 4, 5, 6, 7, 8, 9, 10, 12, 13, 15, 21, 22, 31, 562, 582,592, 700, 706, 717, 726, 736, 764, 769: n = A,T,C or G
ggnnnnnnnngnntntaatanncagctactngttctttttgcaggatccctcgattcgctgccatgtctagtgggctcttctgggctccgtcctgagtttgtcacacctcctagggcccagaggagatgatgtggtatttctatcactaaaaggagttcaagaccagcttgagtaacatggtgaaaccctgtctccactaaaaatacaaaatttagccaggcatgatggcgcatgcctgtaatcccagctactcgggaggccgaggcaggagaatcatttcaacccaggaggtggaggttgcagtgacccgagatcgcgctactgcactccggcctgcgtgacagagcaagactccgtctcaaaaaaaaaaaaacaaaacaggaaaagtcttagagaaaccttgtgtttattcagaataaaatgaaatagttaaaatgttttagtgccttttattttcaaattacatagtcagtatcttctctcatactgattcttgtttgtatctttacccaaaataggagtacacctttgtcatttaattaattgtttgatataatcttncaaaatatggtatctggcanaggggggtgngagagaggaagaatagcacaaggcttttgtttgggtgcctgcttgctggttggattttgagatccaaatcaactatttttggatgaaatcgtagctaatttttcctgnaacctnttttttttttnggtctctgngcccattggntgcttgggatcaggaaaatgccctatanttttnggctattttggcatttaa

SEQ ID NO: 4872 - DNA, 733 bp, Homo sapiens
  misc_feature 3, 4, 10, 379, 410, 435, 468, 523, 543, 547, 565, 584, 590,598, 622, 639, 647, 661, 662, 674, 693, 699, 720, 728, 733: n = A,T,C or G
agnntttatnatcagctcttgttctttttgcaggatcccatcgattcgaattcggcacgaggttttctcctgttacatcatgctgaatcctttcccttagccattagcttttatgatgtggtcttcgtaggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaatccttgcttggcaaagactgttcgatcatgtggggtccttatttacaagggaaagctgggccagaaggctagcaattcangtgttaccgctattgctgtgccttgtgttangacattgtgtgtgtgcatggactgngcctccaaactcagtagttcctatctaaatatnaagtatattacaaacctggaagtacagaatctcaaccttacagtctttcccttantcctgtggccttctaaccanctgntaacgtgttgattccttncacttccccaagtaggcangcacanattgtgangcttaaaaagtaatctggttcctntgactcattgaattcantttgcgcntctggctggaacanntgttgttacagnttttaagaaaattgctggntgcccnataagggtggcctggtgctcngggcctgnggctn

SEQ ID NO: 4873 - DNA, 760 bp, Homo sapiens
  misc_feature 2, 3, 557, 595, 617, 637, 692, 704, 734, 760: n = A,T,C or G
gnntttagatcagctcttgttcttttgcaggatccctcgattcgaattcggcacgagaggagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagantggttcgaaggcaagaatgcagacccaatcctcatctncttgaacacgggtacattccangcaaaaacagggatctcaangtggtcaagaagaacattcttggatagcaagcccactgcaaccaagaagtgcganctgatcagcatncccaagaaaaccacagacacgggctgtgancaaaaatgaacttgtaccgaccatgn

SEQ ID NO: 4874 - DNA, 757 bp, Homo sapiens
  misc_feature 2, 3, 9, 530, 572, 575, 584, 597, 600, 687, 698, 725, 731,753, 757: n = A,T,C or G
gnnttttanatcaagctacttgttctttttgcaggatcccatcgattcgaatttcggcacgaggctgtacggagagtgctggaccgaggggagctgggagcaggtactgcctccatcctgagctgccgtcctttgaagggagaacctggggtagggttcgaggagcctggcgagaactgtgcacctcctcgggaggagcagccccctcctgtgctgctttccccctcccttcaatatgctggggcggagaccctggcctccaaagtgcaattccgggaccccaaatcccagcggacgcaccaggctcaggtggcgttccaggtgtgtgtgcgccctggctcctacaccccgggacccccttccgctgcccttggagaacctcctgaccctcacttcagtccagccgaacttgagtgggtcactaaggagaagggggccacactcctctgtgccctgctggtacgggtggaatgaggggtgagacaccactactacaagcacagtcgggccgcgggcccatggactctgantggcgactgccttcacctcattcccgtgactcgtggcatgcncangtgctggancttggcagccgcncangaacatgtaggcaggctcttaaatgtaggtggcaagtggcacaacttccatgtccgaggcccacaattcggctgatggaagagtctngggaacccaanttcagccctggtaccccttttcatgcntgattngggaacatgactccttttactncccn

SEQ ID NO: 4875 - DNA, 776 bp, Homo sapiens
  misc_feature 346, 348, 349, 350, 351, 352, 354, 355, 356, 357, 358, 359,360, 361, 362, 363, 364, 366, 367, 369, 370, 371, 372, 373,374, 375, 376, 377, 378, 379, 380, 381, 382, 383, 384, 385,386, 387, 389, 390, 391, 392, 393, 394, 395, 396, 397: n = A,T,C or G
  misc_feature 398, 399, 400, 401, 402, 404, 405, 406, 407, 408, 409, 410,411, 412, 413, 414, 415, 416, 417, 418, 419, 420, 421, 423,424, 425, 426, 427, 428, 429, 430, 431, 432, 433, 434, 435,436, 438, 439, 440, 441, 442, 443, 444, 445, 446, 447: n = A,T,C or G
  misc_feature 448, 449, 450, 451, 452, 453, 454, 455, 456, 457, 458, 459,460, 461, 462, 463, 464, 465, 467, 468, 469, 470, 471, 472,473, 474, 475, 476, 477, 478, 479, 480, 481, 482, 483, 484,485, 486, 488, 489, 490, 491, 493, 494, 496, 497, 498: n = A,T,C or G
  misc_feature 499, 500, 501, 502, 503, 504, 505, 506, 507, 508, 509, 510,511, 512, 513, 514, 515, 516, 517, 518, 520, 521, 522, 523,524, 525, 526, 527, 528, 529, 530, 531, 532, 533, 534, 535,536, 537, 538, 540, 541, 542, 544, 545, 546, 547, 548: n = A,T,C or G
  misc_feature 549, 550, 551, 552, 553, 554, 555, 556, 557, 558, 559, 560,561, 562, 563, 564, 565, 566, 567, 568, 569, 570, 571, 572,573, 574, 575, 576, 577, 578, 579, 580, 581, 582, 583, 585,586, 587, 588, 589, 590, 591, 592, 593, 595, 596, 597: n = A,T,C or G
  misc_feature 598, 599, 600, 601, 602, 603, 604, 605, 607, 608, 609, 610,611, 612, 613, 614, 615, 616, 617, 618, 619, 620, 621, 622,623, 624, 625, 626, 627, 628, 629, 630, 631, 632, 633, 634,635, 636, 637, 638, 639, 640, 641, 642, 643, 644, 645: n = A,T,C or G
ttttgttccattcagctctcgttctttttgcaggatcccatcgattcggtctgctgataaaatatttaaccccaagaaagtgaaaactaatataaaattagaaagacctatccaaattagacagtcaattccattaaaataagaagtgagaaaaacaatgttgggcattgaggtgtaaattttgcccagatgtatacccagtgtgaaatatcttctaataaaaatatatttggctcttatccctgcacatgtagaggcataaaaattggtaaacatgtcccgctgtgtagaactttaaaaaaaaggcatttttgaaagtgttgagtggcactgataactggtgaancnnnnntnnnnnnnnnnnanntnnnnnnnnnnnnnnnnnnntnnnnnnnnnnnnnnannnnnnnnnnnnnnnnnntnnnnnnnnnnnnnncnnnnnnnnnnnnnnnnnnnnnnnnnnnntnnnnnnnnnnnnnnnnnnnntnnnnanntnnnnnnnnnnnnnnnnnnnnnnntnnnnnnnnnnnnnnnnnnntnnnannnnnnnnnnnnnnnnnnnnnnnnnnnnnnnnnnnnnnnnannnnnnnnntnnnnnnnnnnntnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnncnnnnnnnnnnnnnnntnnnnnnnnnc

SEQ ID NO: 4876 - DNA, 774 bp, Homo sapiens
  misc_feature 1, 9, 26, 98, 101, 144, 214, 241, 283, 296, 343, 357, 363,417, 442, 444, 445, 449, 467, 471, 482, 483, 496, 497, 505,512, 524, 532, 558, 559, 575, 578, 580, 590, 601, 617, 625,642, 646, 653, 675, 679, 680, 683, 701, 702, 710, 747: n = A,T,C or G
  misc_feature 751, 752, 755, 759, 760, 773: n = A,T,C or G
ngtctaatnctggctctcgttctttntgcaggatcccatcgattcgaattcggcacgagaggggccttacattactttcttgcagcactgatggcttntgnttgaggctgcacaaattcctgcatttcccttgggttgaatggnagggatgcgggcagttggtgactgggtgaaccacctgacttgagcagggctacgactctctctgcaaacnaaacccagagacatgaacagtgctganatttctcagtggtttcccatgtaggctgctttccaagggcancaagcatggcttnatcactcacccagtgcttctgattcagcactgtgatgctcggttaanttttaatgaggttntaaatnttttcgtatgtacgagtgtttatgccaacaaagatgctgaattgtaaacaccancaatctgagtaccttcttttgattncnntctncatattgaataatccctntatntttgtgcgtannatgaaattgcatnngatgtatnggttganagtagattggtnatactttncaaggacaggcaacaatttcacgatnnaacttcttaaaaattnttntnaacaaatgtnaaaatggattnttcttccaaaaaaccntttttccntttggcacatacccaancaantgacccngaaatttaaaagtaatttaggngacnngantttagatgattaagggcnngtttaacntttggacagtttttgcccttttttaaaaggctcggantccnnttntagnnaactcgctccccnc

SEQ ID NO: 4877 - DNA, 769 bp, Homo sapiens
  misc_feature 2, 3, 4, 5, 6, 7, 8, 12, 16, 18, 30, 37, 527, 549, 577, 581,596, 600, 607, 626, 766, 769: n = A,T,C or G
gnnnnnnntttnaaancnttgctacttgcncttgcantttcccatcgattcgaattcggcacgaggtaaacatacaataaagctgaaaattttagtgactacttatatgctcatcatctagattctatccttgagtaatctatttttataaaggtattgatgtaactattttataaatgaaaaactacacactaaaaaccaaatatgtgatctccagcatcacagaaatgaaataaggatttttttttaacttaggtaatattgcttgaactgtagtaattcaaatgtagcaatttcaaaggtagaatttcccatgtattactatactgcttcacatcagctctattaataaaagtagaacagttgcaaaggaacttttatgatctgttttgacaggacagacaatttaaaaagttgttaataaaggtttttagaattcactataagcctttcatgtggctttagttagccacatggagatccgttctgggacgaaagttggaagtattctcaagaagtaaaaaatnccaaataatttataggggcacnagtggtttgaagtactggttaggattanaagngggtcttggcattgnccanaaaccanactactttgcacaattatncttgaattcctaatcatatccactagcctactctcttaaatgaccccagaaaccttgctcttaacatttaagacaatgggaaggtcttgctttctaaaaatgcctttattttaataccccttgccaataaatggaatttnacn

SEQ ID NO: 4878 - DNA, 741 bp, Homo sapiens
  misc_feature 10, 12, 13, 16, 378, 461, 506, 554, 576, 578, 618, 622, 625,630, 649, 663, 676, 686, 693, 696, 698, 701, 712, 715, 716,718, 719, 722, 724, 725, 730, 731, 733, 741: n = A,T,C or G
cgcaattttnannatnctcttgttctttttgcaggatcccatcgattcgaattcggcacgagctcaccaattagcactgccaccgcaggtctgtgaattgcatgtgaaaatagaatttgtccagaagtgctcatgcaaattgtgcaacacaaatgtggcctccatgtcaagtcctttcacgtgttctgacagactcatgtctttccagatttctctgatcggcgccccccacccccttgacagttaccagagctcataagccaaaggaaatagttcctgttgccatgagtactgtgtctgtggtgaggtttatgagctgctcttagggctgggtttttgcctgagaaaacaatcagatttcgcttagatctgcaaganagcagattaggaagggaatatatgcaaatatctatgttaatgccccaaacctataacttggcctcatggtgcttgtgtagcanttctcttagagaaaactttttttgcatttaatatatatttcatgnttttgaaaatctgtgttcatgcaaagaaacctggaaagcaaaagcatnaggtcaaatatgaacttggctntnattcatataattggggtatatcatatcttttgtgacatanaacngtnctttnataaccatctttgcttttncattggaaaaaatncagctttcctgangaggaatatnttttcantgncnctnttaaacctttnganngnngtngnngcggnnanggggcccn

SEQ ID NO: 4879 - DNA, 775 bp, Homo sapiens
  misc_feature 2, 3, 6, 8, 690, 692, 708, 712, 725, 730, 743, 756: n = A,T,C or G
gnnttnanatacagctcttgttctttttgcaggatcccatcgattcgcaggactcaagatgactttctaaggtgatttggggatgcagtgtatgcatttttttactctttttgaaaaaaatcttttcttcgcctttggagtgtaacatttggatagttttattcagcccataataggaccaaagggaaggggataaaaaaaaattctttaaagtacctcagataaaaaggttttgtgaagaaaaggactcaaaatcctaggttataccaagactttatgttcattttgaattttctttattcatttttttcctctctgtgtatagaataatcaggagatattggtgggcagaactgttggttgataacaggaagcagagtatctgagaaaggccctcatcctgtttccttttggagctactgaggcctcacatgccagccattttaggatttgatgaaggctagagaagagttaaactgagccttcacttactcagcatcagtaggaagtagtgttggctacactaaaaacaccgttgtgccagtgaggatttggggggaaaatgacaagctgcctgtgataaacaagcaaactgtgacaaactttttgatgtgtaggttctgaagcttttcaagtttaccgtcctcaaaagaatatttatatatatatatatgccccacatgcccaatntngcattatatacctttngatntacctggaaaganaaaangatgaaatggccngtaaaaattgganatttccagggaacccgatc

SEQ ID NO: 4880 - DNA, 782 bp, Homo sapiens
  misc_feature 1, 3, 4, 8, 358, 403, 460, 500, 572, 608, 635, 642, 650,674, 689, 692, 713, 763, 780: n = A,T,C or G
ngnntttnaatatacaggctcttgttctttttgcaggatcccatcgattcgaattcggcacgagctttaggttcttgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggagatcgtcttattaggcatagagcctgtgctttaagagatactgcctatgccataattaaagaagaacttgatgaagactttgagcagctctgtgaagaaattcaggaatctagaaagaaaagaggttgnagctcctccaaatatgccccgtcttactaccatgtgatgccaaancaaaattccactcttgttggtgataaaagatcagacccagagcagaatgaaaagctnaagacaccgagtactcctgtggcttgcagcactcctgctnagttgaagaggaaaattcgcaaaaagtcaaactggtcttaggcaccataaaaaagcgaaggaagatttccangcaaaggatgatagccagaatgccatagatcacaanaattgaaaagtgatccagaggaaactnaaggacncaagtgtngatcataatgaggacccggaaacnccaggaaagtcttcnggngggaagaaaattgaaaaaccngccaaatgccttttgaaagccaaactgggaattgagaaataattcaaatncttggaaatttaggagnaa

SEQ ID NO: 4881 - DNA, 775 bp, Homo sapiens
  misc_feature 3, 4, 12, 17, 663, 752, 753, 774: n = A,T,C or G
aanngtttgaanacccngctacttgttctttttgcaggatcccatcgattcgaattcggcacgagggttcataaacacatggctaacaaagtaaagccttcaagtctggcacagactcttgactacacgatgggaaaagggattccaattacgatttaacttgtattttaaagatgagaaaagaaatgaataagaaaatttgttgctatttttcttcttccaaattagaatctatatctctaaaaatactttgcatgtttagtaaacatccatcttgaacagaagataccttgacatcagttctatttaatacttatggcaattaagagatttagaaagcagaggaaaagaccaaaaaaaagtatgtgttacaaagtgtcatcatgcttgtaggaccccagcattcttgaaactaacgcacctttaaaaagtaatatttacactgctgtaaatatttgcaaagtatcaatgtttaattcacttagaattttaaggattatggatttactagcgaaaattcccctaaagcaactttcccatatcagtaacttttatttagggaaacaagtttaatgtcataatacatgtgaccttggaattcaatagaattttcgaaactagaagtaactcagaaccgttcactagatgtgttttaaagggctnttttgatactggccttaacatttgcttatttgcaaattaatatgtaaagaatgggttctaaaagtaagttttaaggaatgggtatttcnncaaaaatgttatttcctattnc

SEQ ID NO: 4882 - DNA, 825 bp, Homo sapiens
  misc_feature 1, 3, 4, 5, 9, 30, 186, 203, 288, 541, 613, 641, 693, 706,745, 747, 756, 762, 767, 769, 815, 825: n = A,T,C or G
ngnnntttnagatacagctcttgttctttntgcaggatcccatcgattcgaattcggcacgagcccaaacctaatttaggagtaaattttttgtagcagatagccagatttcagccaatcacaggcttccagctaacaagactatgcccaaataaggcaaatgcctcatcacatgatgctcaaatnaggcagccacctaggcnaggccaatcaggtaacttttctactttgcttaattgttcagcctgtacaaatttgctgcttatgactgctgagcagagctgtctnaacctcttctggtttggagtgctgccttatatatgaattggtctttggtcacataaaattggttaaatttaacttctctaaagttttgtattaaattgtatgtaaaacattggtagcacaatttggattcagatacccaaatattgactatgataatgtaaataatccttaagcagactgatttacaaaggcctgaacaagtttgatattctgaatattcacttcttctgatgaaaaaattgccaagaccttncaattggcagggaaaaaaaatgtgtgttggttaaataagttatgtttaacaaccaagaacatttaccacaanttaggaaaactctttacctatggcccanggcacctatttttaaaccacacccttttggtacccttttttttaaattcctngaaaaaaattttnttaaattaaaatatggcctttttaaatatttaatttggnanttttaatantttaangtggnanttttaaatatttggccccctggttttttgggggaaattaattgccngcaatttaan

SEQ ID NO: 4883 - DNA, 789 bp, Homo sapiens
  misc_feature 2, 3, 4, 5, 6, 7, 8, 9, 10, 11, 13, 14, 15, 20, 83, 269,288, 320, 340, 343, 357, 409, 421, 441, 532, 542, 550, 566,572, 593, 595, 602, 605, 607, 638, 640, 646, 664, 668, 670,673, 682, 710, 711, 719, 726, 728, 733, 739, 747, 751: n = A,T,C or G
  misc_feature 758, 761, 773: n = A,T,C or G
gnnnnnnnnnngnnnttttnaatatacaggctacttgttctttctgcaggatcccatcgattcgaggatatgttgcactagtngttccttgtgactggaatattctctgcccaaactttgaaaggctagttagttacttctcatcattcgggcttaggttaagtgtttcctccttagagttcttccttgatttatcttccccccagtctaaagtgccagtcacattaatctgacatatttctccatacagcactcatcactgattgatnaaaaatctattttgccatntttctctctcactggaatattatgtgctcatnaagaagctactcgtgtatantgntcctgatcgtctgngctgcataacagattacctgtgtcatataaggtgcacaataactatatgcgntgcgtgaatgancaaacgttctctccagtctnttttcaaatcttctattccatcacgactgaaccaaaaggaaatgtactagacgttctgtctggcagccttgttccatgcttagcctttcantgattgccantatctttnatgatgctgggccttngccttnaccatggctagaatgttagantnatgaacnaananatgccattttgatccctgctgcgttcacctnantatggngcctggcaagcctttaanaacntnatnactcagtgnaccaaatgaatgagtaaacgaccttttnnatcctttnaaggaantnaattngcctgnttataggnaatngttgganccnaattccaacttnggccaattggaaaccc

SEQ ID NO: 4884 - DNA, 752 bp, Homo sapiens
  misc_feature 2, 3, 4, 10, 427, 429, 431, 433, 434, 435, 438, 445, 453,456, 460, 463, 465, 473, 477, 483, 491, 494, 498, 502, 506,510, 512, 513, 516, 518, 519, 520, 522, 523, 524, 525, 526,530, 536, 538, 543, 545, 550, 552, 556, 557, 558, 559: n = A,T,C or G
  misc_feature 561, 562, 565, 566, 568, 573, 578, 579, 580, 582, 586, 588,592, 593, 594, 595, 596, 598, 599, 601, 602, 605, 606, 607,608, 611, 612, 614, 615, 618, 619, 621, 622, 624, 625, 628,629, 633, 634, 636, 637, 639, 643, 648, 649, 650, 653: n = A,T,C or G
  misc_feature 655, 656, 658, 659, 661, 663, 664, 667, 668, 669, 670, 671,672, 673, 674, 675, 676, 677, 678, 679, 681, 684, 688, 689,692, 693, 695, 696, 697, 698, 699, 700, 701, 702, 704, 705,708, 709, 711, 712, 715, 716, 717, 718, 719, 722, 723: n = A,T,C or G
  misc_feature 724, 725, 726, 727, 728, 729, 730, 731, 732, 733, 735, 736,737, 739, 740, 741, 742, 743, 744, 745, 746, 747, 748, 749,750, 751: n = A,T,C or G
gnnntttttngatacagctcttgttctttttgcaggatccctcgattcgaattcggcacgaggcagtctcctgagccagagtgtgctcagacagagtccagctggtggaaagggacttatggagagaaaaagaaaagcgatgtagaaaaattgaaaagaggtacagaaacagctggattggttacagctcggtgtttgccttattttgaacagggtttgaacagttggccacctttggttgctcaaaacttggtgattggcacaagagtaggttacagtctgtttgcacatccatttaggttgcagttcactgtgtacagagaaacctttaggctgaacttaaaacgtgtaaggagacagctttctgcttgatttaacagtaacacgggtgtgtgttgggaggtagggaggtgggggctctttcttntntnannntgnctttttncacaacanttntgangantnagcttgtnatgnatttgngcaactgnttntttntgtnattntaancnngancnnncnnnnnactnattttnanatttnanaaaantncatnnnncnngcnnanccttnctttnnntnctgncnaatnnnnngnngnnctnnnnacnnannatnngnntnntgnnctgnntnngntttnttttnnnaananntnntntnnggnnnnnnnnnnnnntnctntttnnaanncnnnnnnnngnnttnncnnggnnnnnaannnnnnnnnnnntnnncnnnnnnnnnnnnnt

SEQ ID NO: 4885 - DNA, 764 bp, Homo sapiens
  misc_feature 2, 3, 7, 8, 650, 652, 654, 695: n = A,T,C or G
gnntttnnaatcagctcttgttctttttgcaggatccctcgattcgaattcggcacgaggtcagcccagctcacggccctggctgcccaacagcaggccgcagggaaggaggagaagagcaatggcagagagcaagatttgccgctggcagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtntntngaaccagttacttctaataatcagaaaggagatgttttatnggacatttctttaatataaagttagagatgtcttcttagcagtatggctatcttttgccacagaacata

SEQ ID NO: 4886 - DNA, 757 bp, Homo sapiens
  misc_feature 2, 3, 4, 533, 599, 648, 651, 746, 750: n = A,T,C or G
gnnnttttatagatacagctcttgttctttttgcaggatcccatcgattcgaattcggcacgaggttttatacattttatgttctttgcaaaactggagccccagaaagaatacaaagtgagcttctgttcccacttctcccagaatagcctaggatgggcaaccatgtaaaattcaataaaaatccaaccttctaactaactcgtggtgttggagagtattaagcatttgaaaagttcaggtagaattttcatcctttttgagctctttcctagctgctttgctgtgatatatctgtcactccagatgagggagtagtggtggaaaaggaatgcattctcagattcattgttggtagttcaaaagaaaataagtaaaccttattcattctctgaagtactttccaccactactacaactgatccaagaaaacaatttcccattggatggtattattcagagtgttattaacaatcagtcctgaatttttcagaatagtactaaagttgtctttttttttaatgggttccttncttcaaggttatagtaaagcttttttataaccttcaaagaatacaaagtggaatttgtaatttatnggatatacattcctagtttacaggtactatttaaagctggcaaatttanatnaagatgccttccctttaaattgcccctttaaatctatggcatgtctcacttaagagttccaatttcagaatttcatggcaacttgggaaacggcntganggaattt

SEQ ID NO: 4887 - DNA, 787 bp, Homo sapiens
  misc_feature 1, 5, 9, 14, 16, 114, 191, 259, 267, 297, 362, 415, 609,632, 655, 662, 707, 737, 782: n = A,T,C or G
nggtntttnaaaancngcccgttctttgcggaccctcgattcgaattcggcacgagcttgaagtagaattttttttcattccttacacttctcagtgagtggtaactgtagttnttgctatcatttttcattttcgtttttgcagttgaacatacttttttcactcagagagttggagggacttgcccaanactgcccaatggcaatgagatttcaacctcaaatcaatgttctttttaatgcaagatgataaagagtnggattcancctaatttaggatagaataaagccaaatantttaggataggttctttggtgttcatgggtgtaatctaatgcccatgatgcaagtggcagagtanagaattagtgcacagcaataattaaagtgacatattgccaaaggaagcggttntagcccattatataataccttttaaaggacagacgcatactcaggtttattttacctgctgagcttctgccttagaagttttcagaattgtgattacattgaataggaaaaaagtctgaactatcagaaaccagtgccgcaactttgacaaacaactgattattataataatctgcctctagcatgagactatnttaattattatttaagctctggnggacttcattaagcagcccagtnaccaccngaaaggttaaagattattaaaatggaaaggaatggttaccaattnggttattaattccgggaacccttaaggcanggaaaaatgggctttgaaaccccaaaaaggtgggaaggctgcaantgaac

SEQ ID NO: 4888 - DNA, 768 bp, Homo sapiens
  misc_feature 1, 3, 4, 5, 7, 11, 12, 30, 37, 90, 93, 252, 262, 289, 479,485, 486, 493, 503, 505, 510, 523, 525, 528, 530, 537, 543,546, 559, 567, 570, 577, 578, 580, 583, 585, 587, 589, 593,607, 618, 621, 624, 633, 634, 647, 648, 652, 663, 664: n = A,T,C or G
  misc_feature 669, 671, 673, 691, 694, 696, 705, 706, 709, 714, 718, 722,726, 730, 731, 732, 734, 737, 739, 746, 761, 766: n = A,T,C or G
ngnnntntttnnaaatacacgctcgttctntttgcangatcccatcgattcgaattcggcacgagggggaaagttttcagttgtattatnagntggattctgactatttgccataactgtattctatacacttgctgaaaacattgaattagggaatactgaatcatggctcctaagggaaagacagggttaggttcctggaagcctctggtcacaacattttcaccaactgatcaatagataaccttgttntgtttatgtntgtgtttagagacatttaatatatatngttgacttactaacatcgaactcatggccaatagcactataacttacggctgaacaaagcttatcaagtcttttctctataaggcacatcccaccttcttgcacttaggagcactagacggcatttctcagcactatacaaggggctatttaaaacagaataatcacccacaaaaagcacaacaattcanaaaaannaaaagcnaaagtcttananaacanaacattgcataananttnanaatcagnaaaaanttngccctttaaaccnttaggggncgnttcccanngnccnancntnatangatccattggtaantttgggacaanccncanttgaaggcnntgaaaaaaagctnntttngggaaatttgnnatctntngnttaatttggaaccttttnacncnctttaaccnnttnccacntccnttgnattnattnnntnttnanggttcanggggaaggttttggnaagtntt

SEQ ID NO: 4889 - DNA, 794 bp, Homo sapiens
  misc_feature 211, 259, 262, 443, 538, 548, 589, 594, 624, 630, 653, 688,700, 704, 734, 738, 739, 754, 790, 794: n = A,T,C or G
ttgtctttttgcaggatcccatcgattcgaattcggcacgagaacatgagggccctctatgccagaagtgaattcatctcacaaaacatgttgactctagactggtgcctcctccagctactactacccccattagtcacctagtaaaaaatgacgacatttcatcacctgcacatgaaccgctttccccccatttcttaatcatgaattnctgtgtcttaaattattaatggctaagactaggtctggcagtaaattnctntctcctggatttttggcccaactcgagtatttttgaaaaaccgacacagtattttaggggagcccaaaaaccatgatgggaaaaagaatgagctggttgtaaaggaagagggtggcagagcccctctccagcagtgctcacagggacttccccagggcaccaggcaccatctggagacggntttggtcacactgggattgcggggagtcacctagtgggtggaggggccagggatgctgctgaacacccaaagtgcacaggatggctgcagtcgancatgtcaganaaagggtctggccccaaaagccactcgcgccggtggctganacaancttggagcaagggaaccctttggtcaaggnccccangttttttaagctaaaacgtaaancaggaaccattcaagccaagaaggagttcccaggnacgttttttttnttanggaatggaccctttaagaaaaattgaaaancatnnttacccatggggttnaacccccatggaaatttccgggccaaattccaagtncctn

SEQ ID NO: 4890 - DNA, 750 bp, Homo sapiens
  misc_feature 1, 4, 5, 16, 30, 355, 423, 437, 439, 459, 497, 544, 592,622, 629, 665, 670, 673, 706, 734, 750: n = A,T,C or G
ntgnnttttaatactngctctcgttctttntgcaggatccctcgattcgaattcggcacgagactgtggagagatctcagtttttctatctgtaattgctcatattttgaatgctaagttttcatcaaccataatttttacgtgctctaatatgtttcttcacagattcatgccatgttcagtttaaaagagtcctgttcttttaatacattatctttgaaatgcctcttactgaggaatgactaaacttcttctgaaatgtgctctctggattgaagtcaagagtacatgttgcaacaaagataatcatgacttttagtattaagagacaattaccagattgagtgctacttanaaaagtttccctccctgtgcagagattactggcttatcaaacaacccgccccatgtgggccatatatnattgagataattantntccaactgatactaaaaggngtaattgggataaattaattttagcaaagagtcctgtntccaaagaaattgggtcatgtatttggcaattaccaaaaagtcagtngtcaaatatgaatgataccgtggtgtgcagtgaacaatcaatttactnaagggaggctggcctttaccttcgctcttngagacanctctagcctggaaatcatgcctgataggatgtcttncttgnganggactgaaaataaagaatacctgaaatctggangattttaagaggtggtgtgaatctgttnaagaaaggtgaggaan

SEQ ID NO: 4891 - DNA, 824 bp, Homo sapiens
  misc_feature 7, 10, 22, 23, 25, 26, 29, 31, 39, 55, 59, 68, 69, 73, 96,105, 137, 148, 149, 182, 211, 255, 264, 273, 287, 289, 300,320, 325, 328, 330, 351, 355, 363, 369, 395, 404, 405, 412,413, 414, 419, 428, 429, 438, 443, 444, 445, 448, 451: n = A,T,C or G
  misc_feature 456, 466, 479, 480, 485, 514, 523, 524, 525, 530, 533, 534,537, 544, 552, 560, 562, 563, 567, 569, 585, 596, 611, 613,617, 628, 629, 632, 633, 640, 647, 648, 652, 655, 660, 661,665, 666, 668, 673, 678, 679, 687, 688, 691, 693, 698: n = A,T,C or G
  misc_feature 699, 706, 712, 718, 722, 728, 733, 734, 735, 738, 748, 749,751, 752, 756, 758, 761, 763, 766, 771, 772, 782, 787, 794,796, 804, 806, 807, 811, 814, 819, 820, 821: n = A,T,C or G
ccctttnaantcccttgttgtnnannagntnggaaactnaagcttcgtaaaaganaggnttgggaatnnggcncggggaggaagcattcacatatnctagaatantatgacttggctatcaaccccttgccggctgnagctccccatnngctgtagtcctgtatgtgctatacccaacctanagcacggcgccatgcctggctaatttatnctcataactttctacagagatggggtctcactatgttgcccatnctggtcttnaactcctgncttcaagtgatctncngcctgagcctnccaaagtgctgcgattatanacttnaancnatcgacttggctcaaatcttngttntaattggncctttngtcagaaagaatgtgccactctgaantttgttccnnatattgnnntcttnaatcacttnnaacctattntacannnatnttnatttnctcatgaaantgctgggattatnnacatnaccaaatagtgcttggctcaaatattcgnttcaatagnnnctttnatnncanaagactntgccactnttgatttngnntcangngtgttaagcttagtancttgcacttanctggaacctattatncntttnaattttacttnnatnncatcttnctaatcnnaatntcnatctnnaatnnanctttntaatnncatctacnnccngnttttnnaattttnctgatnactggnctanttttanccggnnnttntaaataacgnncnnaccnanatntntangcatnnactcttcccntgtanttttctncnaataaatntnncggnaanatacnnnacc

SEQ ID NO: 4892 - DNA, 779 bp, Homo sapiens
  misc_feature 21, 23, 32, 35, 52, 54, 58, 528, 729, 761, 775, 778, 779: n = A,T,C or G
ttctaatgcttggttctaatncntgggctctnganctttctgcaggatcccntngatncgtataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattctccgagcttcgcaatgccgctaaggacgacaagaagaagaaggacgctggaaagtcggncaagaaagacaaagacccagtgaacaaatccgggggcaaggccaaaaagaagaagtggtcaaaggcaaagttcgggacaagctcaataactttagtcttgtttgacaaaagctaccctatgataaactcttgtaaggaagtttccaactattaacttataaccccaacttgtggtctcttgaagagactggaagattcgangcttccttggccaagggcagccctttaaggancttccttattaaangann

SEQ ID NO: 4893 - DNA, 805 bp, Homo sapiens
  misc_feature 7, 8, 13, 20, 23, 30, 32, 33, 38, 40, 44, 117, 129, 139,140, 258, 289, 383, 387, 414, 486, 538, 547, 572, 579, 583,618, 619, 623, 628, 632, 639, 650, 661, 675, 678, 685, 687,719, 740, 744, 747, 752, 753, 754, 760, 761, 764, 770: n = A,T,C or G
  misc_feature 771, 772, 776, 798, 803: n = A,T,C or G
ttccaannggctnggttctnatncttggcnannaaaantnggtnggaattcggcacgagctttgcagccttttcctgcccttaaatttgatacctttggtgtaggagctgcataagngacagttgctgnttttacgttnncacgcgtgatcttgaccctgctagcctgaagtgtatggtttctcttagccagttctaatttttgttcaggtggaagatggatgcctgaagtgtagactgctgctagctgaataccatntgggagcataaaggtgacctgaaggtagggngatatgtcttaaagcactttgtaatgggaatttttatcaccttttaaattggggttccttctctagtgagttttaatgtcagtaggtacattcngtantgttgctctgtctgtagctattaaggngagttaataaatgggatagcctccacagcttatttttgggaaggttttgctgatacttcctgagaagcccanggaaataaatacgcatagtctggcattctgcatcttctttaagatttgtttntatgtgtangtaattgagttttttaaaagcttgngaaatcngcangcatattaccaaagttcttgattaaaatggtaatnncaanaaatntttngctgtcnaattgagtacntttaatttcanctcttaatgatggnccntcggtgnanggattttgaaaaattccgaatctttcaccatngaacttaccctaggaattcantttnganaattnnncatggnnaantcttgnnnggantacctgaaccataaatttcccnggtcncg

SEQ ID NO: 4894 - DNA, 789 bp, Homo sapiens
  misc_feature 24, 30, 41, 45, 48, 50, 51, 54, 55, 59, 61, 191, 195, 208,397, 437, 440, 485, 544, 585, 595, 614, 627, 656, 673, 679,690, 694, 726, 729, 742, 752, 769, 773, 775, 777, 779, 781,788: n = A,T,C or G
tccccttttgaaccttgtccaatnagtctnggttctaatcncttntcnannagnnaggngntgggaattcggcacgagtattagtgataagtatatatggacatcttttggaacaaagataactaacaaaagacaagaattttcaagaaggaaaacaaagaaaaaaaggtaatcagggtatgttacatagnttanctgcttatagttnttctttggttctgctcatggaaacacaatgactatcaatctaagtaagactataatatattagaaggatgggtgatgagaagtgtgaagtgttgcaaaggtaaatccttatcttccgctatgaagtatcaataagcaatgcccaaaaaaatgaactattaagaagtaactgtaaagttatatcatttanagatagagtggagtatagcaaatgaatcagctaaaatatnttnaaaatgggtaccctctggggagtggaagatacatgtatgtattgngggtgggggatgcactgcaatgagatttcttttttttaatccttgtggtactacttagntctctaaactatttgcatctataactttgctaaaaataacntttaaatttncaaattgatcactcttgtnatcagttcaaatngaaacaaggagataacataattgctaagnttatttttggcatattnatcacnttgtatatgtntcantgagaataccatgttacattcctctcaagcangtncttcttaaagtcnaaattgctgnattatttctcaaaaacnattntngnantncactttng

SEQ ID NO: 4895 - DNA, 785 bp, Homo sapiens
  misc_feature 38, 41, 48, 604, 687, 715, 716, 733, 767: n = A,T,C or G
gcgtcccccttttgaaactcttcaaatcccttggtttnaanccctttncgcaggatcccatcgattcgaattcggcacgagatttgccttaatcttgggttactagtaatgctatctgcgctgtgcgtctaaagcctccagaaagattgctcaggcatggcctaatagcttttatcagttcactcagtggctcttacactttgatacctgaaacctagagttaactgtgtaggaccaagctcttctgaaggagtcaactgctctcctctgtcaataatggctgtttatgccaaaacagccaagagaacctccccacccccttccctctgtcaaagtgaaatggaacctaagaatggaagctagtggctattttgccataccccaaccaacttgctattgcttaattccatctaattatcagctgggcgtcgtggctcatgcctgtaatcccatcactttggtaggccgaggcaggaggatcactagaggtcaggagtttgagaacagcctggccaacatggtgaaaccctgtctctaataaagataaaaaaattagctgggtatagtgatgggtgcctataatcccagctactgggaggctgangcaggagagttgcttgaacttgggaggcagcagttgcagtgagctgagattgtgcccctgcactcaaagtctgggcgacagantgagactctatcttaaaaaaaaaaaaannaaaaaaaactcgacctntagaactatagtggagtcgtattacgtagatccnactgataggatccattgg

SEQ ID NO: 4896 - DNA, 813 bp, Homo sapiens
  misc_feature 15, 37, 379, 402, 461, 595, 629, 633, 654, 662, 710, 711,712, 715, 720, 722, 723, 725, 727, 728, 735, 742, 743, 747,755, 759, 762, 766, 775, 776, 780, 783, 786, 791, 794, 795,801: n = A,T,C or G
agtctcccttttaancctttcaaatcccttggttcangcctttacgcaggatcccatcgattcgaattcggcacgagcttgagagaatagatctagatgggtggggcacggttctggggaatggaagggccaaagaggaaagtgggcaatggtggggttgagaacgcagcttctggactcagcaggcctgggttcaaactctgttaatcactcctgttaatcccagcgctttgggaagccaaggagggaggatcacttgaggccaggagttcaagaccagcctgggcaacataatgagattccatctctacaaaaaataaaaacaattagccaggtgtggtggtgcacacctgtagttccaggtacttggaaggctgangcaggagaattgcttgagcctgngagtagtgagtcatgagtgcagtggcacgatcatggctcacttgcagccttgacttctnaggcttaggtgaccccccaacctcatcctcccaggtggctgaaactacaggcacatgccaccatgcccaagctgatttttttgtagagacagggcttcaccatgttgccaagctagtctacaaaagcatctganttttggaagtacatggaatttgttgtaacaaaantatnttgaatggaaatggctctcantgtatttntggaattttccattaaataatttggcttttttccttgaaaaaacatannnctnctttntnntntnnatacttnccccttnnttantattatanaatntcnttcnagccctttnncaanttntcntgganttnnttattncattttatccct

SEQ ID NO: 4897 - DNA, 778 bp, Homo sapiens
  misc_feature 21, 589, 626, 631, 653, 733, 753, 754: n = A,T,C or G
tttgaaatccctggtttcaantccttgcgcaggatccctcgattcgaattcggcacgaggcgtccttcagatatcaaattcaagcctctaaataagaccaaggagtatacagcctgtgaactgatgaacatatacaagactgacaatcacctgaaacattatttacatatcattgaaaacaaacccctgtatccagttatctatgatagcaatggtgtcgtcctttcaatgcctcccatcatcaatggggatcattccagaataacagtaaatactagaaatatttttattgaatgcacgggaactgactttactaaggcaaaaatagttcttgatattattgtcaccatgttcagtgaatattgtgagaatcaatttacggtcgaagctgctgaagtggtttttcctaatggaaaatcacatacctttccagaattagcttaccgaaaggagatggtgagagctgacctaattaacaaaaaagttggaatcagagaaactccagaaaatcttgccaaacttctgaccaggatgtatttaaaatcagaagtcataggtgatgggaatcagattgagattgaaatccctncaaccagagctgacattatccatgcatgtgatattgnagaanatgcagctattgcttatggatntaacaacattcagatgactcttcccgaaaactttcaccattagcttaatcaatttcctcttaataagctcactgaacttnttcgacatgaccatgggcannccgttggcttcacttgaaccactt

SEQ ID NO: 4898 - DNA, 744 bp, Homo sapiens
  misc_feature 9, 45, 49, 51, 54, 56, 60, 67, 83, 91, 106, 111, 115, 116,124, 129, 149, 159, 169, 171, 172, 175, 180, 186, 193, 195,200, 201, 211, 217, 220, 227, 236, 238, 242, 250, 252, 254,257, 285, 286, 300, 316, 330, 332, 335, 347, 352, 361: n = A,T,C or G
  misc_feature 366, 373, 376, 379, 386, 388, 389, 414, 421, 426, 437, 441,448, 467, 471, 483, 485, 488, 489, 492, 493, 505, 509, 512,516, 521, 525, 533, 539, 546, 553, 563, 564, 565, 568, 576,585, 586, 592, 609, 616, 618, 640, 648, 649, 653, 664: n = A,T,C or G
  misc_feature 665, 670, 676, 689, 699, 704, 705, 708, 712, 714, 715, 716,719, 722, 723, 734, 736: n = A,T,C or G
agtctatancagctctgttctttttgcaggatccatcgattcganttgngnacnangttngtgcttnaccactgcttactcanggcccgcnctttgcccgcatttntgcanatcnnacccctancccangagcctctggcagacttaanagcctgctgncctcaccagngnnccnacatngccggnctgagancnagtgnngagtcacagnctcagncanaatgccnaacgcctcnanctgntcctgacngntnccnaggggacaccatatagccttagtcatgnntcatatgcccggangaatcttcccccagangggactatcctagncnacnagatttgtgtcnaaatntctgcttgntgttngaacctncanacnatatggnanngacacactatggaagtctggaattncatgganatttnatgatatgaantaantgtgtangctcctggcatagcaatgntgtnttacttcggagntnaanngannctggacgttgcngacntgntccntaatncaangcaccctnatggangatagcnggacatnctgggcttgnnnatngatcctgntgaagcaannctgcgntgtgattattacccgtnggctggngnccaccagcactggctaatgctntacggctnnagtntctttgtcagnntattnaatggntatgtaaactttnagaattaaantgggnnctnttgngnnngantannttaaccttacntntttcctat

SEQ ID NO: 4899 - DNA, 1017 bp, Homo sapiens
  misc_feature 4, 252, 254, 279, 280, 284, 288, 290, 297, 305, 316, 335,336, 338, 341, 346, 350, 359, 361, 362, 366, 369, 370, 372,373, 374, 375, 376, 379, 391, 395, 397, 399, 402, 405, 415,417, 423, 424, 426, 428, 429, 430, 433, 436, 445, 446: n = A,T,C or G
  misc_feature 450, 453, 455, 457, 458, 461, 464, 471, 472, 473, 477, 484,496, 499, 500, 504, 506, 507, 511, 512, 518, 519, 522, 523,524, 525, 526, 527, 528, 530, 531, 532, 533, 534, 536, 538,541, 543, 547, 548, 549, 550, 551, 552, 555, 556, 557: n = A,T,C or G
  misc_feature 565, 566, 571, 572, 576, 577, 582, 583, 587, 589, 590, 593,595, 597, 599, 603, 606, 607, 609, 610, 615, 616, 620, 624,625, 630, 633, 636, 638, 639, 644, 645, 646, 650, 651, 652,655, 656, 657, 658, 659, 662, 663, 665, 666, 668, 670: n = A,T,C or G
  misc_feature 672, 675, 679, 680, 681, 683, 685, 689, 696, 697, 698, 700,701, 704, 707, 708, 709, 712, 714, 718, 722, 724, 725, 726,727, 729, 730, 731, 735, 736, 737, 738, 741, 744, 745, 747,751, 754, 757, 758, 759, 760, 761, 763, 764, 768, 769: n = A,T,C or G
  misc_feature 772, 774, 776, 780, 782, 790, 791, 792, 799, 800, 806, 807,812, 814, 815, 817, 819, 820, 824, 825, 826, 827, 829, 830,831, 835, 836, 838, 839, 847, 848, 850, 851, 856, 859, 861,862, 863, 864, 867, 868, 869, 870, 872, 873, 875, 876: n = A,T,C or G
  misc_feature 885, 890, 891, 892, 893, 899, 901, 903, 908, 910, 911, 913,914, 919, 920, 926, 930, 931, 932, 934, 935, 936, 938, 945,948, 951, 952, 953, 957, 958, 961, 962, 963, 968, 969, 975,984, 986, 990, 991, 993, 996, 1000, 1003, 1005, 1006: n = A,T,C or G
gttncttccatcagctcttgttctttttgcaggatccctcgattcgcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgntnaatatgatatgagggtaagattttnnatanaccnantgtaacnttcttagngcctttagttncaagaggcttgcatacttnntnatnaccantatnacacgcctngnntttntcnnannnnnctnctgcacacacanaccntntnttnctngtatttctgntncgacanncntnnnctntcntcttacccnncctnctnantnnccnttncctcccnnntccnccccccncgacacttactnctnncctncnncctnnccctcnnctnnnnnnncnnnnntntnccncncccnnnnnntcnnnactatctnntcccnnctanngtctnncttncnntcnantntntgcntcnncnnttctnntttnttcnntcatntcncancnncctgnnncctnnnccnnnnnctnncnncntntnttnaccnnngncnctcntctcttnnngnnctntcnnntcntnctcnctcncnnnntnnngctnnnnatnctnntntatntcntcnnnnntnncacnntcncntntcancntctgttcnnnctctcanntcatcnntactncnntntnncctnnnncnnncgcnncnntctctctnnannttccncantnnnntcnnnnanncnncttgatctncatcnnnnttctcntncncatgntnncnntcccnnatttcntatnnngnnngnttacctnctntcnnnatcnntcnnnttacnntcatcncccccctgntntccnntncgnatcntcnannccnntntcncg

SEQ ID NO: 4900 - DNA, 747 bp, Homo sapiens
  misc_feature 2, 7, 9, 398, 405, 408, 418, 425, 534, 556, 562, 582, 601,622, 662, 666, 739, 744, 746: n = A,T,C or G
tntttananatacagctcttggttctttttgcaggatcccatcgattcgaattcggcacgagggcagagaatcccttgtagaaaggtgggggagaatcataggatattataactgtaaggaacatgcaagattttccagattatacccttgatagaatagataagttccttaaggctcagatcttgcttaaagtcgtccagcctgttagagacaagtagaacacgaagctggcctctggagtctttattgagtactttgtacaattggtgtagactgggagagccctcctcacttcccctttcttgtgctgtaatttcctgtggggcagaacacctcagaggtttctgtgcatcaaaataagatgcagcaaagacatggaaaaaggataacgagacanattccancantaagtagatnaggttgngttttttataaaagataacgaggcattccttccagaaatgtggagcctttgtagatttcagtgcataaaacccaaccatgatttcctgcagtgatcacagagcagagangggagaaagcccttttatcacnaaccancaggaagtctctgtaaaatnggtaaggattctggtttantgtgaagaaccccatttttgngtatgttctgggccctgggaaggacagatcatatttgacntcanaataaatgatcaggccagcatggtggttactctgaatcctaccctttggaagcttaagtggaggattgcttancccanant

SEQ ID NO: 4901 - DNA, 788 bp, Homo sapiens
  misc_feature 1, 17, 530, 584, 587, 621, 663, 676, 682, 697, 723, 730,750, 759, 772: n = A,T,C or G
ngtattcacaagcgctngttctttttgcaggatcccatcgattcgtgaaaatacttatctatagaaacagtgttgtaaataagagagtctcagattatcaaatgaaacttatttaaatccatgtaactgaactaataataccagctgcagttttatcctggctgtaaggactaccatgatgggaaaaaataagaggaaaccttaccctcccccacattcccacatgaccagcagcataagggctccaggttaccacagtatccatcatttgtcttatggccacccaagtacacctgtttacatgacttactgggcctgtgtagaaattgcagtttgtgataggatcccagtatagaatcacagaaactgacttttgaagggtaatgtaaaggctatttgtatctaacacttttttaaaaaacagtatgcttttgttttatttattggagtatatttttgaagtccctgtcctctgtcactgctcagagtaattatcatctggtttatattttctagagttttttgtgatnctataaattatgtcttttgttatgtaacacatgtaatttttttacaacaaatgnggntaatgctataccataatctactacaactttgaangggtttcccccgtggttggctactttggatctggccttggtngatattttatatnttatantataggctctcgttngttaaattccatttaaccaacttccntggaaanttcccattctttgaaatggncccattaanttatttaaattantttccctcttgggagg

SEQ ID NO: 4902 - DNA, 761 bp, Homo sapiens
  misc_feature 3, 67, 71, 74, 83, 87, 90, 92, 97, 113, 131, 139, 163, 179,211, 217, 238, 242, 245, 246, 262, 265, 266, 272, 296, 309,314, 315, 316, 330, 331, 339, 345, 348, 349, 355, 356, 375,397, 404, 421, 461, 464, 475, 480, 500, 502, 507, 517: n = A,T,C or G
  misc_feature 531, 534, 539, 540, 544, 545, 553, 570, 583, 587, 591, 605,606, 612, 621, 623, 625, 631, 640, 646, 656, 659, 664, 667,669, 680, 686, 695, 697, 698, 700, 709, 719, 724, 731, 739,748, 752, 758: n = A,T,C or G
gtnagatacagctctgttctttttgcaggatccctcgattcgaattcggcacgagatgaggtgtgangccnttnaatccgaanaagngcncnaagantgagaacgtgattgcntgaaatgttcatccaganatcttggnatataggagaacagggggagactngattgattaggttggnaatatttgtcctatggaccacggtaacggggnttagcnttcatagtatgtaaccaggantggnagnnggagtcatagagtatnggnnctcttnatcccaggagattcccaatggggncagtatctactgnccttnnngagagaccatgctnngctgtctnttttanggnnaatcannaatttagtggtcgcccctncaatcttcattccactcatccntaccctnttggcattcttaatgtnatttgtggccctgtccttatcattttacaagggtaaattntcntccagatatangaacntgtttactaaactttaagcncnttaanttaaacatcnttacctaagaacantcntggtnncaannggaggttnacaaggggctagcgctntaaaaccactctncttntttnccggaagattgccnntctgancttgtaagntnangattcntgtggacangaaganttgtggcatnacngtttnacngntgggttactantgcacntgtcaactngnngngaaatgtcntggatacaangtgtnatggggntgaatttnaacgggacncaanggtggnggc

SEQ ID NO: 4903 - DNA, 804 bp, Homo sapiens
  misc_feature 3, 4, 5, 6, 7, 72, 76, 79, 82, 84, 140, 149, 183, 188, 196,205, 206, 211, 214, 216, 221, 241, 247, 249, 273, 308, 327,330, 349, 364, 375, 382, 399, 403, 404, 406, 408, 423, 457,481, 482, 489, 498, 503, 509, 510, 517, 519, 523, 526: n = A,T,C or G
  misc_feature 536, 542, 549, 551, 560, 572, 575, 585, 594, 602, 608, 609,616, 618, 624, 631, 638, 654, 667, 690, 695, 700, 705, 708,716, 717, 725, 726, 727, 728, 731, 735, 751, 757, 760, 763,778, 789, 792, 798: n = A,T,C or G
ggnnnnnttgtctatagctggctctcgtctttctgcaggatcccatcgattcgaattcggcacgagccatcngtgnctngcnangggcctgccccataggatggcctcagcaaattttcagtgaactcaagttcattganttccaattngtgaaataaactagagggcctctctgaactgccngcctnatgagaangactgtgannagtanccngnccaanacagactgactgtgacaaanctaganancattacaggtttctgagaaagaangaaggttcaagttcacattggtactgtgaccacgncagctcattgccctcctanacngggctctgcaagctttctntttactggaggctgnactactctttnaagctgnaacagtgtgattataancccnnantnggccccctttgacancatctttacaataatgctcttggttcctcaaccngctggtgactctgaaagctgatgnngacgggntgccaaaantcatnatatanncagcctncnaaangcngtgatctctncatganctcatgnanccttaaacncgtgcttgcccnttnttttacaccnttaacaatnttgacatncacctnnatgcctntngcgaantcaaatncccgtangtccaggcttgaaaangaaacacccgttntaggttgggacctttccacaagntcctnatgcnggggnaanaacaatgnnttcattgnnnnganaatncgtcaatcccattggnttttanttngtnccttttcaaacgcgngccttttaaanatngttggnaacccc

SEQ ID NO: 4904 - DNA, 750 bp, Homo sapiens
  misc_feature 3, 4, 573, 595, 616, 630, 652, 668, 748: n = A,T,C or G
ttnntcagctcttgttctttttgcaggatcccatcgattcgaattcggcacgagcccagccataatggagcctgaaatcaggaattcatgtttcaaggttacatgtacaaatgtatgccctctcagaacaatggccattttgagaaagccagtgagagacagccagaccaggtcctctggcctagcacccaccagtgcctgccagctcagcccaagtctcctcacctaggatagcttgatggaataacaatgtattttaattttctgtagacctaaaactgctcttaaaaagtctattttaaaaatccatcattaaaacacagactttctccataataagaagttggaggggctgggcacggtggctcgcacctgtaatcccagtactttgggaggccgaggcagatggatcacgaggtcaggagctcgagaccatcctggccaacatggtgaaaccccgtctctactaaaaatacaaaaattagctgggtatggtggcgcacgcctatagtcccagctatttgggaggctgaggcaggagaattgcttgagcctggaaggtggaagttgcantgagccgagatcgtgccactgnacttttagcctggcgacaaantgagactccgtctnaaaaaaaaaaaaaaaaactcgnccttttagactatagngagtcgtattcgtagatccagcatgataggatccttgatgaatttggacaaccacacttgatgccgtgaaaaaatgcttntt

SEQ ID NO: 4905 - DNA, 851 bp, Homo sapiens
  misc_feature 2, 5, 6, 7, 26, 29, 70, 80, 84, 94, 110, 120, 121, 128, 146,151, 153, 158, 162, 163, 168, 170, 186, 192, 210, 218, 223,234, 243, 247, 255, 258, 264, 267, 269, 271, 281, 286, 300,308, 322, 332, 338, 350, 351, 355, 356, 359, 380: n = A,T,C or G
  misc_feature 391, 395, 405, 410, 412, 418, 448, 450, 459, 460, 465, 469,470, 476, 479, 491, 494, 500, 505, 523, 530, 531, 534, 542,553, 556, 562, 563, 570, 575, 576, 585, 588, 591, 604, 606,607, 608, 610, 612, 621, 635, 642, 645, 646, 649, 655: n = A,T,C or G
  misc_feature 656, 657, 658, 659, 666, 670, 671, 672, 676, 680, 692, 693,694, 697, 698, 699, 701, 705, 708, 713, 716, 717, 721, 726,728, 729, 733, 736, 742, 744, 746, 750, 756, 760, 763, 764,768, 776, 777, 779, 780, 784, 807, 808, 813, 820, 822: n = A,T,C or G
  misc_feature 833, 834, 835, 836, 837, 839, 841, 847, 848, 849: n = A,T,C or G
anaannngtcaatgctggctactcgnctntctgcaggatcccatgcgattcgcttgaacctgggaggcanaggttgtggngaantcaagatcangccactgcactccagnctgggtgacnngagcagngactccatctcaagaaanaagtnantaacnaatnnttcgngnatgtgatgactgactntagtcnttatggaaaataacttcnggcagctnagtanctactggtcancaattccgntgtntaagagangtnctacantcnantnctcaatattntcagnctgatttcaatacngacacgcnaccactgaaatgcngaaagatggnaatcanagtgtgatgttnntatnnaantctcgagattcacatgtaatnagaccctttancttnaatgatcacnacatnanaatggngacatgatcttaacttgggaacatatggantntgtatttgnnaattntagnntcacanacntatccctatgantgngacacncatgnctgaaatctaagctttanaatattnnctntgtcagtnaaacagcatgnttncatgcnnactgaanctaanntcccaaatnaantgntcatttttggatngnnngnancacattgtnaaccaattcgttgncaacttntgnntancaaatnnnnnaccatanctcnnntggnaccnatggaagggatnnnatnnnancaanaanccttnggnncccntctangnncctnttngtagangncncaanttcccnctcntgnnccangacatggnncnnggantaccccttcattaattttggctnntatancctcaananttgaaattccnnnnncnanaaattnnnct

SEQ ID NO: 4906 - DNA, 762 bp, Homo sapiens
  misc_feature 1, 3, 4, 7, 648, 707, 711, 730, 734, 747: n = A,T,C or G
ngnnttnatcagctcttgttcttttgcaggatccctcgattcgaattcggcacgagcttccttgtataatactgatcattctattttagcggtaagaacccaagaaggagtatggatacctgtaaagctttctggtccttgggaagcctctccttctgtgcatattattactgaaattcttcaaaagattctgagatgctctcagtgtttcattgctactttaattttaatcattatgggattgattgctgtcacagctactgccgcggcagctggagttgctttgcatttcacagtacaaacagcagactatgtaaataattggcagaaaaattctactttgctgtggaattcccaaactaatatggaccagaaactagctaatcaaatcaattatctccaacaaactgtaatgtggctaggagattgagtagttagtctagaatatagaatgcagttacaatgtgattggaatacttctgatttttgcattactcctcatctgtataatgaaagacagcatgagtgggaaagagttaagaaacatttgaaaggtcatactggaaatttactttagatattatgcaactgaaggacaaatatttcaatcttctctggcacatctgacactaatgccaggaactgaantgcttgaaggcgcttcaaatggattagcagctattaacccattaaaatggatcaagacnaaanaaaaaaaaaaaaactcgancctnttaaaactatagngagtcgtattcgtaa

SEQ ID NO: 4907 - DNA, 759 bp, Homo sapiens
  misc_feature 7, 564: n = A,T,C or G
gtttatncagctctgttcttttgcaggaccctcgattcgaattcggcacgaggtcagaggtcaacaatgagtatgtggcaataacaggattcaaacccagatctgttagcttccaaagtccttggtcttacatgctacccactagttccttggagggggctccggaccatggaggtcacacaccagtgctccgagtgtggtcctcacagcacctgcatcaacatgaggttgggatttgattaaaagtggatttctggggccacccacattctgaatctaaagttctgggtgtggttttaggaacctgtgcttttaacaagtacccttagtgatttatatacttactaaacacttgagaatcactgatctttccagtgtggtgtgacttatagacagtgttggacagaaatgaaacaaaggagaaagatgaagcacagacagaaagagctgggaggatgccctgcatgttcttatatctgtaaatacgcatctcttctcctttgtctcagcccttgctgtttaaatctagacccttacatttttcaactatttggctccagcctncccttgcctgactcctggctttgtatattacctctctttcctgactttcactgccttttacaagtttgcattttctgctcatttttagaagatcctactaagggccaaaggaaaatacactgtacagaaacctaaaattaagccctttagaactatagtgagtccgtattacgtagatccagacatgataggatt

SEQ ID NO: 4908 - DNA, 761 bp, Homo sapiens
  misc_feature 2, 6, 7, 8, 599, 756: n = A,T,C or G
gntttnnncagctcttgtctttttgcaggatccctcgattcgaattcggcacgagattctcccaaaaaggttcatcccgagaacactgaagaataatttttgggaatgttaatgatgtgccacaaaattagtattttatgatcaaatgaatttgctttataatattttatctaaatattcatgctcctgaagactcacaaaataaaggaaactttatccagctttttccagaatttacttgcacatagactccatttatatagcatgcctattgaactctgtaaatagtgcagttcaggaaagatagcagtgtgggaaatgtcactctaatggtcatatacgtttatcccatgggaggttaaagcatataggtgagaggagagtgatcgccctggggaactgtaatgagaaaggattgatggctgtttcagttgttgttttcctgtccctggctgctggcatgggggcaagggggaggctgaggctcaggtcttagagaacagaacattgcatttcacttcacagtcagcaaagagaaagccaggcaagcacccagaagtcagtgccccagtggagtcacaaaagactattaattcttnccacattgaattgtgacacacaggaagctcattacagactgagtgccctgagtttttatttggggctagtcatgtaggtccctttggctccatgccccccaattccagacttccagaaagaaagccagaattcaaccttaactggcttggttggtcnaacca

SEQ ID NO: 4909 - DNA, 782 bp, Homo sapiens
  misc_feature 476, 534, 586, 622, 633, 651, 671, 680, 705, 707, 713, 715,720, 730, 734, 739, 740, 742, 743, 768, 774, 775, 778, 779: n = A,T,C or G
ctcttgttctttttgcaggatcccatcgattcgaattcggcacgagaatacacaatttacatgtcagaggatggtagaggaattgtcacttatgcttcagtctgacttagtgaagcagtggggccgagaaagcaatcatatacgcatttgtctcacatgagcagaggaacagagggatgactttaagttctgtctgttttttgtccacaaggaattttcttgtgggcaaattgtgaggtctttgtagctatcttattttaggaataaaatgggaggcaggtttgcttgatgtagttcccagcttgacctcccttttccttagtgatttttggttcccaagatttattttcttttcacagaataaattgtctttcagacccagagagcatcacagtcacattcagaaaggtgtccaaatgtaaatcacactttcacatagaattacagctatattaacaaattttttcttccattgncttcatttgtaatatataaaaaacttaagcttttaaaaaactaaagttgaattatggncttaaaaatgatggtcaatcttatcttcactggcaggatatagaccatttgnctggataattttaagtaagttgctatacagttttangccttcctagntattatttggtggggtanttctcttactttccctgggnccagttttnaccattgggaaccccccccttaatngnccaccntnttttnccccccccanaaancccanncnntttaaaggggggaaaatggcccctnattaannccnnggg

SEQ ID NO: 4910 - DNA, 576 bp, Homo sapiens
  misc_feature 2, 3, 5, 7, 8, 13, 18, 203, 230, 255, 275, 281, 288, 289,296, 297, 303, 308, 312, 316, 320, 322, 326, 327, 332, 337,346, 350, 353, 359, 375, 387, 388, 396, 400, 405, 413, 415,417, 423, 427, 437, 445, 451, 467, 486, 491, 495, 521: n = A,T,C or G
  misc_feature 529, 534, 540, 541, 546, 561: n = A,T,C or G
gnntnannttcantatanatacaagctacttgttctttttgcaggatcccatcgattcgaattcggcacgaggctggtgttagggttctttgtttttggggtttggcagagatgtgtttaagtgctgtggccagaagcggggggagggggtttggtggaaattttttgttatgatgtctgtgtggaaagcggctgtgcagacnttcaattgttattaaaaaaaaaaaaanaaaaaaaaaaaaaaaaaaaaaaaanaaaaaaaaaaaaaaaaaacntcggcntttaaanntttaggnngtcgtnttacntaantccngacntnatannatccnttgtnaattttggncaanccncacctnaatgcatggaaaaaantgctttatttgnnaaatttgngatnctatnctttattngnancctttntaanctgcaataancaagttancaacancaattgcattcatttnatgttccaggttcaggggnaggtntggnaggttttttaattcgcggccgcggcnccaatgcnttggncccggnncccanttttgttccctttantgagggttaattgcc

SEQ ID NO: 4911 - DNA, 771 bp, Homo sapiens
  misc_feature 1, 2, 4, 5, 6, 7, 8, 9, 15, 17, 25, 189, 228, 233, 235, 247,248, 260, 267, 290, 300, 337, 350, 361, 370, 376, 464, 480,582, 629, 630, 642, 656, 665, 686, 701, 725, 731, 734, 742,744, 751, 771: n = A,T,C or G
nngnnnnnnttttanancagctctngttctttttgcaggatcccatcgattcgaattcggcacgagactgaatgggctgtatctggggaatcaaggtattagggttgagcaaaagcaagaggaagtagagcatttgatctcttttcctttgattaggttgaggacaataaagtctcattctctcccttnttcccatgggcagccttatatatgattgaagaacattantgcananattcctcatccnnaaataaactctngtacttntatactaattaaagattcatgtnaattactaanttcttggaaaactatggagaactctgtgggggctgtnattcacactttantatgaattggnttaatgacnactgtnatattggctacataaagaaatggacgtttttatttggggttaggggatcacagatgtggactggcttaggtagaatggtccctgagcnaaggagatattgaagnttatgaggatgtgcaagataagcagatttacttttgcattttattttgggctatctcagcttcttttactagaagctcatgcctataatcccagcaccttgngaggccaaggcaggaggattgctttgaagccaggggttcgagatcannctgggcacaaanccagaccctgactntccaaggangattcaaagatttctgatggngaaaacctcggcctntaaactattggggtcgtttacggngatccnganatgataanancattttngagtttggccaaaccccacn

SEQ ID NO: 4912 - DNA, 787 bp, Homo sapiens
  misc_feature 3, 4, 5, 6, 7, 8, 10, 11, 12, 13, 14, 15, 16, 18, 20, 22,25, 32, 33, 36, 50, 119, 586, 638, 664, 665, 717, 750: n = A,T,C or G
ggnnnnnngnnnnnnncngnancancactcgnnagnaaagcccttcccancgactcgaattcggcacgagccaccctggtgctcctccctctccctggtaccctgactaccaggaagtnttgtgctagagcagctggagaagtgcaggcagcctgtgcttccacagatgggggtgctgctgcaacaaggctttcaatgtgcccatcttaggtgggagaagctagatcctgtgcagcagcctggtaagtcctgaggaggttccattgctcttcctgctgctgtcctttgcttctcaacggtggctcgctctacagtctagagcacatgcagctaacttgtgcctctgcttatgcatgagggttaaattaacaaccataaccttcatttgaagttcaaaggtgtattcaggatcctcaaagcattttaaccttgccgcttaaaacccaatttaccgtgaaatgggaattttgctgcattgttaaactgtagtggaaaccatgctatagtaataaaggttatataagagagaaattgaaattaaatgtgtttttaaatttcaaaaaaaaatcaatctttaggatgactnaaaaattgatttgccatgtaaaatgtatctgcattttttacacaaaacttgntttaaagcataaaaatttaaaactgnnctcttggatgtattatacattttgaaccatatgtattaaaccataaacagtntaatggtggtataataaaacaggcattaatttnttaataaaaaaaaaaaaaaaactcggcctttaaactt

SEQ ID NO: 4913 - DNA, 799 bp, Homo sapiens
  misc_feature 1, 3, 4, 5, 8, 13, 21, 25, 605, 642, 644, 648, 679, 693,709, 716, 717, 718, 720, 727, 728, 729, 730, 731, 732, 733,734, 735, 737, 738, 739, 740, 741, 743, 744, 745, 746, 747,748, 749, 750, 751, 752, 753, 754, 755, 756, 757, 758: n = A,T,C or G
  misc_feature 759, 760, 761, 763, 764, 765, 766, 767, 768, 769, 770, 771,772, 774, 775, 776, 777, 778, 779, 780, 781, 782, 783, 784,785, 786, 787, 789, 791, 792, 795: n = A,T,C or G
ngnnnttntatancagctctngttntttatgcaggatcccatcgattcgaattcggcacgaggtccattacaccgccagcagcaatgtcttcctcggccatggcagtgggtcacgggtgcagcagtgcaatgtcttcctcagccacggttgtgggtcatgggtgcagcagtgcaagaccttcctcagccatggcagtgggtcacaggtgtagcagtacaatgccttccttggctatggcggtgggtcacggacgcagctgaatcttgaacacacctgagcctctgcctccacgtgacttggcggtagcaaggaatgaacacagttatctttttaaccaaaattttagatcatgatctcgctgtactcgttgacagtattcaggtacttgttgaagaattaatctctgctcttctctgaagtctgatttaatcaccccactcagctgccagtgaaattgggggtcatccatcgcatctcggatgtggctggctgtggctcttctgaaaagtttctttcttctgccttgtttccatatttagggggaaatcagcaagattctagagtatgtatgtgggctgggtgcaagtggctcatgcctataatnccagcactctgggaggcttaagcgggtggatcacccnangccnggaatttggagaacagtgtggggcaacatantgagaccttgtctnttccaaattaaataanttaattnnncngggaaannnnnnnnngnnnnntnnnnnnnnnnnnnnnnnnntnnnnnnnnnnannnnnnnnnnnnnntnanntanaact

SEQ ID NO: 4914 - DNA, 785 bp, Homo sapiens
  misc_feature 3, 4, 5, 26, 617, 647, 654, 669, 717, 763, 770, 785: n = A,T,C or G
ggnnntttaatcagctcttgtttttntgcaggatcccatcgattcgaattcggcacgaggatatgctttagaattaaggtgagtggtattatctctagtttgagacaaagagaagcgaagtaacaaaaggccacataagtgataaatagtggacctggagtttaaacctgggatccccacctaaatcagaaatacaaaatcaaccacttttttgatgatccagggtctatgtatatttattacatgtatgtatatatgtatatatatatgcatgtgtatatatgtacatacatacatatagatgtgcttgtactagtgtttttcccaccagatagttagcctttcttctccccttgctcacttttttttttttttttttgagatgaagtctcactcttgtcccccaggctagagtggaatggcacgatctcggctcactgtaacctccgcctcctgggttcaagtgattctcctgcctcagcctcccgagtagctgggattacaggtacctgccaccacgcctggctaatttttgtattttcaatagagacagggtttcaccatgttggccaggatggtcttgaactcctgcctcagggggatccacccgcctcggnctcccaaagtgctgggattacaggcatganccactgnacccacccaaggggnaaaacttttatttagaaaaaacttaactttcactcgttagaaaaacgngttttgaataatctaatttttaaaaatgcattaactatgtcttatnttggctnacacattttaattgn

SEQ ID NO: 4915 - DNA, 792 bp, Homo sapiens
  misc_feature 3, 699: n = A,T,C or G
ttnaaccagctcttgtctttgcggatccctcgattcgaattcggcacgaggaggaagtgagattgtgcatgacatacttctcctttgtattctctcagtgccttacagcaggttactccattctgctatgacaacttgtttcaaatgttaatttacataggattttttataagccattaaggcatatgtatagtatatcagtaaagatggatggtgcatatataaatagtcttctgtaatagtgattggatttacttctcaattatgagagacaaaaattatcccctcacctgtctctattctttcaacaggttgatcccttttcatgatttttcattaggtggttcaggaagtttccatattacagcgcttcagactgtatatgttagtttaaaaatcacttttctctctctcaacttctttcttttttttttgaagacttaatttaaaaaatttgggttgttagatccgtatcatagatttggcctagcctcttctgttaacctagtccacagatgagcgaatctggttagttgaaggacattgtgatttgactctggtcacgcgaggaagtagaagggcaaagacaggaccggcagtttacatttccagtggttaaacctcacgggactttgggacctgcttggtaactttttgggggtggtctggaggccaatctaacctggaccattttctggncccctcaacaagagagagggaaagcaaccttgggccaatgaggagtaaaaataaccttgggctttcagagatttgaagaatagaagaacttct

SEQ ID NO: 4916 - DNA, 802 bp, Homo sapiens
  misc_feature 3, 4, 157, 309, 374, 380, 383, 425, 452, 454, 455, 485, 510,522, 559, 571, 585, 586, 608, 612, 613, 619, 689, 739, 746,759, 771, 772, 782: n = A,T,C or G
tgnnatctatgctggctctcgttcttttgcaggatccctcgattcgaattcggcacgagcacacttggagctcatacaaactttttcccaggctattgtctgttcttcaagcccattcacctcccctaaaaatcatgtattcttcctcaaaaattgnctattatcttccacttccctttcccccatgaaaagtgttgaggcttattctgagccaatatgagtgaccatggcctgagaacccaatatgagtgaccatggcctgagaaccatctcaagagctccttcaacagttgtgactgagcttgtcangttgcagtttggttttatatattctagggagacaggaattataggtaaaatcataaatctatatntagaangtntacattggttcagcctaaaggggtgggatatcttgaaggcanggtggaggggatgcttacagatcatangnnaattcaaagattttctgattggcagttggntgaaagagttaagttttgtctaaanacttgaagtcantagaaacaaaaatgcttgagtaaagataaggggggtngcgagggccaangtttttggtatgtnnatgaagcttcatagatcacagncttnngagagnatagaagataaatgtctcttttcagactttaaaaggttcagactctcaggttaatctcttctagatccangaaaagcctccaaaagaaaaggcctgactcccattaatgggggattcttnttacaanaatgcaaaatttncccccacaaaannatggcttttnccagaaccccatttcaaaat

SEQ ID NO: 4917 - DNA, 887 bp, Homo sapiens
  misc_feature 1, 3, 7, 8, 16, 589, 610, 627, 655, 687, 696, 708, 729, 746,766, 789, 794, 800, 805, 808, 810, 852, 868, 886, 887: n = A,T,C or G
ntntatnnagctcttntctttttgcaggatcccatcgattcgaattcggcacgagactggttaaatagcccttgatgacttttcatgtggcatgagagggatatgcttataaagcttaattctgatattatcctcttactacctacagtatgttttgcaaaaatcagtccacttagcaaactaatctttgtaaagcagtcagtttcagaagatactttttatcaaaaaagatggcaggtttaacattataccttttggtttttgcccaacatttgatttaatctaaagcaagaatataaaataattttaagaagcatataatttcttttgataaaaagtaacaaaaatttaatgcagatcaaagaccaaggcttgtaaccaaaacaagcaaaaagaaactttagctgtttaactatcacctctctaatttaaaatgcatgaaaattaatactttgtttttgtttttttttggaaacagtctcactctgtcacccaggctggaggtcgcagtgagctgagatcctgccactgactccaacctgggggtaacagagcgagactctgtcttcaaaaaaaaaaaaaaggtgtnatttggaaatggaaaatctanggtaaagggaagctttnaaaaatgttggtattttttttccctggnaaataaaacctttttattggaatttaaatggncctttgggnaaaaaaggaacntccaccattggaaaaaagggngggcctttttttatttntttttggggtagggggaatnaaaaaacccccttttgggccccnttttnaaatanccccnttngncccaaaatttggaaaagcccaattttttttttaaaatggaanggggtttaccctgggnaaatttgggttttaaaann

SEQ ID NO: 4918 - DNA, 851 bp, Homo sapiens
  misc_feature 3, 4, 5, 6, 7, 8, 11, 12, 13, 33, 234, 345, 558, 659, 660,667, 691, 717, 720, 761, 762, 778, 787, 789, 802, 816, 824,835: n = A,T,C or G
ggnnnnnncgnnnatttagaccagctcttgttnttttgcaggatcccatcgattcgaattcggcacgaggagtatttgctggtgcattggagagtttcacgtaattcttgtgcagattcagcaagagagtttgccggcatgctttgcacagcccctggtacccagtaaggcgattattagcattggtgcttgctggaatcagatattccagaatattctgtcacagctcatcgntgccctcttcttttctgtgggtaaactgaggcagaaactcaggctgggtggaactctgcagcctcagctggagacctcgtctggccaaggactgtggggacacaggccctntaggctgccacctcatggtcccagcatgagggcaccagaactgcacagaaagtctcactacccaagtgtctgagccaggccagactgtgctagccagacctgcccggggttcattcactgacctttattgagcacctactgtatgcccagccccaaacctggctctgctcatggaaaagaacttcagtggaaacaggtcctgggatgaacaanggcctggcctggcctggtgatgccactatttctttaaagagggagagtggacaattcccggatttattgtcaggggggaggtcttcattttcttgctggtnntaaccanaaatacccacaagacttggggtcntttttagaaaacccattagaaaactnganttttcgtaccttgtttctagaagggttggggaaagtccccnngaatcaagggtggccnagccagggntntgggttgtcctgngaggggcccactanatttgggnttccaaagaanggggccccctcctttt

SEQ ID NO: 4919 - DNA, 836 bp, Homo sapiens
  misc_feature 4, 6, 68, 115, 124, 134, 143, 166, 176, 178, 252, 257, 272,282, 295, 299, 324, 332, 334, 339, 350, 354, 359, 383, 385,401, 403, 410, 439, 440, 456, 467, 469, 492, 513, 532, 535,553, 573, 597, 634, 694, 711, 712, 716, 719, 723, 742: n = A,T,C or G
  misc_feature 744, 767, 771, 773, 782, 800, 801, 821, 836: n = A,T,C or G
tatncnagctctcgttcttttgcaggatcccatcgattcgtcttgactgaggttcccatctttcttanttctcttaaggatgtgctattctattctagatgcataggagggaagntaatccagncttagatcancagggctgngttctttctcagaaccatacccnaaaaagcctnantagaattttaggaaagttctatttagaaagaaactaagaattatgattaagttttggcctaagcaacttaatangcagnggtatcatttattgngaagcaaatnacataagaagcangttntggggcttgggaggaggtaagggcngaaagttngntattnttttttaaacntgtntaatntgagacacctgctagatatcctantnaaatgtcatagacacntnaatggtncacaactttgaaactcagagagaggtcanngctggatataaacagntgggagtcaancntattttatattatttaaatccanaagactggatacggcaagttnggagggagtttcaatgganaancaaaatttttgactctgnggcacttaaacatttaaagntctgataaataggagagggcccancaaagggaaatttgaaagaaccaatcatttacggtanggaggaaaaaacttagaagggggataaatatcttcaaaaaatcaaaaaaattaattggcntttttcaaagaaaaatnnaggnggnttanccccctgtggtttaaaggngnggttaaagtattcaccttggaanaaananggttcaaangggcaaagaaggcccaanngggggccctttttttaaagnaaacttttttccccn

SEQ ID NO: 4920 - DNA, 852 bp, Homo sapiens
  misc_feature 1, 2, 3, 5, 9, 10, 12, 23, 66, 80, 85, 91, 119, 125, 136,150, 157, 183, 200, 205, 221, 232, 234, 238, 243, 247, 274,292, 312, 316, 335, 346, 352, 371, 375, 390, 392, 399, 409,421, 445, 458, 461, 483, 487, 488, 497, 502, 506, 520: n = A,T,C or G
  misc_feature 530, 538, 542, 551, 552, 553, 556, 579, 585, 591, 598, 609,620, 631, 650, 653, 654, 671, 680, 692, 708, 716, 728, 737,741, 745, 748, 749, 755, 781, 802, 805, 807, 811, 814, 817,846, 850, 851: n = A,T,C or G
nnntntttnnantacacgctctngttctttttgcaggatcccatcgattcgaattcggcacgagcnaagctgttttatanattanggagangagtgaggagagaggaataggatagacnaaggtngagatagggancactggagaagaanacctcanagtgaggcacaggaagaggtgtgaangggaaaagaagtggcanatgtnacggaagagcccctgnccatgagaganantggngggantggnaaggaagggaagttatggggcatgggncacatagcacacaacacnacagtaaggctagagatatnaaanaaacaatgattctgagctncataagtagcnatctcncgcttaatagacatagggngtanctgtgacatggcgtnanctacagnactggacatnatcacccttttntagggaaggagggatgcctgcagnggcctaactccancangttatcatgtgctatggaagtnctgnncacaatggnggccnccantcatgtgtccaacnttaaataagnctgtcgtngctnaggacctannntgnaatcttaatttcattttaaaatntaaatnttccgnaatggangctcaaggctngcttctttttnggaaagtgtcngaactgaattgaaaccggnttnnaaaaaaaggattagtancccctggtntttccccttgtncgggggcattaaagtncttttaanccctgggacccntccccggtngggncccnttnnaaaacncccaaaatcccattggcccccattgnattttttaaaaacaatttttnaangntagnaanttntttgaaaaaaaattgggaatttggggggncccnnt

SEQ ID NO: 4921 - DNA, 897 bp, Homo sapiens
  misc_feature 3, 4, 5, 6, 7, 8, 9, 10, 12, 13, 14, 16, 44, 50, 54, 55,88, 116, 123, 126, 223, 227, 247, 261, 278, 291, 292, 300,308, 313, 400, 402, 407, 422, 426, 428, 429, 432, 436, 437,453, 463, 477, 483, 493, 506, 520, 527, 534, 535, 555: n = A,T,C or G
  misc_feature 570, 576, 587, 589, 595, 596, 597, 600, 602, 610, 611, 613,617, 624, 630, 634, 638, 640, 644, 646, 657, 658, 661, 662,665, 666, 668, 671, 678, 679, 681, 685, 686, 699, 700, 705,716, 727, 739, 740, 744, 749, 751, 753, 761, 768, 769: n = A,T,C or G
  misc_feature 770, 775, 782, 785, 786, 788, 789, 790, 792, 793, 811, 812,813, 814, 820, 821, 823, 827, 828, 830, 831, 832, 833, 834,835, 837, 839, 840, 841, 842, 846, 850, 853, 856, 863, 864,872, 873, 875, 879, 885, 888, 897: n = A,T,C or G
cgnnnnnnnntnnnanggctttgccactaactgaaaccctttgnacccancganncgaattcggcacgaggttgaaggtatgtgtcanttttaaccaggtgttgagttatttgatntttcctncanagattatttaatagtttcaataatatctaatgatgtgtgggaaaccgtaaaatttttcatacaaactgggacaaatgaacatgcatactattaaaanactncctacaatacggcataaaangggctttcttaggngaaccaggaggtatagncagcctaatcatnngctatgantattagtnatggnaggctgtgttttatcactcatatatggaaatcttttttgaatgactactctggaaatgacgactgaatctcatactgtgtacacacntnatcanaggacacttaattgnattnannaanatanntttgaacttaccttgngttagagggncagagaggttcatnatccanaaaaattatnatgtggggctttnttcctttgggaaantgaccgntcacacnncagggcatgtgtttcttctnataccttcaccccanggggcnctttctctttnanaaaaannnggngncatgaaanntntatnattcttncccctncccnagtncnttgntnttgcttaaggnntcnnccnnantgncaaggtnnanaaanngaaaaaaagaatnntgggnaaaggcaattntcacaaacttntaaaaagccggnnatcntttgntntngggtaaanctccccnnncctanttttaanatnntnnncnnctccggggggggatattnnnnggggcnntntaanncnnnnnnanannnnaagngatnggnggngcccaannccaacganntntttntaaaanagngtaaaagcn

SEQ ID NO: 4922 - DNA, 786 bp, Homo sapiens
  misc_feature 1, 3, 4, 5, 6, 7, 15, 23, 27, 46, 54, 704, 737: n = A,T,C or G
ngnnnnnttggatancagctacnggtnaatttacttcctgcaacgncccgaatncggcacgaggttaggttggacacagaaggggcaatcaaatttctgtattcagataccttttaaaggtacactgtgccaccttgctgcctttgattgcaaatacaaagttaattttcaaaaaggaaaaacaaaacagctctttttcctaaaacacatgttgtacttcagacctaaaattctaagtcttatttgtttctcacccatgagttagatttaggtaatagtattagtagagtccttagagaatcttaagaggtcatttactccacctctttcattttaaattggggtatccaaagcctgaagaggtggcctggccaatattgaccaaggtataactaaatatgagctagcatcttcttccttcttctcgctatcccttggctttaaaagatttagtacatgaagaataatgcattagcaaaaagctcctagtttgtgtttcccctttgtgtctccctgttggctttctgagacaacctgaattttgccaacaaaatatcgcagagggatttatattaattattttttagttagatgaatattatattcttcccatccaaagtgagtgatttgctaggtttggttagggagggaaaaagcaagaataatgtgagaagaatctaaatgcgaagttgattttgtgtggnaaactggttattagttccatcaggaatttctgnttttattttttgagctattgagaagtgcatgcagatttgaaaaattagg

SEQ ID NO: 4923 - DNA, 800 bp, Homo sapiens
  misc_feature 3, 4, 5, 6, 7, 9, 10, 11, 12, 13, 14, 15, 18, 22, 23, 24,723, 730, 734, 760, 763, 769: n = A,T,C or G
ggnnnnntnnnnnnnttntatnnnagctacttgttctttttgcagggatcccatcgattcgaattcggcacgagggcagcagcagcagcagcagcagtggtggaacgaggaggtggagaattgagagcacgatgcatacacaggtgtttctgagtagtaattagatcgctgtgaaggaaaaagcacacctttgagttttcacctgtgaacactatagcgctgagagagacagtctgaaagcagaggaagacatcgatcagtaacaccaagagacaccaaagttgaaagttttgttttctttccctctgttttatttttcccccgtgtgtccctactatggtcagaaagcctgttgtgtccaccatctccaaaggaggttacctgcagggaaatgttaacgggaggctgccttccctgggcaacaaggagccacctgggcaggagaaagtgcagctgaagaggaaagtcactttactgaggggagtctccattatcattggcaccatcattggagcaggaatcttcatctctcctaagggcgtgctccaaaacacgggcagcgtgggcatgtcttttgaccatctggacggtgtgtggggtcctgtcactatttggagctttgtcttatgctgaattgggaacaactataaagaaatctggaggtcattacacatatattttgggaagtcttttggtccattaccagctttttgtaccaatctngggtggnactnctcataatacgccctgcagctactgntgngatatncctggcatttggaaccctaccatttttggaa

SEQ ID NO: 4924 - DNA, 784 bp, Homo sapiens
  misc_feature 2, 3, 4, 5, 6, 12, 14, 565, 585, 629, 635, 661, 667, 683,716, 748, 774, 784: n = A,T,C or G
tnnnnnttttanancagctcttgttctttttgcaggatcccatcgattcgaattcggcacgagcttgcttgaaatacagaatgtccagatctactgagtcagaatttacattttcaaaagcttcctacgtgactcatgcatattaaagtttgggaagcactgacttagattaccttttgagaattccagatgggtcagaaaccagacagaaatactcagtagtgagaagctatggtgtatcagaagctgttaggcatttcatggtttggtagtgagcaagacagatagttttcctgtattcagcgacttagtctagagagagacaggatggaattaagtgtttaggtgctagccaaaagtaaagattcgtagaaaacaagggttcatatcccagtcatcaaagtgataaattttccctgcttaacatttagattaaaaagtaataattaggccaggtgtggtggctcacacctgtaatcccagcacttttggaggctgaggtggacagatcacttgagctcaggaattcgagaccagcctgggcaacatggtgaaaccccatctntacaaaaaataccaaagtcnggcacggttggttgtgtgtgcctgtggttccagctacaccggangcagangcaggagaatcacttgagcctgggangcaaangttgcaatgagccaanattgggtctttggactctagccctgggcgacanggagtgaaacagtcttcaaaaaaaaaagcctntaaaactatagtgagtcgtttacgtngatccagacn

SEQ ID NO: 4925 - DNA, 790 bp, Homo sapiens
  misc_feature 1, 2, 3, 4, 5, 6, 14, 22, 618, 661, 697, 724, 727, 771: n = A,T,C or G
nnnnnnttttatancagctctngttctttttgcaggatcccatcgattcgaattcggcacgagcttggatgtatgttttaatatgtataccttataattctgcctctagccaaatgctatgtttgcaaaatgtggcatctgttagtttttattgtctgtgtcttctttgtttactataccttgggtaattttgtgttaccaaaaaaaaaaaaaaggaagtgtaatgtcagacacacaagaaaagcaaatcagtgttgtaagcttaaagtacaatttcaaaggtcattaccaacagcagggttttttttatactttaaaaacattatgctacatatcattgccattttcatattttggggttttgctactcttatacaatggaatcaatggaaatgtcatccagccactgaattgccattattatatctaaaaagtttctaagatgacagttatcactattttgttttatctccatgctgacatttgaaagaaggtctagtatccctctagccagattgcttagtttttcgttggtaatcaaacaacagttgtactaaaggaaagtaaagctaggacctaaatcagaatcatagttgcctgcatatatggtaacaaggncgtgtgcatttgctttcacagtgatgagtgagaggatgagaanaaattatttgacatttttcttgtgggtgaatagaanacacctttcttttgtctttagggttanggnggagatactaaaaaaacctgggatgtttatcctatcttaaattngggtgggagtaataaaaaa

SEQ ID NO: 4926 - DNA, 788 bp, Homo sapiens
  misc_feature 1, 5, 15, 23, 633, 711, 736, 745, 748, 757, 788: n = A,T,C or G
ntatnctggctactngttctttntgcaggatcccatcgattcgaattcggcacgaggttggttgtcaactttgcattataccacccacttgtaatatctctgccttgaagaggaaaaaccaggaacatttcctagaatccccttcccgttatgatcccaagttaggatatgccagtgagaggtgctgttttagtcccttttgcctgctgtgacaaaatgacacagactgggtagcttataaacaacagaaatttatttcccacacttctggaggctggaaagtccaagatcagggtattggtagattctgtgtctggtgagggctcattttctgattcatcgatggcaccttctcaggggtcctcacatgcggaattgataacgcagatctctgggatctcttttataagggcactaatcccattcatgagggttctgccttcataatctaaccacctatcaaaggccccatttctagtaccgttaccttaggggttaggatttcaacatgacctctggggagatacattcagcccatagcaggtactcacaatagaataagaaggcaaagcaaggaagcttttattctcaggatgtgggaaagcatcacccacttctccagtaagttgtggncgttttcaatttctcaatttcttcaccagcttccacttttgcagttgtgtcagccaatcaacgacagctttccaaaanttccgtgcaagtgcctgcttttganggcaaaggnggncataaaatnggaagcttcttcaggctccttccacaatctn

SEQ ID NO: 4927 - DNA, 889 bp, Homo sapiens
  misc_feature 3, 4, 5, 6, 7, 8, 10, 11, 13, 14, 15, 23, 39, 41, 163, 176,243, 244, 272, 278, 394, 404, 413, 418, 422, 428, 436, 442,446, 456, 458, 465, 472, 477, 478, 479, 486, 487, 490, 495,498, 507, 510, 511, 518, 537, 538, 539, 543, 544, 549: n = A,T,C or G
  misc_feature 551, 557, 572, 574, 577, 580, 591, 597, 603, 606, 622, 627,629, 639, 647, 648, 654, 656, 667, 678, 683, 688, 691, 695,701, 726, 732, 747, 748, 750, 753, 769, 776, 777, 795, 800,803, 806, 822, 825, 827, 829, 830, 831, 840, 850, 851: n = A,T,C or G
  misc_feature 854, 870, 874, 883: n = A,T,C or G
ggnnnnnnanngnnnttttaatncttgctactcgttctntntgcaggatcccatcgattcgaattcggcacgaggaggaagcatataccacagaacattggctggtcaggatatacaaggtaaaggacctggataatcgaggcttgtcaaggacataaatgtnacgtccagctctnatatgcttcgcactgagcacatcacatttaggacgttgaagattttttttttttttttaatatgcannttgtaagaacaaaactggatggcatcanaattgnctggaagttttgtcttgggccaaatgaaatgatttttataattctaaacaggttaccaaatgaaatgtcatggctttactttggtcaattaaaggggggaattttttttaaaaaantgaaatgctnacacttatntctgnaaantatatngaaaatgnataccntggngcctattgangnttttggngggtcantttcnnnttacccnnccnccaanttngaaactttnttnnttttggnccatcccaccccttttgcnnnggcnnttaantnacaaanttgctttttttcccntnaangtntgggaaaaaanactttntccttnttnctttaaccccttttcnccccngnggtttcttgnttaaaaannttcctntnttaaaaatagncaactcttttnttttnttttnaangggntaccanaaaaaaaaaaataggggggggtttntaaaanatgggattggccccnncnacngggaacccaattgggntcccttnnaataaaaccttttttttnccaanatnaangggggcctttttcgcntcnantnnngcggcttanaaaaggggcnntancccgttgtttcttttngggnaaatcgcancccttc

SEQ ID NO: 4928 - DNA, 828 bp, Homo sapiens
  misc_feature 1, 4, 5, 149, 514, 626, 629, 657, 661, 727, 728, 754, 763,785, 826, 828: n = A,T,C or G
ntgnntttttattcagctacttgttctttttgcaggatcccatcgattcgaattcggcacgagagggggcgggcccgtacgccgattccatatgggcgccggcgcggagcgccgcggggcagcgcggggtcgccatggctgagctgcancagctccgggtgcaggaggcggtggagtccatggtgaagagtctggaaagagagaacatccggaagatgcagggtctcatgttccggtgcagcgccagctgttgtgaggacagccaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggagtaaggagcttcaggtgaagcacagctggacagttgtgtgaccaagtgtgtggatgaccacatgcacctcatcccaactatgaccaanaagatgaaggaggctctcttatcaattggaaaataaaagtttttgccagtggccatcaagggcttgagggcaagaatatattttttattagggaaaaaaaaaaaaaagcctnttngaacttttagtgagttcgtattacgtanaatnccagacattgataaggatacatttgattgaggtttgggaccaaaccacaaccttggaattgccagnnggaaaaaaaatgctttttttttgtgnaaaatttgnggaatggctatttgggttttanttggtaaaccaattattaagcttgcaaataaaacaaggttnan

SEQ ID NO: 4929 - DNA, 789 bp, Homo sapiens
  misc_feature 1, 2, 3, 4, 5, 6, 11, 13, 629, 671, 688, 691, 705, 718, 732,754, 758, 783, 787: n = A,T,C or G
nnnnnntttanancagctcttgtctttttgcaggatcccatcgattcgaattcggcacgaggttactttctttctcacacaaaggaaaaaagagactatctttagggaaacactgctttaaatcatcttccttgaatattaattctctgttgcttcctccaaaaatggagaaaataatccctaccctcataggcttattataaggctcaattatgataatggtgtgaaaactttgaaaattagacttcagagaaattgagttaatctgggattatttatcaatgtcttagtaaccaaaagtttaaaatgtgttttgtctaccaactggttgcatgtacatggttaatccaaaaggctcagcttttcagcaaatggaaaaagattaacttctttatggatcacattatgagatgaaacacatttcattctagctgctgaaaaaatagcaacatgtttttgaaaccattgtgattttgtattgcagtcactaaaacatcaaatatatcatttttatgttaaagtgccctaatttgtgttgttacataaaacttggagtaccttggccaaatagaagaaattaatgtgccgcgtgtctgttttaaaagaatgaaatctgagcccagtgtgangctcatgcctgtaatcccacccctttgggaggcttgaggcanggaaaaatgcttgagtncangagttggagaccancccggccacatanggagaccttttctnttccaaaaaattaaaaaattgnccgncatggggggcccatgccgtgtaggncccnct

SEQ ID NO: 4930 - DNA, 775 bp, Homo sapiens
  misc_feature 2, 3, 4, 5, 6, 10, 18, 617, 643, 701, 725, 731, 733, 746,775: n = A,T,C or G
gnnnnnttcnaatactgntcttgttcttttgcaggacccatcgattcgaattcggcacgagaaacagtctatacatgttcagtacagatgcagccatccattttcttgtccaaatattttttatctccagttggttgaatccattgatgcagaaaccacggatacggagagctgactctgtgtgtgtgtgtgtatactcaccaattctttatttattcaacaaatatttattgaatttctactatgtgtgaagcatagttcacgatcctggggatatagtagacaagctccttgccttattgagctcacattcttatggggaagggcaggttcagggccttctcagatctttgctgggcatgcacacagccctgtgcatatgctgctttgtggattcccacaatgagctgaagcttttcaaagctcctagggacgtaccattctctggcttttccttttgagctttaggttagccttttgtttgccctaatatcacccactactcaggcaggaatgaagtcaaacaattgtcttgaaatattttcaataaatgcctctggagaaaagggtttttatttttttagccctggataagatcctggttagggtaaataaangcagccttgcaagtgggggctttccnggaagcaccagacagacaaataactacagtccatgagaatgaactttgaagggctctnaccccattctgccttattaagggntggcangntcctgggggtcancaagatgggggactggttggctttcaagn

SEQ ID NO: 4931 - DNA, 770 bp, Homo sapiens
  misc_feature 2, 3, 4, 5, 497, 571, 606, 607, 661, 664, 669, 677, 687,719, 726, 739, 744, 745, 746, 751, 758, 760, 762, 766, 767: n = A,T,C or G
tnnnnttttaatcagctcttgttctttttgcaggatcccatcgattcgaattcggcacgagggccagcggatcgctgcgagtggccttgaaggcagctgctgcaggtgaagagtaggcggcggggcagagagcggcctccgagggtcacctgaatggttgagcatggaccctgttgctacccacagctgccatctgctccagcaactgcatgagcagcgaatccaaggcctgctttgtgactgtatgttggtggtaaaaggagtctgctttaaagcgcataagaatgtcctggcagcattcagccagtattttaggtgggtattttagacttcattctcctagctgtgaattaagggtaaagctcttttagtatggaagtattcatattttgttctccttggatttcactatctttatcttttatagcacattggattttgtaggagttgttttaatttttaagtttgttaaccatttttattatttttgcttttgngtttagagtaacctgaaaagaaaagaggctcttaagtaaaatgaatttgggatgactgaaagtattttgggtgnttggctttcattttactaattctggctaatgtcanncttctacatatatttcttatcctttcaagaaaaaatgatgggggaattaaattnccngtcanaaattttnttgtgataanaaatcaggggaaaaacatatttgggggtgganttctttntttttttcttaantaaannntttanttttggntntnattnnaaa

SEQ ID NO: 4932 - DNA, 774 bp, Homo sapiens
  misc_feature 5, 594, 639, 642, 655, 667, 677, 689, 722, 738, 758, 763,774: n = A,T,C or G
taaanccgctcttgttctttttgcaggatcccatcgattcgaattcggcacgagagggaaaatatgacaaacctcaactatgggagttgtccacaatacaaaattttgaaaaaacattacatagtgataatatcatacttggttgttaggcttgttgcttccccacatcagaggcatctaatgatttatcttttgtaattgctgtgaacttttttaaataagccatttagtgtgaaattgtcatgtatcaaatggctattggaaatggactttactcaattttaattccactgtaaataaggacggagtcattcctacaaggctctcttcagagaaatagattaaaagtccaatttccaggtattattagtatagttatgccgctgggccacatcctcaacaacagctgatccctcttgtataaatatgttaactgtgcagaacagttatgttatgggacaaatataatggtcattatggtcagattggttgatgccacaccagtcaaggtagagtctgatagggcagtatcttaataaccctcccatgacttaactgttggatttgaaaggaaaacgtaggatttgctcttgnccccttcccccacaaaattttgataatttgtttaaaaagggagangcngaggaaaagactngaaccttaaatngctgctttanggtttgccagangcccatacttaacattagttcttaaaattcganggtattttactaatgnaattaatcaacagagccccnagganttttttatggn

SEQ ID NO: 4933 - DNA, 844 bp, Homo sapiens
  misc_feature 1, 2, 3, 4, 5, 6, 7, 8, 9, 10, 11, 14, 19, 684, 740, 751,764, 765, 773, 786, 800, 809: n = A,T,C or G
nnnnnnnnnnnttntatanatacagctacttgttctttttgcaggatcccatcgattcgcttgttttaaagataattgctagatttatgttttagctttccataaaatgtaataacataaaataaaatataaataaaatatgaaataaaataaaagccatggggaaaaggtagggtttgattgctaataagaaatttcttggaaaagagactagctctcttttggttttccaaagtccacattttataacatttttagtgcttggtgtttgcttgtggtattacattagataaaaatgtatcacagtgttggtttatactggatgtttaaataggattcattgaaaggggtgtgttttctttctgaggaatacttactcagcattttcttcagaaagttacttgctgctaatcctttatggaggctctaggggaacatcattttcttgccttttccagcttctacaggctgtccacatcctcagctagtggccccttttcatcctttttttttttcttgaattatgagattttttgtactttgagttctgggatacatgtgcagaacgtgcaggtttgctacataggtatacaagtgccatggtggtttgctgtacccatcaacctgtcatctacattaggtatttctcctaatgctatcccacccctagccccttaccccctnacagtccccggtgtgatgttcccctcctgtgtccatgtgtgctcattggtcaactnccacttatgantgagaacatgcannggttgggntttctggtcctgngtgaagttgctganaatgatggnttccagctttattcatgtcctgcaaaggacatgaa

SEQ ID NO: 4934 - DNA, 776 bp, Homo sapiens
  misc_feature 2, 19, 24, 41, 50, 53, 57, 61, 66, 68, 113, 731, 737, 773: n = A,T,C or G
gnccttttgaaatcccttntaacncaaacgcttggcaaacnccctttctncangcancccntgcgntncgaattcggcacgaggccaaatgccggaatttaaaacctggcttntaaaaagaatgattttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaagattttatgtttacaataaaaagaaacgtcttgtcaacacaccttacgtggataactcctataaatgggctggtggtggatttctgtctacagtgggtgaccttctgaaatttgggaatgtaatgctttatggttaccaagttgggctgtttaagaactcaaatgaaaatcttttacctggatacctcaaaccagaaacaatggttatgatgtggaccccagtccctaacacagagatgtcttgggataaagagggtaaatatgccaatggcgtggggtgttgtggaaaagaacaaacgtatggttccgtgtagaaagcaacggcattatgcttcacatactggangggcantgggtgccagtagtgtcctctggtcctcctgaaaantgg

SEQ ID NO: 4935 - DNA, 762 bp, Homo sapiens
  misc_feature 1, 10, 602, 614, 619, 633, 669, 691, 711, 742: n = A,T,C or G
ngttttaaanatacagctacttgttctttttgcaggatcccatcgattcgaattcggcacgaggaatggagttccacctgggctgttttattaactatttgcccctccgtttcttcatctgtaaaacagaaatgataaccttactattaattgtgtgaccttggacaagttacaacatctccctgggcgcgattgtcccatctgaaggtcataatagcacctgccacagaggatggtagtaaggattaaattagttaatccatgtaaattacctaggtaagtgcctgccatatagcaagtgcttggtacttttttttaaaaatcactggtatgactattgcagacacctttgccatgattggaatagctggaatccaaactcaagccttccatttccagggttctggctggtgtggggctgacagacctggatggggattcccagctctgcctctcttcagctgagcaagtcactggaacctctctgagctgcattctgttcagctgtaaaataatagtttgtactttgcaggggtgttgtaaggcaatggtctccagcctttttggcaccagggaccagttttgggggaagaaaatttttncatggacagggntgctnaaggggatgttttnaagctcccatgaggatttaatgcggccggccccggnggcttacccctgtaatcccaanacttttggaagcccaagtgngccggatccccaggtcagggaaacgagaccntcctggtaacatggggaaac

SEQ ID NO: 4936 - DNA, 762 bp, Homo sapiens
  misc_feature 1, 10, 12, 648, 676, 715: n = A,T,C or G
ngtcatttgntngatacaggctacttgttctttttgcaggatcccatcgattcgaattcggcacgaggaggagttaaattttgaagctctttgagaaaggtaccttttcttaacatgttttaaaaataaaaatacaatggcttatttaaaatgtccctatgcatggtgaaatgttaaataccaagtggatgaatggttctcaaatatattgtaatggagaattattcacatgcatctattgtttaaactaataagtaaaatagacttcctttttctgttctgttttaaatgtgcactaaaattacctgcttgtggttagcatgggctggacagtttattgatttttcagaagaatgcttggctttgggtttttggcaatagggagcctgcagcaaattatttcatttgacaaaaaagagttattttaatcctatttgaatgtatgctatctcctttaccctccccatcttatgataaaaggtctctcttttttctcttccaggtttgcagctaaaactgtgcacagtgggtcattgatgctagtcacagtggaactgaaggaaggctctacagcccacttatcataaacactgagaaaactgtgattggctctgttctgctgcgggaactgaacctgtcctgtctcangggtaacctgcttacatctggactttanaatctggcacacaacaaaagtgcctggcatcactactgntgcctttcatttataataatagcccttcctcttgcagtgggggtaga

SEQ ID NO: 4937 - DNA, 795 bp, Homo sapiens
  misc_feature 3, 4, 5, 6, 7, 8, 20, 31, 39, 67, 71, 95, 122, 143, 148,159, 169, 172, 180, 182, 185, 202, 203, 204, 206, 208, 214,215, 217, 230, 237, 239, 246, 251, 254, 256, 258, 259, 264,266, 267, 277, 283, 284, 285, 288, 294, 296, 300, 302: n = A,T,C or G
  misc_feature 303, 309, 310, 311, 312, 315, 316, 320, 326, 336, 341, 343,357, 359, 368, 369, 372, 378, 384, 385, 386, 388, 394, 399,403, 418, 422, 432, 437, 449, 454, 464, 472, 473, 475, 476,484, 485, 486, 487, 488, 496, 506, 513, 520, 521, 522: n = A,T,C or G
  misc_feature 530, 534, 543, 549, 566, 570, 572, 573, 579, 580, 589, 604,624, 635, 636, 638, 645, 651, 655, 657, 658, 664, 669, 671,678, 679, 687, 689, 693, 706, 707, 710, 712, 722, 723, 728,742, 758, 763, 766, 768, 780, 794: n = A,T,C or G
ggnnnnnngtctttcaaatnctaggctactngttctttntgcaggatcccatcgattcgctcaagtnccancacaccggcgccgtcctggactgngccttctacgatccaacgcatgcctgnagtggaggactagatcatcanttganaatgcttgatntgaacactgntcnagaaaatntngtngggacacatgatgcccnnntnanatgtgnngnatactgtccaaanctgaatntnatggtcnctggnatntngnntcagncnnataaactgcnggatcnnncancttctngnaatncnnggaccnnnnctnngccngaatangtgtataccntctcnangtcttggagaccgncnggttgtggnnacngcaagnctgccnnngnttactnccatnttangccaacatgggtatnccantcttgttggngatanaccatcctgccntaccngacttgatgngttcgagnntnngcaaactnnnnnggcttggnattaagctgnttagaangccaagnnnattctganaatntggacctgngccttngggccataaaaaagcgnatgncnntttctnnggccaaacnatgataacctgattnccatcgatttcacccttganaatggcttcanntntaaactnaatacncaantnnttatcntcaangnggaccgnnaacgcttngngaanctttttggggggnncantnttgcaaaacnngaaangtgcccatttaaanccaaactcgcaattgngcaanttnanttcaattgcctngaataattggagang

SEQ ID NO: 4938 - DNA, 750 bp, Homo sapiens
  misc_feature 1, 6, 11, 13, 14, 579, 592: n = A,T,C or G
natggnttttnannatacagctcttgttctttttgcaggatcccatcgattcgaattcggcacgagacagagcgagcactccagttcaaaaaaataaataaaaattaaaaaataaaataaaataaaaaatttactaggcatccagcattcattaaggagaataattcagttaaggaggaaaagaattctgggattctgggaatttccttaaccaataaagagtatgtgtgagaaacctactgctaacatcatacttaatggtaaaagtccaaagatcagcaaaaagaggatacctggtctaaacacttccactaagcattatactggaagttctagctagtgcaataaatgaaagaatacaaagtatccagattggaaaggaagtaaaatcatctttattaacagattatatgattgtctatataaaaaaaatctgaaggtatctacaacactattagaactaaatgagcttagtgagactgcaaaataaagatcaatatatataaagcagatgattttgcatgactagccatgaacaatctgaaccttaaaaccttaaatgccatttatacaccatanacaatatgaaatncatagtgatgcatctggcaaaagaagtgcaagatgtatagtataaaaattaaaacactttgggagaactttaaaaagcctaaatgagattactatgtcagagactccagactcataccataatatgcaatcttccacctgcctaagatcagtgaatcc

SEQ ID NO: 4939 - DNA, 758 bp, Homo sapiens
  misc_feature 2, 3, 4, 5, 6, 7, 8, 9, 11, 15, 18, 544, 590, 606, 609, 611,612, 613, 616, 617, 619, 620, 621, 622, 623, 624, 626, 627,628, 629, 630, 631, 632, 633, 635, 637, 638, 639, 650, 657,666, 673, 680, 683, 687, 692, 701, 725, 742, 748: n = A,T,C or G
  misc_feature 758: n = A,T,C or G
gnnnnnnnngntttnttncagctacaggctacttgttctttttgcaggatcccatcgattcgaattcggcacgagaggacattctcctacatagccgtatattctcattatacccagcaaatattcaatcatattatctaaggtacactccacattcagaaaaaaaaatgccctttaccatagtttttgttttgcttttggttttgatcaaagattacaggtgtgagccaccgcaactggcccactgtgttacgatttgaaataaaaaggaacctgtcaagtacccagagaatatcagaactgctgtccgatctcctgaaattgaaattaatttcctcagtgactcaatacccactgccactcactcaagccctgcaagttcaagccaaatcatcctgccaccacaggaatctgatgggtcacgctgctgcctactgaaaatggggatttgggttagtgataaaataggttaaaacacataaaataggtaaactagggtaaaatacagtaagaatgggtgagaggagagaaaaagaaacttcantttaggaagcataatactacttaaaatttcctgagaataaatttgncttctagacaacacanagnannntanncnnnnnncnnnnnnnnantnnnaaaaaagcctntaaactntaggagtcntttacgnaatcccnacntgtnagatncttgatganttggacaacccacttgaatgcagngaaaaaatgctttttgngaaatnggagctttgn

SEQ ID NO: 4940 - DNA, 771 bp, Homo sapiens
  misc_feature 2, 3, 4, 5, 10, 13, 431, 466, 469, 479, 481, 519, 534, 541,544, 553, 565, 578, 583, 584, 602, 614, 634, 635, 649, 656,670, 671, 683, 706, 722, 728, 741, 742, 743, 751, 757, 763: n = A,T,C or G
gnnnnttttnaanatacaggctacttgttctttttgcagggatcccatcgattcgaattcggcacgagacgggagctagtgacggcatttctacgatcctgaagatcctcgtctccgggggcggcaagtcacggacaggtgtgatgatccccatcccacaatatcccctctattcagctgtcatctctgagctcgacgccatccaggtgaattactacctggacgaggagaactgctgggcgctgaatgtgaatgagctccggcgggcggtgcaggaggccaaagaccactgtgatcctaaggtgctctgcataatcaaccctgggaaccccacaggccaggtacaaagcagaaagtgcatagaagatgtgatccactttgcctgggaagagaactctttctcctggctgatgaggtgtaccaggacaacntgtactctccagattgcagattccactccttcaanaangtgctgtacnanatggggcccgagtacttcatcaacgtggagctcgcctnctttcacttcacctncaaaggnctncatgggccnatgtggttacanacgaggcttcatngaggnnaatcaacctgcccctganatcaagggccanttggtgaaactgctttcggnnctccttgtgccccncaatatntggtcaaggccgcnntggacatttttngtgaacccccttggccatgcctnaacttcaaaacaattnaaatgnttttttttttggnnncaaattanaacctnacttanttttgcca

SEQ ID NO: 4941 - DNA, 757 bp, Homo sapiens
  misc_feature 2, 7, 8, 10, 12, 522, 561, 566, 656, 685, 714, 718, 719,725, 751, 757: n = A,T,C or G
gnttaanncntnatacagctacttgttctttttgcaggatcccatcgattcgaattcggcacgaggctgctgggcctggaagtccaggtggggccactcgctaattctcatgtgttgctccggcccctccagctgcaggtgggtgtggagtttgaggccagcacaaggatgcaggacaccagcgtctccttcgggtaccagctggacctgcccaaggccaacctcctcttcaaaggtaaaggtctcggttcccctacgcgggaaacaggcaggaggtgactcaactctgagtggatgtgtgggccaccacaggtgctggaggacagtgtgctgccaccctgtgggcctccacattaccggggaacacttgttaaaaggtaggtggggccgggtgcggtggctcacgcctgtaatcccagcactttgggaggccaaggcgggccgaggtaaggagattgagaccatcctggctaacacggtgaaactccgtctctactaaaaatacaaaaacaaaattagccnggtgtggttgccggtgcctatagtccaactactgagctnaagcnggaaaatggtatgaacccaggaagcggacttgcggtgaacccagatcgtgccaccgacttcaacctgggcgacagacaagaattcatttnaaaaaaaaaaaaagtagtggacaaccctntactatgtttatcttgggaaaaaaaagtnggtnnaacggncaagccttgtgaataaccctgtaatnccaacn

SEQ ID NO: 4942 - DNA, 762 bp, Homo sapiens
  misc_feature 2, 7, 9, 15, 16, 389, 396, 471, 547, 551, 565, 580, 588,597, 603, 616, 621, 624, 643, 653, 676, 679, 710, 713, 727,739, 758: n = A,T,C or G
gntttanancagctnntagctacttgttctttttgcaggatccctcgattcgcaaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggtgttggatgtcaatgatgatttttctgaggaagtaaccaaacaagaagacctcatgagagaggtaaacacctttgtaaagaatctgtaaccaataccatgatgttcaggctgtgatctgggctccctgactttctgaagctagaaaaatgtngtgtctnccaaccacctttccatccccagcccctctcatccctggagcactctgccgctcaagagctggtttgttaattatngttagactttgccattggtttcttttgtcctgaagcattttgaaaataaagttacttaagttaaaaaaaaccaaanaaanactcgagcctctanaactatagtgagtcnattacgtngatccaganttgatnagaaacattggtnagttnggnaaccacaacttgaatgccncggaaaaaangccttatttggtaaaattgtgangcnattggtttattcgtaacctttttaaccggcnttnacaagttaaccacnaccattgctttnattttatggtttagggtcncggg

SEQ ID NO: 4943 - DNA, 818 bp, Homo sapiens
  misc_feature 3, 4, 5, 6, 7, 10, 12, 15, 29, 30, 35, 467, 505, 527, 574,586, 619, 631, 642, 700, 719, 744, 757, 789, 813, 817: n = A,T,C or G
tgnnnnnttnanaancagctcttgttttnnagcangatccctcgattcgaattcggcacgagcagccttggtgacagagcgagaccctgtctctaaaaaataaataaataaaatattgtgagtctctgatggggagcagtattgcatggtggttgagaactgaggctctgatgttagaactggattctgacttaacccactgtttgcccacatcttgagccttggtttccctatctgtaaaatggcagtattctcgggctggctgaggaaaggaaatgaggccaggcgcggtggctcaggcctgtaatcccagcactttggcaggctgaggcaggtggatgatttgaggccaggagtttgagatcagcctgaccaacatggcaaacccccgcgtccactaaaaatagaaaaaaatagctgggcatggtggtgcacccctgtagtctcagctacttgggagacagaancaggagaattggttgaacttggaaggtggaggttgcantgagctgagatcgcaccactgnactccatcctgggcgacagagcaagactgtctcaaaataaataaatnaataaataaatnaagttcaaaaaaaaaaaaaaaaactcgagcctntaaaactattantgagtcgtatnacgtagatcccagacatgataaaaataccatttgatgaagtttgggaccaaacccccnccttggaattgccggtggnaaaaaaaatgccttttttttggggnaaaatttggggangccttttgcttttaattttgtaaacccatttnttaaagcttgccaataaaaccaanattna

SEQ ID NO: 4944 - DNA, 821 bp, Homo sapiens
  misc_feature 3, 4, 6, 14, 800, 813: n = A,T,C or G
aanncnggctactngttctttttgcaggacccatcgattcgaattcggcacgagatccaactgtggcttctcccaggaccattacacttgtatctaaatacctacttgacatcttcttttggatactgaataaagatcttgaacaaacaaataaaaacagtaggttgttgatgcatgttactttgcccaatagatatattctatcagaatgtgatttgtatatataatatgtttacatattaaattttgattcaattaaaattctccacaggggagattctgtggtaagttctttcgtaaatgaagtaattattctagtgatttaagttcatgttacttgtactttatgctttattattgatgtgttattatgcagtatgcttatttgtgttttattcttatgttatttactcttgtttctgattgatctttcatgaagctcctaatactctgtccatagaagcacagctataatgatatttacatatgtaaggaagactacaaatatttcttcttttgattcatttttggtgattatctccttggcagacataaaagactgatgtggtttggctgtgtccccacccaaatcttgaattgtagctcctctaattctcacgtgtcatgggagggacccagtgggaggtaactgaatcatgggggcaggtctttcccatgctgttctcctgatagtgaataagtctcacgagatatgatggtttaggaatggggagttcccctgggcatgctctctctcttgcctgccacctgtagacgtgactttgctcttccttcgtttntgccaagattggngaggcctc

SEQ ID NO: 4945 - DNA, 818 bp, Homo sapiens; identical to SEQ ID NO: 4943
  misc_feature 3, 4, 5, 6, 7, 10, 12, 15, 29, 30, 35, 467, 505, 527, 574,586, 619, 631, 642, 700, 719, 744, 757, 789, 813, 817: n = A,T,C or G

SEQ ID NO: 4946 - DNA, 845 bp, Homo sapiens
  misc_feature 2, 3, 4, 5, 6, 7, 8, 9, 10, 14, 738, 782, 841, 842, 845: n = A,T,C or G
gnnnnnnnnntttntatagatacagctacttgttctttttgcagggatccctcgattcgaattcggcacgaggatacatccaaatattattcatgttatagtaaatcagatgaagccttgagcttctcagcagccacgtaaggcttaaatatgagggaacaggggctcttagaagtgaagtgacttctgaaagatgcacagagaattaggaaagagtctgaattcaaccctggaaccctgactttcaggtgagtgcctggcccactaaagaatgacaaagccatggggagtggcatggaaagcatgagctttggagttagacaggcctgggtgtgaatcctggtcaccccagttctgttaaagacctcagaaaagttacctagcttcattaagcctgtttcttcagccaaaaattaatggtgttaacgcttacctctcaggatgggggtcacaaataaatagaacgacataaagtacataatacatcaatcagttaggatgtatttggctacaggcaaaagaacagccctcctcaactggcttaaccaacaattaacctattatcttacataaaagggagtctagaagtagggatgttccaggtttggctaatccagcagctcaaccatgtcaacacagaccgggttttctctgtcttgcctttttgccattctcagtgctttcatgggctccctttatgcttgcaatatgccagctgcagcttcagacatcaacttntcacatacctatgtccagagcagaagaaggacatttctccttgngcatttctactggagactaaattttcctgcctggcaaaaaaaaaaaaaaaaaaactcgnnccn

SEQ ID NO: 4947 - DNA, 830 bp, Homo sapiens
  misc_feature 812: n = A,T,C or G
actacagctacttgttctttttgcaggacccatcgattcgccacactgctgttctcatgatactgagttctcacaagtcctgtttgttttataaggggcttttcccccttttgctcaacacttcttcctgccatcatgtgaagaaggacgtgtttgtttccccttctgccacgattgtaagtttcctgaggccttcccagctatgtggaactgtgagttaattaaacctctttcctttataaattacccagtcatgggcagtcctttacagcagcatgagaatggactaatacactcctcaaatgttttgaagattgttgcaccttggaactaccagtgtgcacacaatctggctcaatgtatatattggcccagcaaggcaaagaactgaagttccaggatggaagaacctgtgttctcctcataatagtatagaataattcaagataggcaagaaggacagcagtaaatgaagaccatggaagaaaagaaggaatgccaaagatcgaggaaatctaccaagactagtagggtagtccagaagaagctgtttcagggcctgttgccagctatgcctttgagaacctcgggatcccaaagaatgaggggaatttcttcagaaagacaatctcggcatgcattatttctttggtttgaagattcactcatgttgcatgcatctgtagcttgtgccttttttattgcctagtagtattctggcatatgcctatcttacaatttgattatctattcacctgttggatgaatgtttgaattttttccatttgaggaatttatgaataaagctgctnttagcatgaaaaaaaaaa

SEQ ID NO: 4948 - DNA, 844 bp, Homo sapiens
  misc_feature 1, 2, 3, 4, 5, 6, 7, 8, 9, 10, 13, 15, 18, 692, 746, 751,778, 816, 820: n = A,T,C or G
nnnnnnnnnnttntnaanatacagctacttgttctttttgcaggatcccatcgattcggagaatcatgactgctggctgaagcctgcatctttgggtaaacagggcaattaattcccagagaacaaggacatcatggatagttaaggcaaccagataggtgcttatcctctaggtctccatccaaaatggagtaatgacacctactttcgtgttttaagatttaaacgcagtaacatatgtaaagtgcagagtctgatgttcgagtccacaacgatgtaaataatgcaaaaccagtggattactcatgcttaatttatattttacttggaaatttatttcctttttcttggttatctctctaaataaggtaacttttttatacattttctttttatatgtatttattcttttttttttgtgacggggtctcactctgtcaccaaggctgaaatgcagtggtgcgatctcagctcactgcaacctccactttccaggctcaagtaattctccagctactcaggaggctgaggcaggagaatcgcttgaactcgggagatggaggttgcactccgtctggatcatgccactgcactccagcctgggtgacaaagcaagactgtcttaaagaaacaaaacaaaactacaaaccaatttgttttaaagcatgttttttctctggtaaagaaccttncagtgagtaacacaggacataaatttactatggtaattaagtcgtttttatcanatggnattattaagttggttttatcaagtggnattaaaggattcatttgtttacagtattattcaacacnaatnggaggataattacaattccttatt

SEQ ID NO: 4949 - DNA, 881 bp, Homo sapiens
  misc_feature 2, 5, 9, 10, 11, 26, 577, 611, 628, 655, 676, 678, 689, 708,713, 715, 739, 748, 752, 757, 759, 760, 765, 770, 773, 778,779, 784, 799, 803, 809, 815, 816, 819, 820, 825, 827, 828,830, 834, 837, 843, 859, 862, 868, 879, 880: n = A,T,C or G
gnagngtcnnntttctaatgctgganactcgttctttttgcaggacccatcgattcgaattcggcacgagggtacacgaagaggtgataatgacagccaccaaggagatttggagcccattttagaggcatctgttctatcttcccatcataaaaaaagctctgaggaacatgaatacagtgatgaagctcctcaggaagatgagggctttatgggcatgtcccctctcttacaagcccatcatgctatggaaaaaatggaagaatttgtttgtaaggtatgggaaggtcggtggcgagtgatccctcatgatgtactaccagactggctcaaggataatgacttcctcttgcatggacaccggcctcctatgccttctttccgggcctgttttaagagcattttcagaatacacacagaaacaggcaacatttggacacatctcttaggttgtgtattcttcctgtgcctggggatcttttatatgtttcgcccaaatatctcctttgtggcccctctgcaagagaaggtggtctttggattatttttcttaggagccattctctgcctttctttntcatggctcttccacacagtctactgccactcanagggggtctctcggctntttctctaagtaagtatctgtaaagtncatatttttggccaatgattnanaggttagtgcnttaggggaaaaaacattcncccanantttggcatgaattctttaataatnattctaatncccnccttnannttttnaaaanaanttttnnacacnaaaccccagatttgncttntttaancatttnnttnnatttncnnanaganccnccaagntataaattcggggaanacnaaaatnggttcaatttnnt

SEQ ID NO: 4950 - DNA, 831 bp, Homo sapiens
  misc_feature 4, 5, 657, 722, 775, 780, 782, 792, 793, 806, 816, 831: n = A,T,C or G
tttnnatacagctcttgttctttttgcagggatcccatcgattcgaaaaggtgaatgcagaggcctggcccagaccccagccctgtgtgtcaatacaacttttcacgttgttacatacacattttccagtctgtgtctccctctgaaagaaaccctgaaattcaggttgctaatagattgttggttgcaagtatgaaggacagaggaggtaagagaggaggcaacttgctaatgcaaaagcagtgtactgaaagtcacttttatttcttatttataatctacatgcacactctggataatagatgacactgctcattcagtactttaacttcaaagcagagagaagccatggatgacagagccgggagcgggaatacaaaggtactaacaacaagaggaaaaatgcctgtttacgggattgcatttgttagcacgctctcttcagatattgttcccccaggaatagcgaaaatatgtgcagcgcgaacaatgatttaacatctgaaaatggtacttaaagagtttctgtctggtagtaatgtgatggaggcttctgaagggaacctggggacttcatttcttctatttatctatatgtctctctggttttagtgagcggtaattgcatatttaacccctcaaatagctttaaccctnacgatgccactttttaccctgtataaaatgtacttttatcccagcaaaggcagactcagaaattnccttacccaaaaaattatttaaaaaaaaaaaaaaaaaacttcgagccttttanaactntngtgagtccgnnttacgtagatccngaccttgatnaggatccattgatgn

SEQ ID NO: 4951 - DNA, 848 bp, Homo sapiens
  misc_feature 2, 3, 4, 5, 6, 7, 8, 9, 10, 14, 15, 28, 734, 749, 767, 776,778, 848: n = A,T,C or G
gnnnnnnnnntttnnaactttgctaatncttggctactcgttctttttgcaggacccatcgattcgaattcggcacgaggcctctgtcctgaactttttaacccggtgccacaacccgagggtctccataggggcaggtaaacggggattttaatcattttaagtgtcttagaatgatattttgggaaaaagcactccttttcctaaggactgcgactcggtgaacagaaaggaggctatgcggtgtggccagccaactcaaggaggacgaagcaacctttgcctctaaactgcctggaaccaaatgtcgatttttctgacccctcccagggagtgctgagtagtgatggtgtctggagggtcaaatccattcccaatggcaaaggttcctcaccactccccaccgctacaactccaaaaccactcatcccagtgtttggggcactgtgttcctcttcgtccctgcaccagaccctggaagccttggccagagacctcaccagactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaaaaagcctctagaactatagtgagtccgtattacgtagatcagacatgatnagatacattgatgantttggacaaaccccactnggaatgcantngaaaaaaatgctttatttgtgaaatttgtgatgctattgctttattgtaaccattattaagctgcaatan

SEQ ID NO: 4952 - DNA, 849 bp, Homo sapiens
  misc_feature 2, 3, 4, 5, 6, 7, 8, 9, 10, 14, 21, 27, 37, 87, 727, 792,793, 794, 795, 796, 797, 798, 799, 800, 801, 802, 803, 805,806, 818, 834, 841: n = A,T,C or G
gnnnnnnnnntttnaaccttnctaatnctggctactngttctttttgcaggatccctcgattcgaattcggcacgagagaaaccagnatcacacaggaatgactgggattttaggcctggaatgtacctttaaaattatcttattacacaccatccttcatttttctcattttcctcttttgggattcatatattaagtattagggcattaaaacacaactgtatatataaagaaaaatataaagtaaccacacatgctcagggaaagacacaggctcagaaaatgcctgagaagaacttagtttcacaccccaggctgatcctaagcaccgagacagcctacaacaatccaaaaaacaaaaacaataaataaaaagtaacaaacaacagcaaacctaagagaatgacgaaaatataatttccagaattaccactttattagagtcaaatgtccagtttttaataaaactcagaagcatacaaagaaacaggaaattatggcccatcaaaggatcaaaggaaaaaaaaatgaatggaaactgtactgaaaaagacatgatggcagatatactagaaaaatactttaaaatactgtcttaatgatgctttaaaaactagaggaagatgtggaggaagtcaagaaaatgatgtacaaacaaaacagcaatatcaataaggaggtagaaaactttaaaaggaaacaaaaaaattctagagtggaaaagtncaatactgaaataaaatattactagtaggattgaagtcatgtttggaataggcaaaaaaaaaaannnnnnnnnnnntnnaaaaaaaaactnggccttttaaactttnggggtcngtttacct

SEQ ID NO: 4953 - DNA, 835 bp, Homo sapiens
  misc_feature 3, 4, 7, 577, 622, 638, 693, 697, 699, 700, 702, 703, 705,709, 712, 714, 716, 718, 720, 721, 722, 724, 726, 728, 729,730, 732, 733, 735, 736, 737, 738, 739, 740, 741, 744, 746,747, 748, 749, 750, 751, 752, 754, 756, 758, 759, 760: n = A,T,C or G
  misc_feature 761, 762, 763, 764, 766, 767, 770, 773, 778, 786, 790, 792,799, 802, 810, 812, 822, 833: n = A,T,C or G
tannccngctcttgttctttttgcaggatcccatcgattcggtttggcagtctctgaaaatatatacctgccatatgatccagccagttcactgctacctagtttcccaaaagaaatgaaaatatatgtatatgtgaatactcatatactaatattcatagcagctttgtttgtaatggacaaaacaacccaaatgtccatcaacgttggaatggaaacaacccaaatgtcaatcaacaagtgaataaacaaaatgtgctatacgtatataatggaatactactcagcaataaaaaggaatgaaaggaatgaactaatgatgcatgcaacagcatggatacatctcaaaataattatgctgaatgaaagaagccagacagcaaaaatttcctactgagtgattccatttatataaaaatctagagaatgccaattagcctttagtgaaataaagcagaacagtaattgcctgtgacagggtgggaaagatttggactggaagcagggattaccaagaggggtgagaaaacttttgaaggtgatgaatatgtacattgtcttcattgctttggatggnttttccagggtgtatattgtaatttcaaaaaatgatcaaaatttntacacttttaaaatantggttcaagttttattttttatattgaaataaaaggctggattaaaaatggcccnaaanannannanactnttnantntntnnncncntnnntnncnnnnnnntcntnnnnnnntntntnnnnnnncnnccngcnccttnttaaaaantttngnggggggncgntttttccntngaaccccccnctttgttttanct

SEQ ID NO: 4954 - DNA, 772 bp, Homo sapiens
  misc_feature 6, 7, 9, 10, 19, 26, 54, 70, 75, 77, 82, 85, 90, 101, 115,222, 229, 234, 251, 254, 280, 284, 295, 310, 344, 375, 463,469, 472, 475, 477, 482, 581, 594, 601, 641, 648, 678, 703,722, 740, 741, 769: n = A,T,C or G
acattnngnncgcctttcngtttgancccatcgaccgaattcggcacgaggctngatcgtctgggcctgngtttnanctggnatnggatnctcaatccttnttgttcaaattttnaagtccagaaagctctgaaaactgaaagttttttcataatttatttcactgtaaaacctgaattgaactgatatttatctcactaaaaatgagtattcatatattgnactgtangaatngtaaaattaccaagtantancccagacctagttagataaatgcacnattngcttttaattncaaaaaaatcttaantctgaggcacatttggctgacagcatttcagatnagggattttgaacctctaattcaatgatgtngataaatatcaccacttctactaccattgtctattactgaacacttaccatgggccaggtacagagaaggaattgacctaataagctnttcggnccntananagctntaaaaggcaggtccttttattgacgtcattttattgctggtcacccaagtggcaaggctgggctgatccattggtcaagttatgactgccgtgctcctnccccaaacttaangcagaantctcagtgcagatgatcctggacttaccaagggggttatnctaaatngaataagaactgggcctaaaattgggaaanattggtaaggccttttaataccatnttaaccatcttagctttgncttaacctacccttaaanngtgcctcaaggacacttacatttaccgnacc

SEQ ID NO: 4955 - DNA, 790 bp, Homo sapiens
  misc_feature 9, 10, 11, 13, 14, 230, 366, 490, 537, 558, 562, 570, 572,577, 585, 589, 619, 636, 706, 708, 755: n = A,T,C or G
ttttctttnnntnnatcagctcttgttctttttgcaggatccctcgattcgaattcggcacgaggggacctcgatcatgacaggctcatcagcctgtgcctgacccttctcacgtgaccccagacatcctgcaacctggggggacattcctttgtaaaacctgggctggaagtcaaagccgtcggttacagaggagactgacagaggaattccagaatgtaaggatcatnaaacctgaagccagcaggaaagagtcatcagaagtgtacttcttggccacacagtaccacggaaggaagggcactgtgaagcagtgaggatttcttgtgccattttcataatggtcattagctccttttaagctanaaacgtacctgagcttctgaagagttcctgggagatttgagctgattttggaaatggagcatgacaagtggggagtctctctctctctttctctctctctctttttaaccaaaaagagatgacnaaactaagttcaggggccatggaaaatgaaaaagtccgctatattgngatttgggaagaagaaagttntcangaagaaanangtgangattgaangatngagaaaaacagacttgttgggaagggtcanaaaggaattcccccgangcaagggattggtgtgcccatttgtgcctttgaccgggaccttcatcttattatactggttaaacttgtnanaccacaaaacaggggttttccaacccctgtttttagaaccccacgcnccagatttttccaattctttaaaggggggctggtt

SEQ ID NO: 4956 - DNA, 775 bp, Homo sapiens
  misc_feature 4, 5, 6, 7, 8, 12, 19, 473, 478, 510, 536, 553, 589, 619,621, 624, 641, 648, 649, 697, 723, 724, 725, 726, 727, 728,729, 730, 731, 747, 756, 764, 770: n = A,T,C or G
ggtnnnnnttgnaatcganagctacttgttctttttgcaggatcccatcgattcgaattcggcacgaggaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacnagatntttaaaaaaagaaaggaaggaaaaaaaaaacncttccttttaaagaaattccctaccngatttttaatataggtnatcttaccactttcttttctagtttcttggattttnagcttaggctgcattctaacctcatactgngnaanaccaaaggtggtttttngattcannaaattttttgaaaatctgcataagccttaaatttggtaaaaaattaangaaaaattcctttaaaaaaaaaatannnnnnnnnaaaaaaaaaaacctgnggcctttanaactttgngagtcntttcc

SEQ ID NO: 4957 - DNA, 773 bp, Homo sapiens
  misc_feature 31, 582: n = A,T,C or G
ctaatcccttgtttctaatgcttggctactngttctttctgcaggatcccatgcgattcgaattcggcacgagcccagagaagagcttttcagagaaaggtacagacaagaagctagaaagagtggaaggagcagcagtcttgcaaggaagcagggcagagacacagcccatggcccctcactgccctgctggaagggctgatggagctccccgcagcatggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggctgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctggggtcttaaggacctncctcatgtctttaaggtagcatcattgatctttggatgtggctttttggatttcttgaacaagctaatgttgtgtcaagaagcaacacttttgtgaatctcattggctttgattggatttgggcttgttcaaaaatgtttatttgaaaaacgtattcctttaataaacttaaccaaagagattttaaaatt

SEQ ID NO: 4958 - DNA, 704 bp, Homo sapiens
  misc_feature 2, 3, 4, 15, 26, 465, 487, 511, 535, 577, 594, 608, 616,625, 650, 662, 674, 678, 692, 702: n = A,T,C or G
gnnntattgcaattngatagctactngttctttttgcaggatcccatcgattcgaattcggcacgagggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcanttcttcatgctgattaaaccgnttttaaaaaacccttctttaaaantttgaagaggaaggaaccctactntccagccaaggtatgggatgatgggatcattgtccacagacncagactgtcttggtctngtttagtgcacctnaccccatngagagatgntcgttcttagatgtactggataagngttctgtgaatnctgaatacctgngtanctaaattaacttcnctagtgtcanat

SEQ ID NO: 4959 - DNA, 758 bp, Homo sapiens
  misc_feature 3, 4, 5, 6, 16, 35, 476, 487, 489, 491, 492, 503, 511, 540,562, 565, 618, 629, 663, 664, 665, 666, 667, 668, 669, 670,672, 674, 675, 676, 677, 678, 681, 682, 709, 710, 724, 726,736, 741, 749, 756, 757: n = A,T,C or G
gtnnnntttcaattgnttaggctctcggttctttntgcaggatcccatcgattcgtttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaagctcaatagcatctttaacgtgaaaatnaaaccagaacncnannaaggcctttanggatttcngggtttttgcccacggccacaggttcatntccagaggaatgcaaaactganacnatccaggaagagctaaaacatggccctgtaataaatgaccagacctttcctgnggttcaaattnttaacacacttcctttcttttgggaaaaaaaaannnnnnnnantnnnnnttnnaaaaaaaaaaacttgacctttaaactnnaggatcttttactnantccaacttgntaganccatggtnagttggnna

SEQ ID NO: 4960 - DNA, 869 bp, Homo sapiens
  misc_feature 3, 4, 5, 6, 7, 9, 10, 11, 12, 24, 111, 121, 145, 149, 153,185, 198, 247, 258, 260, 272, 274, 292, 313, 341, 359, 364,368, 392, 406, 408, 412, 413, 415, 416, 417, 418, 420, 429,449, 455, 456, 466, 477, 481, 486, 493, 502, 504, 535: n = A,T,C or G
  misc_feature 541, 542, 544, 545, 554, 556, 563, 578, 579, 601, 611, 612,614, 619, 620, 623, 624, 625, 627, 642, 647, 648, 649, 654,660, 663, 669, 670, 693, 694, 700, 709, 714, 719, 725, 728,733, 735, 742, 743, 745, 753, 759, 761, 764, 765, 767: n = A,T,C or G
  misc_feature 774, 776, 783, 788, 789, 790, 796, 801, 802, 804, 810, 812,815, 824, 827, 828, 834, 837, 840, 843, 858, 864, 868, 869: n = A,T,C or G
ggnnnnntnnnntttgaaaccttnggctacttgttctttttgcaggatcccatcgattcgaattcggcacgaggtcaacctctaccacgtgcgggaggatggctggatccnagtctccagngacaatgtggctgatctacatganaagnatantggctctaccccctgaaagagggtggatgcanctgcttgtgtatnttggggtgactgtcattggtaatacggacacagtgacccatcctccatnctatttatagngnaagggccttcantngtatcagtacttgatttnaagctctggcacattgacctntatgtgttaccagtcattaatgagctgntgcacgaggtgactattngttanactntcttagcatgttaacattacactnctcactactcatananaagnntnnnnanaacttgagncctttaaaaacttttaagtnagtcannatttccgttngattccaatancttngaatnaagaatncctttgggntnaatttttggaatcaaaacttcctacctttgnaaattnncnntgtggaaanantaaaatntgctttaaaattttnngttgaaaattcttggggggaancgattttttnngnctttnnaannngngggttaccccctttnattannntcttnaaatanttnccaaannttttaaccctcaacctttttggnnttttantttttaagnggttncatgntaaaangtnaaatntntttgtanngntttttttntccagntnccnngngttcttnanaaatttngcccnnngtgtcnacaanntnttttgntnccntaatttatnggnngttttnttnccnctnttgtcataaaatagngttaanctgnn

SEQ ID NO: 4961 - DNA, 817 bp, Homo sapiens
  misc_feature 4, 5, 6, 7, 8, 13, 14, 15, 16, 474, 499, 503, 505, 519, 523,541, 562, 566, 601, 611, 630, 646, 664, 673, 679, 686, 704,725, 733, 740, 765, 777, 791, 792, 801, 802, 805, 810, 816,817: n = A,T,C or G
ggtnnnnnttttnnnntacagctacttgttctttttgcaggatcccatcgattcgaattcggcacgaggagatgctgaaggaaattatagccagaggaaattttagactgcagaatataattggcagaaaaatgggcctagaatgtgtagatattctcagcgaactctttcgaaggggactcagacatgtcttagcaactattttagcacaactcagtgacatggacttaatcaatgtgtctaaagtgagcacaacttggaagaagatcctagaagatgataagggggcattccagttgtacagtaaagcaatacaaagagttaccgaaaacaacaataaattttcacctcatgcttcaaccagagaatatgttatgttcagaaccccactggcttctgttcagaaatcagcagcccagacttctctcaaaaaagatgctcaaaccaagttatccaatcaaggtgatcagaaanggtctacttattgtccgacaccatngaantnttttgagggttgcnaaanaccattgaaaaaagaacnaaaagccttaaaagccctgtnttcncttgtaaattcacctgcaaaaatatggattggctntttaccaacngggcaaccctggcaaaccnaaaaaggcttgtgggnatttggaattatttggtnccgaaaatngtctcntggtaanttattcattacttacttnaaagaactggtttcaaaaatnggcaagcnttccttnaaaagcccagtttgttaaaaaatanggtcccccttgncttggttccaaaannaaaaggccnnaanggaantttccnn

SEQ ID NO: 4962 - DNA, 861 bp, Homo sapiens
  misc_feature 2, 4, 5, 6, 7, 8, 9, 14, 16, 439, 472, 475, 484, 494, 499,520, 523, 535, 540, 549, 558, 560, 574, 607, 625, 648, 651,653, 661, 683, 692, 696, 710, 718, 749, 762, 765, 769, 782,807, 818, 825, 861: n = A,T,C or G
gntnnnnnnttgtntncatacaggctacttgttctttttgcaggatcccatcgattcgaattcggcacgagccggcttcctcatcaacctcattgactcccccgggcacgtcgacttctcctcggaggtgactgctgccctccgagtcaccgatggcgcattggtggtggtggactgcgtgtcaggcgtgtgcgtgcagacggagacagtgctgcggcaggccattgccgagcgtatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctncacgggtgggccttaccctgaagcaatttgccnaanatgtatgtngcccaatttngccgnccaaggggggaaagggcccanttnggggccctgccnaaacngggcccaanaaaaggttnanggaccattgaattnaaaaaaaaccttttggggggttgaacaagggtncctttttggacccccaanccccaaacggggcaaaggttttnaancnaagggttnaagcccaacccaaacccccccnaaaaggggnaaanaaaacttggccaangccaaccnttttttggccaaacttggaacccttgggaanccccatttttttnaangggngttttggatgccnaaccattgaaattttcaaggaaaanaaggaaggccngggattngggaaaaccccaaaaaatttttttccattttttttn

SEQ ID NO: 4963 - DNA, 851 bp, Homo sapiens
  misc_feature 4, 5, 6, 7, 8, 15, 16, 19, 464, 483, 491, 507, 508, 511,518, 536, 539, 542, 545, 550, 558, 566, 571, 584, 601, 606,619, 620, 621, 634, 644, 652, 656, 698, 699, 721, 726, 733,737, 739, 769, 776, 777, 779, 794, 810, 828, 829, 830: n = A,T,C or G
  misc_feature 839, 840, 844, 848, 850: n = A,T,C or G
ggtnnnnnttgtaanntanagctacttgttctttttgcaggatcccatcgattcgaattcggcacgagcctcattatccaccacgcacagatggtacagctggggctgaacaaccacatgtggaaccagagagggtcccaggcgcccgaggacaagacgcaggaggcagaatgaccgcgtgtccttgcctgaccacctggggaacacccctggacccaggcatcggccaggaccccatagagcaccccggtctgccctgtgccctgtggacagtggaagatgaggtcatctgccactttcaggacattgtccgggagcccttcatttaggacaaaacgggcgcgatgatgccctggctttcagggtggtcagaactggatacggtgtttacaattccaatctctctatttctgggtgaagggtcttggtggtgggggtattgctacggtcttttaattataatnaatatttattggatgcttnaaaaaaanaaaaaaaaaaaacttnnggnctttttnaaatttttaggggagtcngtnttnccntagantccagacnttgtttanggatnccattggttgaanttttgggaccaaacccncaacnttggaaattgccnnntggaaaaaaaaantgccttttantttggggnaaantttgggggaatgccttatttggcttttaattttggtaacccnnttttttaaagcctggcaatttnaaccnaggtttnaccnanccaaccaaattggcattttcatttttaaanggttttnnanggtttcaaggggggnaaggtttttgggaaangtttttttttaaaatttnnnggggccccnngggngccncna

SEQ ID NO: 4964 - DNA, 848 bp, Homo sapiens
  misc_feature 4, 5, 6, 7, 14, 15, 17, 68, 69, 98, 99, 100, 102, 104, 108,121, 123, 126, 128, 134, 135, 162, 180, 181, 184, 190, 200,203, 212, 217, 219, 220, 221, 224, 231, 237, 239, 249, 254,259, 260, 265, 267, 272, 274, 279, 281, 282, 290, 296: n = A,T,C or G
  misc_feature 303, 304, 317, 329, 332, 343, 359, 368, 383, 407, 408, 410,432, 451, 461, 471, 476, 478, 486, 496, 499, 504, 514, 519,521, 526, 527, 529, 532, 535, 546, 550, 555, 566, 570, 590,602, 616, 632, 642, 652, 662, 665, 676, 693, 698, 707: n = A,T,C or G
  misc_feature 711, 712, 724, 729, 743, 759, 762, 769, 777, 781, 783, 795,800, 805, 808, 810, 824, 825, 828, 834, 847, 848: n = A,T,C or G
ggtnnnnatttaanntnagctacttgttctttttgcaggatcccatcgattcgaattcggcacgaggnncctgcaagggctggtgtggaaacaagcannntngntgcntgaagcaaaagtnanacngnggtgtnnactgttgatgtgaccccacaaagtgtnggaaccgccatcaaggcnnggntagctngggcactgtngancggacccanaattncnnnggntccttcnaactgnangatcctaccnaggtnacccnnggatngngcttntntaatncnntttgtgcnaccccnaatagcnngatcctgaaaganatgtgccatgtngancaggtgctgtnaaagaagactgcttcngctccctgnccttttgacctcccngagttgaaacatgtagcaacacgnntnccatagaatacaaggctccagntgaagaaaaagaaacgggntctggtcagnaacaatcagnttccntntcttggangattcccctnttntaatnaaaagccctnatttnanttttnnangcnttnaattttttacncctncaatntttggtttgcntaanatgctttttcaaggtttganaaccctttaaangggggttttttttnaaaatggactttcttntgggattttnagggttttantttggcttanttnaaaaaaaaagntaaccaaaaaccgtttncttgnaaaaagaanggtnnaccctttaaatnggatnttgggccctttaancctttcaatgttccanggnttacctnacttttangttntntcccaaaaaaanggttnctaangtntnccttatttggactnnaanaacccnaattgaacttttnn

SEQ ID NO: 4965 - DNA, 756 bp, Homo sapiens
  misc_feature 2, 3, 4, 15, 468, 488, 502, 524, 655, 701, 721, 723, 730,755: n = A,T,C or G
gnnntttcaatcganagctcttgttctttttgcaggatcccatcgattcgaattcggcacgagtacatatttgtcataattacaataaaatacaaagagctattttggaactgggcaagctgtttctaaatgtatatggaaaaataaaaatgtctccaaaaaatccctgcagagggaaactagcccttccagatataaaatatattatagaactgtgtaattaaagcaatatggtactggtccataaaagaacataaaaccaaatagttcagtagactcaaaatgcaagcgttggtgagggtatggagaaaagggaacccttttacacttggtgtgaatgtaaattagtacagacattgtggaaaacagtttgtagagcttcctcaataaaaacacatatgatccagcaatcccactactgggtatatatccaaaggaaatgaaatcagtatgttgaagagatacttncacgttcactggaaccttgntcacattggccagnacttaaacctaaagggtccatnaaccggaagatagatagggctgaccgcggtggcccacgcctgtaatcccagcactttgggaggccaaggcaggtggatcatttgaggtcagaagtttttgaccagccttggccaacatgatgaaccccgtntttctaaatttccaaaaattagctgggcgtatggtgggcacctgtnttcccagttctcggaggctnangcagganaatgctgacccagggacggacttgnt

SEQ ID NO: 4966 - DNA, 775 bp, Homo sapiens; identical to SEQ ID NO: 4956
  misc_feature 4, 5, 6, 7, 8, 12, 19, 473, 478, 510, 536, 553, 589, 619,621, 624, 641, 648, 649, 697, 723, 724, 725, 726, 727, 728,729, 730, 731, 747, 756, 764, 770: n = A,T,C or G

SEQ ID NO: 4967 - DNA, 770 bp, Homo sapiens
  misc_feature 2, 3, 488, 514, 517, 519, 532, 533, 535, 574, 652, 681, 696,711, 728, 736, 740, 742, 751, 767: n = A,T,C or G
gnnttcaaatcgatagctacttgttctttttgcaggatcccatcgattcgaattcggcacgagggccgttgggcgagatgaagctacactgtgaggtggaggtgatcagccggcacttgcccgctttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggattccatatggctctcatatcattccattccatctctgccaagatttggataccgcaaaaatttgtgtttgtggaagattctgctgaactctttcattcaagggactacttccattgaatttggattntgtttgccccacattgggggtcttantananaatttggggtggnncntgaagcacctattaatctcttaatttctggttctcttangctggttatgttaaattcctccgatatgttaaaagtaatgggtgagaccagaaaaagaaatttcaattaccagatcantttggggtgcattgtatgattttgcaccntcaaaatggaattangggaagaattctggntcttgcttggaaaggangatgtgtntagntncccatttanatgactccaaattttntta

SEQ ID NO: 4968 - DNA, 707 bp, Homo sapiens
  misc_feature 2, 4, 5, 6, 7, 8, 14, 16, 20, 474, 477, 486, 515, 526, 537,548, 553, 587, 589, 591, 592, 593, 594, 595, 596, 597, 598,599, 600, 601, 602, 603, 604, 605, 606, 607, 608, 609, 610,611, 612, 613, 614, 615, 616, 617, 618, 619, 620, 621: n = A,T,C or G
  misc_feature 622, 623, 624, 625, 626, 627, 628, 629, 630, 631, 632, 633,634, 636, 637, 638, 639, 640, 641, 643, 644, 645, 647, 648,650, 651, 654, 655, 656, 657, 658, 659, 661, 662, 663, 664,665, 666, 667, 668, 669, 670, 671, 672, 673, 674, 675: n = A,T,C or G
  misc_feature 676, 677, 679, 680, 681, 682, 683, 684, 685, 686, 687, 688,690, 691, 692, 694, 696, 697, 698, 700, 701, 702, 703, 704: n = A,T,C or G
gntnnnnntttgtntncatncagctacttgttctttttgcaggatcccatcgattcgaattcggcacgagggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaacccaccggcgacttgcccttcactggatctgccaccctacattcggccggggcccaagganganaaccagganaaagcagtcccccaaaaagcgggccttgnaggaaaaggangtggcacggangtctgtcttanacccnttgcaaaaggacaataatatttaaagtgaaaaananannnnnnnnnnnnnnnnnnnnnnnnnnnnnnnnnnnnnnnnnnnnannnnnngnnntnnannttnnnnnntnnnnnnnnnnnnnnnnnannnnnnnnnntnnnancnnntnnnnntta

SEQ ID NO: 4969 - DNA, 673 bp, Homo sapiens
  misc_feature 2, 4, 5, 6, 7, 8, 9, 474, 477, 484, 496, 501, 503, 504, 507,510, 519, 522, 526, 528, 531, 544, 545, 551, 556, 582, 623,663, 667: n = A,T,C or G
gntnnnnnnttttatatatacaggctacttgttctttttgcaggatcccatcgattcgtgcttgttcgtttctgtgtacttgcttagtggactgtagcaacacactcagcttctccagtgtcaacccacattggctttcccactctacagtttctgtaggatgcatgttttcaccattatcaggcttctgcagtgctcagagggcagcaatacccagcaaccagtgacccgaggccagcaacttcttttacttccccctcagttggatttgtaacagagtatctttggtgggacacttctgtgtgaagagattttactagcaccctaaagaatggatttctggcaagttccacaaggtagacttccagtaagttctgctggtgcagcactacagcaacttccgtgctattcagtgagaggactgtgttctctccaacaaggtctggatctcagccctgggatggtttaaggtcngangaagctnttgctttggggntctgngnnaanctnagggacttnggnactntnaanagtctcttattcnnatagtnaatanctgttctcacccatgttaatagtagngacctttataagttcatttcaatactggggttcttcgatgnttcttcttattagacgtgaaatgtgatgtgattgtatagnatgntacata

SEQ ID NO: 4970 - DNA, 753 bp, Homo sapiens
  misc_feature 2, 4, 6, 7, 8, 17, 18, 473, 491, 494, 503, 505, 507, 515,516, 525, 527, 549, 551, 560, 581, 615, 648, 666, 691, 696,713, 745, 747: n = A,T,C or G
gntntnnntttgtatanntacaggctacttgttctttttgcaggatcccatcgattcgcagcaatgttttgtggcttttattgtacaagcttttcacctccttggttaagttagttcttaagtgtcttattcttttacgtgctattataaatggaattattttcataatttccttttcaggttgttaattattagtgtacagacatgcaactgatttttgcacattgactttgccagtgacatgaacctgtatgtagaaaaccctaaagattgcacaaaaaaaatggttagcttgagacgtaaaccttaggcaaagagaagtttgtgatttgtaagaaatttaaaattaataggattaaaaagagagctgtgggccttgttatgtatttgctttggaagccctctaagaaaatttcaggtcaattttttattctctgccctactggaatgcccccagattatgtgacaatgangtcttattttaatatgtncanaatttggtnanantggcaatnnttgggttcnanattttcccatttcagaaaattntngctttttcnggtgatgtcttatcctcttgngtgggtcccaagtgagccctgatcctttcagatncattttatatactctggtggtgatgaatatttnatctctggcaaatactgnccatgctaattccctggaggacctnggatncaatattattggaattntaaatcaaggttaacctaagtcaaagagtctnanctgccc

SEQ ID NO: 4971 - DNA, 817 bp, Homo sapiens
  misc_feature 1, 2, 3, 5, 7, 8, 9, 14, 21, 23, 505, 544, 545, 550, 551,554, 555, 564, 583, 588, 604, 629, 645, 670, 672, 677, 684,701, 702, 706, 708, 711, 720, 729, 733, 777, 786, 791, 795,796, 797, 798, 802, 813: n = A,T,C or G
nnntntnnnttttntacatanangctacttgttctttttgcaggatcccatcgattcgaattcggcacgaggcgagggcctggcccccagggcggccacaccagaaggtcggagaaaggcccaaggcggatgccacgcccagcagtggtgagggacccacagattttggaaacgacctggacacactattgggaaggagatgtggacggcctgtctcctcctgcagggcccaccctaagaatgtatttttaaacacatgaaataagtatttttcactgataaaaaaaaaaaaaaaaaaaaactcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatggtttnaaggttaaggggaagtttttggaaaggtttttaaattcnnggccnnggnnccaattgcnttgggcccggttccccaanttttngttcccttttattgangggttaattgccccccttgggcgtnaatcatgggccataancttggtttccctggggtgaaaattngntattnccgtttnacaatttcccacacaanntttncnaancccgggaanccttaaaantgtnaaaaccctggggggtggccctaaatggaattgaaccttaacttnacatttaantggcntttnnnncttnaattggccccntttt

SEQ ID NO: 4972 - DNA, 684 bp, Homo sapiens
  misc_feature 3, 4, 5, 6, 7, 8, 9, 10, 11, 12, 18, 21, 22, 23, 475, 507,514, 536, 538, 540, 642, 674, 682: n = A,T,C or G
agnnnnnnnnnnttgaanacnnnagctacttgttctttttgcaggatcccatcgattcgaattcggcacgaggataggcttagaaattattttttatcagcattaagtgcttcaatttctccccataaagattctaaggaaatttcagttcctcatattatagttttccccataatttaatattactaagtatttctctgcccagtaatgttgatgcagtttgcataaatagccttggaagtaaggaggcaggacagaaagccaaatatcgaaatctctggccttgatttagtgacagtttattctaatggggaccataggtgttattagtaaaaagatagtgtacaaggcctaagttcagtttacattgttctttgaaatgagttcatcttttgtgttgaataattgtattctaagtaggagatgcctgtatttaacataatcatgctttctatataatcaaatatgtatttgntggaatactggtagaaataccttccttcctcnttgccanggaaaaaaaactcccgattatncngntataaataggaatttgtacatattacattttaaaatttaaatgcatatatttgaaggatggatatagtctgagctatgctgcttaattcactcctggaccgncaatgttttatatggctgctatgctggtacgngctgatgnaa

SEQ ID NO: 4973 - DNA, 779 bp, Homo sapiens
  misc_feature 5, 42, 43, 44, 48, 49, 62, 67, 72, 76, 80, 82, 84, 98, 103,108, 109, 111, 112, 113, 116, 118, 121, 123, 125, 126, 127,128, 139, 149, 162, 212, 213, 215, 216, 217, 219, 223, 231,234, 235, 237, 241, 245, 263, 273, 276, 277, 282, 286: n = A,T,C or G
  misc_feature 290, 291, 298, 300, 306, 315, 322, 324, 325, 335, 336, 337,342, 343, 344, 345, 354, 357, 358, 359, 360, 361, 372, 374,382, 396, 410, 425, 452, 467, 471, 484, 485, 489, 492, 496,498, 501, 528, 537, 541, 562, 587, 589, 592, 598, 604: n = A,T,C or G
  misc_feature 605, 608, 614, 617, 637, 641, 645, 656, 658, 668, 675, 689,694, 695, 697, 708, 728, 738, 739, 768: n = A,T,C or G
acganagctacttgttctttttgcaggatcccatcgattcgnnnctanntcgagaagaggtntggtnacctnctgntgcncncnctgggctggacggnaagangactnntnnntcnanggngngnnnngcggcacaccnggtatttgancatgcattatctncacacactgtgcagcatcctttggagagcacaacgcatggaaaggtcatnnannntntganttgccatntcnntngcgngtcntcctacccaagtaaaagntaccttggcnatnntaccnccgntttnntcactcncnaggacntattacctngggtgcntnnaacgtaatcnnntactnnnnctcattctnacnnnnnttggacccatngncttgctgncacacctatgaagnactgtttcacagcnctttcacttcctacnaaggtaccatgttatttatcttgcctngaaaattctgaattntacncttaaattttaanntttnttnactntnaangcaaaaattttttgaactgaaaggtcnttaaaggcntttngactcttcatttttcaaattngggaaaacaatgctcaaaagagttntnttnaccttngtaaannaangggaanaanaatctggaatctttcctgancctntacnttaacctcttntnttcactggtncttgcanttttttcctaagtnatttnntngggattatttnatttcaaccaaacacttganccctttttanngccaatgcacttggttaaaccatgggggnaaaaatgcccc

SEQ ID NO: 4974 - DNA, 779 bp, Homo sapiens; identical to SEQ ID NO: 4973
  misc_feature 5, 42, 43, 44, 48, 49, 62, 67, 72, 76, 80, 82, 84, 98, 103,108, 109, 111, 112, 113, 116, 118, 121, 123, 125, 126, 127,128, 139, 149, 162, 212, 213, 215, 216, 217, 219, 223, 231,234, 235, 237, 241, 245, 263, 273, 276, 277, 282, 286: n = A,T,C or G
  misc_feature 290, 291, 298, 300, 306, 315, 322, 324, 325, 335, 336, 337,342, 343, 344, 345, 354, 357, 358, 359, 360, 361, 372, 374,382, 396, 410, 425, 452, 467, 471, 484, 485, 489, 492, 496,498, 501, 528, 537, 541, 562, 587, 589, 592, 598, 604: n = A,T,C or G
  misc_feature 605, 608, 614, 617, 637, 641, 645, 656, 658, 668, 675, 689,694, 695, 697, 708, 728, 738, 739, 768: n = A,T,C or G

SEQ ID NO: 4975 - DNA, 758 bp, Homo sapiens
  misc_feature 2, 3, 4, 5, 10, 14, 15, 25, 33, 34, 44, 50, 289, 599, 649,706, 715, 719, 723, 751: n = A,T,C or G
gnnnntttcnaaanntttttgaaanccttcttnncctttcaaancgcttncgaattcggcacgagcacttgtcaggggagaggggacagcaaggtgggaggttgaagagctttgaggctcagcagcatgtttgtggcattcggtggacaccatggccttgggcggctggacaggtttttgtgatgtgagggacacgcatggggcacatggtaagcttggcaagggctccaggaacgctgacgaagggttttaggacccccacccccatgcctgtaccagggctggcctncagagcgggtgaggacagagcagctgtgggcttttcattctgaggtcttggcccccctgccaccgcaagggactctttgcttgtcagggcttgcaaaaaccaaccttcgagaaagaaaagggaactcttcacgttgaatgttgactttgtgtgtatgcctgtgtgtgtgtgtgtgtgcacgcgcgcgtgtgcgtgtttacttcatggaattttgttttgtgaaattcccctcaatcgtgtcagaatttaccttcatgccccatcacactgttggttctgcgctctgaacctgggtgtagctcatttgaangactctcttctgcgtttcctaacagttatttggtggtctcaaaagttgangttgtggaagggttgggaagaaactgaagttctatccatttccatagaatttacatnctgcatttnaaangcanggaaggcttaaccccggcccaaaacttncaggcct

SEQ ID NO: 4976 - DNA, 1335 bp, Homo sapiens
  misc_feature 12, 17, 47, 52, 92, 96, 103, 107, 110, 111, 125, 128, 129,140, 146, 156, 160, 183, 184, 204, 216, 221, 227, 228, 234,237, 260, 273, 282, 299, 303, 304, 312, 325, 329, 330, 335,343, 350, 351, 360, 364, 375, 389, 391, 406, 430, 434: n = A,T,C or G
  misc_feature 438, 439, 476, 477, 479, 480, 498, 499, 515, 517, 528, 571,576, 587, 591, 593, 599, 607, 610, 618, 625, 627, 633, 638,639, 646, 656, 659, 661, 666, 670, 672, 680, 686, 692, 700,701, 703, 716, 721, 729, 731, 733, 740, 749, 760, 770: n = A,T,C or G
  misc_feature 771, 774, 776, 778, 779, 783, 785, 790, 798, 801, 802, 805,806, 809, 817, 819, 821, 823, 825, 831, 843, 845, 854, 856,860, 861, 872, 892, 908, 911, 912, 913, 917, 918, 919, 922,927, 930, 935, 936, 947, 950, 957, 962, 978, 980, 981: n = A,T,C or G
  misc_feature 987, 990, 994, 997, 1014, 1018, 1019, 1023, 1024, 1034, 1035,1036, 1041, 1051, 1052, 1057, 1062, 1067, 1071, 1073, 1074,1094, 1096, 1099, 1104, 1108, 1113, 1114, 1121, 1127, 1132,1135, 1140, 1145, 1154, 1156, 1170, 1172, 1174, 1178: n = A,T,C or G
  misc_feature 1186, 1191, 1195, 1200, 1206, 1211, 1222, 1227, 1229, 1234,1240, 1243, 1246, 1253, 1254, 1256, 1260, 1266, 1282, 1286,1289, 1292, 1297, 1300, 1304, 1306, 1315, 1324: n = A,T,C or G
gccctttctaantgctnagacccttgtactcctcatgaacgtttggnaaatnccgcacgaggaaacagacaaatctgtaataacggcctaancctntttctgngatnagnntcatttttgcccantcnnaaaaaatgtgnaatagnttattcaagncaancagctcattttccaacaatcctnngctcatgtgatcccccaatncccacaactttntgganaacccnngggccncanatggttgtggaaaaatggggttntagatgggttcgnggaacttgnagggtatgaaaaagggnccannccaggctngaactggggattnggannaaacnccaatcgnaaaaccnntttttaaanaacnccccttttaanaagggggcacctgntntttaacggctaaganaaaatttggaattgcccccctcangttncatnnaaacggggatttggaaattttggaaccccctgggggnnannattatcccatccacaaannggaaccctgggggcancncccaggggganctttgggaaaacaaggggggccccttggccttttaacggccgngcctntttttgggcantaancnaggctngccctaanaangggggccnccctttntntaaccncccannacctttncggcgtttcncantnccccntggngncttaaacnctgggntgcccntgtctatnncnagacccctttttngcccntggggggncnantttaagnccccccccnttgggaaaatntccccccaannggngnanngggngngcccnaaattttnccnncgnnccntttttgcnancntntngggccnatcccttatggntnaaacccttngnaagnntcaccaaattngggttgggcccctttctaanggtaaaaacaaaaaanggnnngggnnnccntttgncancattnncttttcccaanacnctttggnggggnaaaaaacccctgtaananncaagcnccngggnaanataaagggtaaaaatcncccnngggnncccttaaggnnnttttnaaagggaacnntaaanccccncccgngggngnnaaattccttgggcttttacncnccntttgngccncaacnntgggacnaaaggnttctnacnagggnaaatngggggggcntnaacccgaacccccnantncccnctaagganagcgntaanttaangggaancttcngccttgcaaanaaagntntttgnacaatnttngcncgaaaanngngggngaactnaaaactgggaccaaantccnccnggncctanacnttananaaaagatgntaaacaatngcccccccccc

SEQ ID NO: 4977 - DNA, 848 bp, Homo sapiens; identical to SEQ ID NO: 4964
  misc_feature 4, 5, 6, 7, 14, 15, 17, 68, 69, 98, 99, 100, 102, 104, 108,121, 123, 126, 128, 134, 135, 162, 180, 181, 184, 190, 200,203, 212, 217, 219, 220, 221, 224, 231, 237, 239, 249, 254,259, 260, 265, 267, 272, 274, 279, 281, 282, 290, 296: n = A,T,C or G
  misc_feature 303, 304, 317, 329, 332, 343, 359, 368, 383, 407, 408, 410,432, 451, 461, 471, 476, 478, 486, 496, 499, 504, 514, 519,521, 526, 527, 529, 532, 535, 546, 550, 555, 566, 570, 590,602, 616, 632, 642, 652, 662, 665, 676, 693, 698, 707: n = A,T,C or G
  misc_feature 711, 712, 724, 729, 743, 759, 762, 769, 777, 781, 783, 795,800, 805, 808, 810, 824, 825, 828, 834, 847, 848: n = A,T,C or G

SEQ ID NO: 4978 - DNA, 768 bp, Homo sapiens
  misc_feature 2, 4, 5, 9, 10, 12, 13, 14, 15, 16, 17, 18, 19, 25, 32, 38,48, 49, 57, 65, 73, 78, 586, 678, 686, 726, 734: n = A,T,C or G
cntnnttgnncnnnnnnnngggggntttgcantgcggnctaatggctnnggctactngttctttncgcaggancccancgattcggaaaatataggcctttattgtctttaacattgaagtaactttgtagttttattcaattatgagccagcagatccttagtttaggcccttatattgcatacctaattagaactttccccaaagttcaactgcatgaccttaatgtattggagcacgtcttacaggtggacttaaaactctagaatttcctgagtcgttgttattttccactgaaggtctttccactgtacagcatttcaggcatcatcactatgattcttttttcttgactgttgcttgttttcccactgctcttttccccaatggcgagctgggtgtgccatctctggggctctcttataggaactcacagtctagcctactgtattttgttttcggagaagtgaaagtgaacactgttatttgccatcatacctccatcaagaatttcacttcactaggaaatatatgggcctttcatggaactgatgattactgtggctgatgtgagtgttgggcttangatgctcacatgtggtagttggaagttttgtaatctaagatggaaatgagtgggccatttaaatggccatctaaaggtcacagtgactgcanaagaagtnagaagagagtataattcttcagctccctggacttccatangaaagctngaaaatcttatacccagattacccaaaaaaaaaa

SEQ ID NO: 4979 - DNA, 798 bp, Homo sapiens
  misc_feature 2, 3, 4, 5, 6, 7, 8, 9, 12, 15, 22, 23, 24, 35, 36, 41, 49,56, 72, 85, 108, 134, 384, 488, 534, 567, 604, 627, 642,668, 678, 685, 694, 695, 699, 748, 760, 762, 769, 770, 775,784, 789, 791, 793, 795, 797, 798: n = A,T,C or G
gnnnnnnnnttncgngtgggcnnntaggtgggggnnttctnttttactnatagctngtgtactcgttctttncgcaagatcccancggttcgaattcggcacgagggnaacctttcaatcactttaactagtcncttaaggactctaggcccagaagcctggtttctgggtgaatgtttttatacatcactcaacttccctcgtcctaaaaggacacctaattttgttactattgaaaatttttattttggtggccagaatacgaaatcgggagaggtaacccaaacagttgtcttaggaaaaggcagattctcagaggcaatgggctatcaacaaaataggtgctaagcacatttgtttgtaatgatcattcatataatttanaagatttatggtaacagtttatattcattatccatacagttctatttttgcaaatagaataaccacctataagcaaacagtgttaatgagaaatatatattgtnttaagaaaatagcatataccacatgaaaaagagtgttccctttctntttttttttttgccagaaatcaagtgtggaagncttgatcaaagtaaaactacctatttgaactgcacanataaaactggggtgcccaatccntattttacatttctngggcttgattcatataactttgtaanaaaaaagttnactattnaaaaagtcnngtgngccttcacttttgacttggacttctattcccctttttgtcctgggattnctttttcctacncnatttctnnaaatnttatgaaangggcntntntncnn

SEQ ID NO: 4980 - DNA, 1105 bp, Homo sapiens
  misc_feature 7, 11, 20, 22, 23, 52, 56, 62, 66, 69, 73, 76, 78, 79, 81,82, 83, 89, 90, 99, 105, 108, 116, 141, 149, 153, 165, 167,172, 186, 187, 202, 203, 209, 214, 217, 226, 227, 228, 232,233, 239, 242, 245, 250, 253, 255, 257, 259, 264, 268: n = A,T,C or G
  misc_feature 269, 276, 278, 284, 286, 288, 291, 293, 296, 298, 301, 302,303, 304, 309, 310, 314, 320, 324, 325, 327, 333, 334, 336,343, 349, 353, 354, 355, 357, 359, 360, 364, 365, 368, 372,382, 386, 387, 393, 395, 405, 406, 407, 409, 411, 413: n = A,T,C or G
  misc_feature 414, 415, 417, 418, 420, 421, 427, 429, 431, 434, 436, 443,452, 460, 461, 467, 472, 473, 476, 477, 483, 491, 493, 495,498, 502, 505, 507, 509, 510, 512, 513, 523, 524, 531, 537,545, 550, 555, 570, 572, 575, 576, 580, 581, 587, 598: n = A,T,C or G
  misc_feature 602, 603, 607, 610, 611, 621, 624, 625, 632, 634, 636, 640,644, 645, 650, 662, 665, 673, 680, 682, 688, 697, 711, 714,718, 725, 728, 729, 730, 744, 745, 759, 766, 771, 774, 781,783, 787, 793, 794, 808, 815, 825, 826, 828, 831, 832: n = A,T,C or G
  misc_feature 834, 837, 838, 855, 870, 878, 883, 885, 889, 891, 894, 899,900, 912, 914, 916, 923, 924, 925, 926, 939, 942, 943, 946,953, 954, 959, 966, 968, 972, 979, 981, 985, 989, 996, 1007,1008, 1010, 1011, 1013, 1024, 1032, 1034, 1035, 1036: n = A,T,C or G
  misc_feature 1052, 1053, 1056, 1069, 1072, 1073, 1075, 1076, 1081, 1082,1090, 1093, 1095, 1099: n = A,T,C or G
gaccccnttcntgattgggncnnaggtggggggttttcctttttactaaatngctngtgtcntccntantctnctnannannnagagcnnagtcctcanacagcncgnagccccantagctgggcctacaggcgcccgtcnccacaccnactnttatgggggggngnggggngggggagacggggnntttaccatgtttgcnncccgcnggtgnccncgtggtcannnctgnngaccanctnttnccggncanancncnccggnctcnntatcccncnccaggncncncgncnccntncannnntgaanncccncccccnctcnnanctaacnngnagccacngccaanttcnnntntnncgtnncantttnactacacttnttcnnctcccntnttccactctnnngncncnnncnncnnggtctnantnccntncttcttntatagacgntcatcacnnccaccnccaannttnncttcancataatcncntntancctncancncnnanntacggcctcnntctcccncccctnttctcacncttanttctnctctcctctcgcccntnctnngccnncctccnctccccctctnaatnntctnctnntctctccctntcnnttttcgntnancacncatnncatcnccaccacctcanctntatctatnatcttancntcctcntctccctcnctcatcactgttcnacncctnctcacancannnatctcctctcacannttgctatcatctanatctctntctcntcntcaccanancctntacaanntcttctccctctcncatctcncttcactctnncnacnntnacnncttaccgcacgcctccnctctcaccttcactnccccactnttcantntcgncncgnctctnngacctctcttcncncnattccannnntctcctcctaccnatnntcnattctcnntcatnactactntntcanctaccanancctnctcntcataantcccctcgacnntnncncacctctactntgcgcccncnnnccactttcctctcccnntangtcacctaccaancanntnnatctnntattctantcnantacnttacct

SEQ ID NO: 4981 - DNA, 784 bp, Homo sapiens
  misc_feature 1, 2, 3, 8, 9, 12, 17, 19, 20, 22, 23, 24, 28, 37, 46, 50,51, 86, 766, 781, 783, 784: n = A,T,C or G
nnnttttnnttnttggngnngnnnagtngggggtttnctttttttntaanngctgcgctacttgttctttttgcaggcatcccatncgattcgaattcggcacgaggagatccaagtggtttagaaggggatgattgctggtgaaggttctgaacatggtgacaggtgggaggctgagcacacactcgtacaccgctggcaggaagagaaatgacttttctggactacaatttggagataacacaaacattaaaaagaagaaaaaattgtatccctttttgactaagcaattctaggattgttatttttttctcctgaggaaactagcatggatgttcacattcaggtgtggggatgtttatcaatttgctattttagaaaagagaaaaaaagtttagcatgtcacaagataattttcatcaatatatggtacatccatttagtgaaatgctgtacagccatttaaaaagatacagaagaggccaggcacggtggccttacttggctaattaaaaaaaaaaaatctgtagagatggggtatcaccacgttgcccaggcttgtctcgaacgcctgggctcaagtgatcctcccacctcagcctaccaaaggcctctagaactatagtgagtcgtattacgtagatccagacatgataagatacattgatgagtttggacaaaccacaactagaatgcagtgaaaaaaatgctttatttgtgaaatttgtgatgctatttgctttattttgtaaccattttaagctgnaatcaaacaagtttncnn

SEQ ID NO: 4982 - DNA, 784 bp, Homo sapiens
  misc_feature 3, 5, 7, 14, 15, 16, 17, 19, 34, 38, 39, 43, 50, 54, 201,206, 208, 219, 223, 282, 294, 333, 344, 374, 403, 443, 489,490, 496, 499, 502, 505, 507, 536, 549, 553, 559, 577, 594,600, 603, 616, 617, 620, 645, 650, 651, 697, 711, 724: n = A,T,C or G
  misc_feature 728, 742, 751, 761, 764, 768, 783: n = A,T,C or G
ctntntnggtcctnnnngntggctttctaatgcntaannctgntggtctngttnttttcgcaggacccatcgattcgaattcggcacgaggtggtaccttggctttaggttttcattcgcacggaacaccttttggcatgcttaacttcctggtaacaccttcacctgcattggttttctttttcttttttctttcttttnttttntntgagttgttgnttgnttttagatccacagtacatgagaatccttttttgacaagccttggaaagctgacactgnctctttttcctncctctatacgaaggatgtatttaaatgaatgctggtcantgggacatttngtcaactatgggtattgggtgcttaactgnctaatattgccatgtgaatgttgtatacnattgtaaggcttatgtcactaaagatttttattctgattntttcataatcaaaggtcatatgatactgtatagacaagctttgtanngaagtntangancancnatttctgtacctgatcaagtttattgcancctttcttttccnattnctttcntttaagggttagtattancaaatggcaatgagtcnaaaagntancatgaagattttnnaangagagaacttaccggacacagattngtgannctttgactggggacacctattggatgtgattcttaaaaagcttttnattggagccatttngccaaaattttgnaaanctttcatagggggnattggaccnttattatccnatnaatnccccctcctatattnc

SEQ ID NO: 4983 - DNA, 778 bp, Homo sapiens
  misc_feature 2, 3, 5, 6, 7, 9, 10, 11, 12, 13, 19, 27, 32, 35, 38, 43,51, 52, 306, 333, 364, 381, 433, 465, 477, 486, 491, 505,514, 523, 581, 608, 615, 636, 659, 661, 671, 716, 717, 718,724, 728, 747, 752, 754, 755, 756, 757, 771, 775: n = A,T,C or G
tnngnnncnnnnntggggntttcaatntttcnaantgngtctngttctttnngcaggatcccatcgattcgcaaaagccaccttttgttcgaaactccctggagcgacgcagcgtccggatgaagcggccgtccccacccccacagccttcctcggtcaagtcgctgcgctccgagcgtctgatccgtacctcgctggacctggagttagacctgcaggcgacaagaacctggcacagccaattgacccaggagatctcggtgctgaaggagctcaaggagcagctggaacaagccaagagccacngggagaaggagctgccacagtggttgngtgaggaccagcgtttccgcctgctgctgangatgctggagaagcggnagatggaccgagcggagcacaagggtgagcttcagacagacaagatgatganggcagctgccaaggatgtgcacaggctccgangccatagctgtnaggaacccncagangttcagtctttcangaaaagctncatggagcnaatccttctgcctgatgaagtgcatctcagcatcacttcagctgtcggggcatttgtngggagaaccagaccacctctgcggaangcagcanacccttttccagccatggatngagtttgaattcttctataaacngntcaccatcanaccacccaattcatttccattgctttgcctatagaggaaatttannnaatcanattnaatggtttcactttatttnaaaancnnnnaactctaaaaactntggncct

SEQ ID NO: 4984 - DNA, 762 bp, Homo sapiens
  misc_feature 6, 12, 26, 29, 49, 53, 61, 63, 64, 67, 71, 96, 119, 121,192, 308, 323, 352, 354, 355, 363, 364, 371, 373, 377, 387,406, 411, 415, 427, 437, 439, 444, 445, 446, 483, 491, 496,497, 502, 518, 528, 546, 551, 555, 559, 560, 568, 574: n = A,T,C or G
  misc_feature 589, 592, 593, 601, 602, 605, 612, 613, 618, 619, 623, 659,686, 736, 762: n = A,T,C or G
tggttntcttgntggggtgttccttnttncaattatgtgttctcgatcntgtngcaggagnannccngcgntggccggtgtgttgcccagactggncttcacctcctgggctcaagtgntnctcctccctcagcctccccaagtgctgggattatagatgtgagcccctgcaccagacaattatatttattnttaaaaacgcccctcatgaagtctgggtaattctctccagatttctccttatcaacaaatttataagagttaggaaaaaaatgatgtaaataaagcacttaaattgcgacagtggntctattcttaacatnataatgcttatgactaaggagcattcttntnnttataaannaaatgtntnctgnactgttagantacatgagggtcagagacnttatnagtntgtaagaatgcnttgtggattntnctaannnatcacctacagtaatgggctatggctaacaccctttnacaaaatngaggnncacanatgaaattccagttanagatcataanggtgtctgcggtgacccntagtnattncctnncgattacnggcgcnaaatttaacgatganctnncagctcannagntttggannatttnngctnaaatgctctcctggacactaccatacttagcatatncctgggaaatactaaccgaataatatncctttaaaacaccccggcctcaacagataagatctatgatctaacgtttnattcttttcacacattattattaatn

SEQ ID NO: 4985 - DNA, 860 bp, Homo sapiens
  misc_feature 7, 8, 9, 12, 26, 30, 36, 49, 57, 65, 365, 388, 391, 392,395, 413, 420, 421, 424, 426, 431, 432, 443, 447, 450, 458,467, 469, 472, 481, 484, 487, 492, 498, 505, 511, 534, 536,553, 554, 562, 565, 568, 570, 579, 586, 590, 591, 595: n = A,T,C or G
  misc_feature 596, 597, 604, 609, 610, 622, 624, 629, 635, 638, 639, 643,644, 650, 653, 659, 661, 664, 665, 678, 681, 684, 690, 691,693, 698, 718, 721, 725, 729, 730, 731, 733, 734, 737, 738,744, 746, 749, 751, 752, 754, 755, 756, 760, 761, 762: n = A,T,C or G
  misc_feature 763, 765, 766, 769, 772, 774, 776, 777, 780, 786, 787, 789,790, 791, 794, 795, 796, 798, 802, 805, 808, 809, 810, 811,815, 817, 819, 820, 824, 825, 828, 829, 833, 835, 836, 837,838, 840, 841, 843, 844, 846, 851, 855, 857, 859: n = A,T,C or G
tgggttnnnggnttggggttttcaantttngctaanagctgggctactngttctttncgcaggancccatcgattcgcttttctttgcagtatgaaggtagataattcttcaagttaaagatggacttttttcaccagaaatggctttatggaatcaatttgcaaaaatgtaagaggtggcaaaggaaagaataaaataatattttcattttcttctgttattcttagatcctttggtagattgtaaactccatgaaagcaggataccttcttttgccctaaggcttggcccaaaagagataccaaaaaaatacttgcttatatactaacctagtctctgggtgtgggagccatagagggttcanggtggggtggtggggaaggtggnggnnttncgtatatccgaaatgttncctcatnnaangnatttnnagcaagtttangaanganttttgctnaatgaaatngncanagaaccatnaanttncatanatgccnatgcctnaaagcngccttttgaagctttatcttaangntctcacccttcataacnncctaacgnatnacntntttccttanctttggnattnnatannnaacatangctcnncgtttattcaanantccanaacctnggnnggcnnttatanttnctcctntnccnnaacctttggaaanttnaancctggnncnttttnccatttctcctcttttttancanatanatannncnntcnntcttcntntananntnnnctcnnnncnnctnccntncnntcncttttnntnnncannntnctcntcntannnntttncntnnacannctnnctantnnnntnngnntnctccntttntntnc

SEQ ID NO: 4986 - DNA, 762 bp, Homo sapiens
  misc_feature 1, 4, 7, 8, 11, 12, 25, 31, 33, 52, 54, 57, 64, 68, 70, 71,74, 76, 441, 468, 470, 472, 496, 519, 521, 528, 536, 543,548, 561, 582, 584, 597, 599, 600, 611, 614, 621, 639, 684,715, 719, 741, 743, 761, 762: n = A,T,C or G
nagngcnnttnnggtgggggtttcnaattcncnctaaaactggggctactcntnctntccgcancaancnngcngntcgaattcggcacgagaagggagaggcagtaggactaggagttaaattgtcatgccgaggtctctgagcatgggtgggcctgtcagaattgtcatcgctcactctgttgacttccagcagctgacaggcaaggccctaggaagctcttcagcctcctttccttgctagaggtgctgttttccctggaaatgttcaagccctgcaaatcgtttctatagtaacaggtctctgtcttttttcttatgatgcagatttttgaaaaggtttcttatctaaatgttcttgggatctatggtcttcctacctgtagctcctttgattagacagagcctttatttaaagacttttccccccaagaatgttgntgttgcttctaccaaaataataaccantngntagttttactagtgcttgaagttntagtttattaataaagcttcatntnaactatnaaaaggantggttgngtacnaatagtaataccngaaaaaactaatattcactgntnctctcatgtattngnnaactttaattnttnattatgnaaaaccttcaaacataanagtagtcaaaattatataatagacacctatatacttaccacctanattgaaaactaacattcttgccatattggcntacnctattccatactgatagtaaancntagaccatgtatttacann

SEQ ID NO: 4987 - DNA, 783 bp, Homo sapiens
  misc_feature 4, 480, 484, 489, 493, 498, 502, 525, 529, 572, 578, 615,649, 658, 673, 679, 689, 699, 714, 739, 749, 752, 769: n = A,T,C or G
attntacagctcttgttctttttgcaggatcccatcgattcgaaaaggtggccatgtgagaaggactcagcaagactttgctggctttgaagatggaagaatgtggccaaaagcctagggatgaatatggcttctagaatctataataaacaaggaaacattatttcccagagcctctagaaggactgcgttttgcttttgcctcggttttagcccagtaagacccattttagacttctgatctttggaattgtaggttaatgcatttatattattttaagccactaatttctggtaatttgttacagcagccgtaggaaattaacatgtaggaaaataaacgtttcaatgcccaggtatactctgaggtcaagccagagaagagttgggcagagacttcaaaaacgatgaaggaggggttaggaaggtcctagcatcagtggaatagaataaaattactcttattaagaggggaacctnaccnttagngganaaatnctgnaaatgggtctgagacaaaatgcnttanagcactggttgctagaaaaatcaaacataggagatttaggaanatggangcttgcaatgaattatgattgcatcactatatttcanccctcatccctgtcttccagaaaaaaaaaaaatnggggatttnaaaggtttattggtncttaanggccagcccntttgaaaaanccattggtttttggnaaaggaaaaagggccaatttaaaangggacctgtnttngtaccaggctttgttgnatttgggaaaaaaa

SEQ ID NO: 4988 - DNA, 1063 bp, Homo sapiens
  misc_feature 1, 6, 8, 9, 10, 11, 36, 49, 52, 53, 55, 60, 64, 74, 81, 86,94, 101, 107, 113, 118, 121, 126, 128, 131, 138, 156, 157,189, 198, 204, 212, 219, 224, 226, 229, 237, 240, 241, 245,250, 253, 255, 258, 259, 271, 276, 277, 281, 283, 289: n = A,T,C or G
  misc_feature 297, 301, 302, 309, 310, 313, 314, 329, 331, 332, 334, 337,339, 344, 345, 354, 359, 361, 365, 366, 369, 370, 374, 378,380, 383, 384, 391, 397, 398, 400, 403, 408, 410, 411, 426,435, 436, 437, 439, 440, 443, 445, 446, 450, 451, 452: n = A,T,C or G
  misc_feature 454, 457, 463, 464, 467, 468, 471, 473, 474, 475, 476, 477,478, 481, 483, 484, 488, 489, 491, 492, 494, 498, 502, 505,506, 528, 534, 540, 546, 550, 551, 553, 554, 556, 566, 572,581, 589, 592, 594, 599, 605, 607, 610, 612, 616, 621: n = A,T,C or G
  misc_feature 624, 625, 639, 641, 645, 647, 648, 652, 657, 661, 664, 668,674, 682, 683, 686, 691, 695, 697, 707, 709, 720, 721, 722,728, 730, 742, 744, 745, 746, 752, 757, 760, 763, 764, 769,771, 773, 781, 785, 795, 796, 797, 802, 804, 805, 807: n = A,T,C or G
  misc_feature 811, 816, 835, 850, 851, 852, 853, 857, 862, 868, 877, 879,881, 885, 888, 891, 893, 902, 903, 905, 909, 911, 915, 919,925, 926, 931, 933, 942, 948, 951, 955, 958, 960, 961, 963,967, 970, 977, 979, 981, 983, 987, 993, 998, 1007: n = A,T,C or G
  misc_feature 1011, 1014, 1016, 1030, 1032, 1033, 1036, 1044, 1045, 1048,1051, 1060: n = A,T,C or G
nccccntnnnnaagggggggtggggggtctcaactngctagcggtgtgnacnncnaactngccnaaaagaaggntggggcnatccngcacgagntgacggngcgggntcgggntttgntgnttggnanaanccttccnatatctccagtgcggganncactatctggtatctctattgacctacgggangctttcctnagtcantcgctacnccactgnactangnganaccacgcnacnntacncttanatncntcnngcacatctgaantcacnnggangnttagtncgcagcgnccgnntccacannccnngatcacgcgccctcntnncnaanancatannctcacttgntgttncnccgnntannttangttngnccnnaacaaancttacnncnttntcagnannactccacctcttccnccgaaactnnncnnacngnncatnnnanccngcttcnngcnnctncnnnnnngcngnnccanntnntnaatngccntcnnctcaacacgcccaaaccttacntatatncctttnaccacncttnncnnanccctctaccncccganctctcgttncccccatntcnanttctnctctcncnacncncccntctcnccnncctcattccccccntnaatngnncctncatcncacnacnttgnatgacntcttctcnnccntaccnaccncntctccaactncntctggcaaaannntcctcncnttcatatactantnnntatctnccctntgnacnntcttncngncgcaaaantcanctcctacacnnnacacntnncnctcncgctngcacctatctactcaactnctatgcactcatcgnnnncaanatctnacctcncaaactctntncnactnccncananccccccacnnanacanangcgncaanacaccnncacananggcgatacncttatnacnctcngancnnanatcnccnctctacncncnancatncacgtntctcnctatcatcngcgntcncncaactcagcagttnannacnccatactnnctncangggctcaantat

SEQ ID NO: 4989 - DNA, 996 bp, Homo sapiens
  misc_feature 3, 9, 12, 13, 118, 135, 139, 148, 152, 157, 169, 180, 183,196, 204, 211, 213, 216, 238, 243, 250, 255, 258, 263, 268,282, 288, 300, 304, 310, 321, 323, 338, 356, 357, 358, 361,366, 372, 375, 392, 400, 403, 413, 416, 418, 428, 436: n = A,T,C or G
  misc_feature 443, 444, 445, 451, 455, 466, 467, 469, 476, 485, 487, 506,509, 510, 517, 521, 536, 539, 541, 544, 545, 556, 563, 570,571, 576, 577, 585, 587, 590, 603, 608, 612, 615, 640, 644,647, 656, 657, 670, 677, 679, 680, 687, 691, 694, 697: n = A,T,C or G
  misc_feature 711, 714, 719, 725, 726, 734, 737, 741, 742, 747, 751, 757,762, 777, 783, 789, 790, 791, 792, 793, 794, 800, 810, 815,820, 821, 822, 826, 834, 836, 845, 846, 852, 856, 859, 862,867, 871, 872, 876, 879, 880, 888, 892, 894, 902, 906: n = A,T,C or G
  misc_feature 911, 913, 918, 920, 923, 926, 933, 947, 960, 962, 964, 972,983, 984, 995: n = A,T,C or G
gcnctttgnaannttttcctaatgctggttttgctacggaaacccttggcaaatccggcacgagcttcctgtgccaggggaccgtggagaaagtgtcaggggccgctcactgcagcanttttgctctgctgcctncccnggcagcgtnctgngggtngtacaccaaaanagctgggtgtncgnggcgggtgcttgnaatcccanatactgnangangctgaagctgcattatcgcttnaaccnggggggnacgangangccanggagncaaaatgggggctnttagancaaaactttgtntcanaaaaanaatgaataatnanacaagaaaatggganaagccccaataacttacnnngtntctcntggccnaangcaaaaactccacttgnaaagccanganaaaacggggnaanancaaaacaaanctatcacntggaccnnnaaacanaaanccaaaggattnncnttccccnaaattggantnaagattcaatggacatggnacnnaaaaatncagnggtaccggaactccnganangcnntacaggttgcncaaaaangaaaccnnaaaanncggggagngnttnattaaaggggggnatttncgcncantttaaagggaaagggccacccaagnattnagncacaacacnntgttgacgggaantccattntnngcgaganaaanggntgntacatccccaattntanaaaanggcctnnaaaaaaanatntttnnaaccncacnaaatcntttancactaggggatttcnaaaaantagccnnnnnnaatatngggggaaaanaaaancgatnnnaganatcatacncngaaaaaccnnggggtnattnganaancaccntttnnaagntannggggcatngcancncaaagggngcantaaananatagncnganagnacattanaaccccttggtganaaaaaccccaagnangnccccaaanaggattggctnnaaaaaaaaaang

SEQ ID NO: 4990 - DNA, 783 bp, Homo sapiens
  misc_feature 3, 9, 468, 482, 493, 514, 536, 547, 575, 599, 602, 614, 630,668, 680, 688, 724, 731, 738, 746, 766, 767, 778, 779: n = A,T,C or G
ttnaagctnagctacttgttctttttgcaggatcccatcgattcgaattcggcacgagctaagccccaaaacgaacttcaaactgggtgtggtggcacgtgcctttagtcccagctacccgggaggctgcggcaagaggattgcttgagcccaggagttcgagtccaacctgggcaaaagagtgagaccccatctctaaaaccaaaaaggtaccttagaaggtcacctggttggctaaccttttaaaggcaggggcgtgacacgtaggacacattgggaatgtcttggctactacatgtagccttctgggatatatgtgcccagagggagaagcactgagcctgaagaaactagatgagtctcagaaccacagaccggccagaaatctctcccaccattatatcagcgtgatacaggtctacattcatttctacaaacaggaacaagttccttgcagcaataatttantttattaacttggnttttttaattnacccttccttttgaggttaantttcatcacattatgttcaaanattcccatatnttccgtaaaattaccagcttaattacangggcatttgttcccattgggttanttnaaaaatcaggangtttatttaaaaaatncctgagttctttaagggcttggctttaaccttttcaantttccacctggnccttgtanaaaaccagttcaagcttggaaaaccaaagttctttnatttggngggtcantttcttgncaacttttttggactttganncccttggacannactt

SEQ ID NO: 4991 - DNA, 825 bp, Homo sapiens
  misc_feature 3, 5, 8, 13, 14, 15, 22, 477, 503, 505, 506, 512, 515, 525,528, 539, 573, 584, 620, 627, 644, 658, 663, 682, 687, 692,756, 757, 808, 811, 817, 822: n = A,T,C or G
ggntnttnaaacnnnagctctngttctttttgcaggatcccatcgattcgcccggaagcatccaggatgtgggaacattgtgacatttgcacaatttttatttattgctgtggaaggcttcctctttgaagctgatttgggaaggaagccaccagctatcccaataagggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggcttttggtttataaatcacnccctttccaattttccgggtttcgcntnnttgggnttncggaattttnttnacccatgccanttcttattcaaataaagtcctgaagttattttgnaaattccccgntcattcggggaaatggaccccttgccccaatcaatngtggggnttcttaacccttccttnattggaaaccattnattcnacctcaaaacccccttttnaaccncttgnggccaacttggcttgggcaccttggtttgggctttcaattggggaacctttaatggttccaccnnaaggtgttgggaacaaccctaggggaccccccaaaaaagtggagccctcanaanggacanccatnaat

SEQ ID NO: 4992 - DNA, 792 bp, Homo sapiens
  misc_feature 4, 8, 19, 473, 486, 499, 501, 502, 503, 505, 507, 514, 548,564, 568, 570, 588, 601, 609, 623, 674, 675, 686, 702, 729,759, 762, 768, 771, 790: n = A,T,C or G
tttnaaancgttagctctngttctttttgcaggatcccatcgattcgaattcggcacgagacaccctggactcctgcaggggaggacacacggaggtggacaactgcagatacacttactcggagtggcacagttttactcagccccgtcttggtgaagtgagttttcctaagtggcctacaaatctattttaattttctttaaactttataaataactaactggattctgactataattttcaattaattatgaatctactaattctactaattgaaagctattatttttcctcaattttaatttagttatgttcagatttaagtggttatttacttcccctcctatttttttaattgaaagaattactaaataatgtgtgatgagatttaaattactgtctcatggctttgtgctaatatttcccatctgacaacttgtaccttagaaaccaaaaatgtggtaccagcaanacccagcattgtncttttacttttgntnnntntngggaaanaaacttgacccccatttttaatttggccttcaantttaaatggggttgcnatgntnactttttcagcttaaaantttttgaaaaggnaaaagtantggactttttttanaaatggaacaccctgttattacttgctggccacatgccgtggactttttannaaacatgcttntactggaaatttatantggtgaatggtttgaaaccggacccantcttgtgcattttttatggttttgggaatnccntttganggncacacttttgttaaaaatnaa

SEQ ID NO: 4993 - DNA, 802 bp, Homo sapiens
  misc_feature 2, 3, 4, 13, 15, 24, 66, 68, 75, 77, 78, 85, 89, 110, 136,138, 150, 164, 223, 236, 238, 242, 254, 271, 281, 287, 300,303, 313, 321, 322, 328, 340, 344, 364, 385, 404, 451, 487,488, 497, 502, 503, 517, 521, 523, 525, 528, 533, 534: n = A,T,C or G
  misc_feature 558, 559, 562, 564, 566, 580, 590, 597, 603, 617, 628, 652,661, 663, 669, 670, 671, 678, 679, 681, 721, 726, 727, 740,742, 760, 764, 770, 779, 785, 795, 801, 802: n = A,T,C or G
tnnntttcaaatncnaggctactngttctttttgcaggatcccatcgattcgaattcggcacgagngnagctcancnnatgtatnttgncacttgggagcatcatctttncaagggccactttgaggtgaaatggntnttttacatactnagcatcaatttggncctaaaatcaggagacattcacccttctccaccccaatttccaacatcccctcctttgnagagagagcactntngaanccactgagcccnatagccctagggcctanaccactattncaaaanggaagacttttcnatnactatgacanacacccannctggantcctctgcctgnactnaaagctctaaccccaacctntttttccagtgcaaacccttntactcactaaaaatttctntccactcaaactagcctggatgcccttccctgaacggggcttgtgtnttcccattagctcaactttgcttacatgcccaggtnnaaaaccccntttcnncaggccagacaaantgcntnanttntttcnnacacgtaaaatgaaaggctcttgnngtncntnaaaaggcctcttanaaactattgnggagtcntttttnccgtttgaatccanacttggattangattccattggatgaaattttggnacaaaaccncnaacttnnnaatgccnntngaaaaaaaaatggcttttatttggggaaaatttggggaangcttnntggctttaatttngnaaccttttttaagctgcnattnaacaanttaaccaancaccantggcattctnttttgnn

SEQ ID NO: 4994 - DNA, 788 bp, Homo sapiens
  misc_feature 3, 4, 485, 503, 516, 530, 531, 544, 552, 561, 575, 610, 612,615, 640, 648, 714, 717, 719, 741, 744, 761, 765, 768, 788: n = A,T,C or G
ttnnttcaaatcgctaggctactcgttctttttgcaggatcccatcgattcggaacctttgaatagtggttgtacatacagtttttcagagctggtgtttaataacaatatttttcattctaatattacattattctttttatcatttaggtctttatccgtcagtgtttttagagaactactgcacttgaccacaaactgataaatacttggtactgccccatctcactgttctgtttactttgtcttaaatatctcttttttttttcccaggcagctagtacaccactgaatcctttaagctttcagtgtgaatttgtaaaactcaggattgaccttttacaagccttctctcaacttatctgtacttgtaatagcctgaagacaagcccaccacctgcaattgccacaacaattgccatgaccttaggaaatgacctccagaggtgtggtccgcatctccaatcaggcatgtcttaactttnagtgcattttttatttancccttttaaaggnttttcaaattttannatgaaaagtttgnaaaatttnaaaatcagngggtttgaactcanaacatttttcataaaatgtttaattcactcaactngnctnggcttaaaaaaataggctggatggngttattangaaaagataaagtggtttcatggtaatctcaatggggggctaccataatttattttaaagagaaanggncngatttttttaaaaaccttgganaangtttataacttaaattntttnatnggaacttgaaaaccctaaan

SEQ ID NO: 4995 - DNA, 746 bp, Homo sapiens
  misc_feature 4, 5, 8, 9, 21, 26, 27, 447, 460, 469, 471, 480, 485, 497,500, 504, 559, 607, 615, 640, 712, 717, 735: n = A,T,C or G
tggnnccnnaagccctttgcnacttnntctttttgcaggatcccatcgattcgaattcggcacgaggagttcaactgcaacatccgggcaccttcaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcantgcattgaggctncaagacatnanccccaaccngactncccaaaaaattntgntcanggcccgcttcttttggaaagggtttcctggacagatttccacccgaaaagcttcntgcacattgtgtcaaggacctgcgtgtgctcaatgctgttcgggactntcacattngggatcccgttacctattgccaatntaacaggttaccttcaagtgctgctggaaagctctgttgcggaaatttacccctggcatccaatttccaatnctgcncttctaatcaggcttacnggactggccct

SEQ ID NO: 4996 - DNA, 742 bp, Homo sapiens
  misc_feature 2, 3, 4, 8, 10, 11, 478, 486, 491, 514, 533, 591, 594, 726,737: n = A,T,C or G
gnnntttnannatacagctcttgttctttttgcaggatcccatcgattcgaattcggcacgaggcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtacaaaacanggtaaagnattanttgccaaaaaggtgtggaaagcntcattgacatgttcatganaatgctatgctacagactgaaaataataacctgcgtgtaaaattaaagcctgcaaganacngttgatgcattgaggtccagaattacacacttgttagtgatcaggccaccatgttcttgccaaacaggtgaaggaatgaggagattagtaattgatcatagtttttaaagaatcgaaatctaggcaaatttngaagtgaaccngatta

SEQ ID NO: 4997 - DNA, 742 bp, Homo sapiens; identical to SEQ ID NO: 4996
  misc_feature 2, 3, 4, 8, 10, 11, 478, 486, 491, 514, 533, 591, 594, 726,737: n = A,T,C or G

SEQ ID NO: 4998 - DNA, 754 bp, Homo sapiens
  misc_feature 2, 3, 4, 8, 11, 469, 490, 493, 496, 534, 593, 621, 659, 663,701, 725: n = A,T,C or G
gnnntttnagntacagctcttgttctttttgcaggatcccatcgattcgaattcggcacgaggcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggacagagctagtcagcaaatcaatgcacttcgtagtgaaatcacacgacttcagatggagctcatggagtnccaaacaggttaaagaattanttnccnaaaaggggtttggaaagcttcattgacatgttcatganaatgctatgctacagactgaaaataatacctgcgtgtaagaattaaagccatgcaaganacggttgatgcattgaggtccagaattncacacttgttagtgatcaggccaccatgttcttgccanacangtgaaggaaatgaggagattagtaatatgatcatagtnttttaaagaaatcgaagatctcanggcaaatttttagaagtgaaccatgatga

SEQ ID NO: 4999 - DNA, 773 bp, Homo sapiens
  misc_feature 2, 3, 4, 5, 6, 7, 11, 12, 20, 35, 46, 49, 57, 66, 67, 70,74, 78, 80, 207, 244, 393, 425, 432, 454, 552, 558, 571,580, 600, 640, 650, 661, 666, 676, 684, 687, 711, 729, 731,745, 766, 772: n = A,T,C or G
gnnnnnntttnngagggggntttggggggttttcnaatttttctancgngtgagganctcgaactnnccnaaanaaanangcgggtcgaattcggcacgagatttgatttaaaaaaggagaaatgttcacactcagtctagaccacttaggtatgcagagttgcatcctgaaagcaattgctcacactttccttaatatactccctntccacctttgcaaaaccttgattggcatggagcctcnactgcttgcattgtatacacatgtaataagaaagcattaaatctcttggaaattaggaattgacaagataaatagataaggcataaagccaatttttcacacatgtccttaggctcttgtaaatgtgtgcctggtgctgctttgacttnccaggtccgggaggctttctctttctctcttntcccaangtgaggctggcaagctatcagnctctccagagcaaagagaaatggcaggagaattgactgcgtgaaccccacagggccggtagtggaaaaataaatgtctaaattgaaagggtcacactngtgtanatggtgactgtcntgcttgcancagctgaggacaccgactgngtgtagcgagtgtcctgcttttcatgttcacatctggctnaataaagaantcacgaagcanacctngccttggctnaaaccctntgngctggacacaaatgactttgattncaaactcaagtccttggnantgtcacaaaggacnaacccctggctgggacaaaancctacna

SEQ ID NO: 5000 - DNA, 773 bp, Homo sapiens
  misc_feature 2, 3, 4, 5, 9, 10, 11, 12, 13, 14, 18, 19, 20, 21, 22, 23,24, 28, 36, 43, 46, 47, 48, 56, 75, 126, 668, 696: n = A,T,C or G
gnnnntttnnnnnntttnnnnnnngttnttgaccanaggtaanacnnngggaattnctctttctgcaggatcccntcgattcgaattcggcacgaggcagaaacaatagtcaggagtttgagattnggctgattaacatggtgaaaccccgtctctactaaaaatacaaaaattagctgggtgtggtggcgggtgcttgtaatcccagttactcaggaggctgaggctgcattatcgctttaacctggggggcggaggttgcagtgagccaagatgggggcaataagagcaaaactttgtctcaaaaaaaaataaataaataaaaaataaaatatgtcaagccccttctcttcctgtctcctctcgtggtgtgtacttgactccccttctcgccagatctcacaggactttcagatttaagcaatacctggccaagaaacaaaagcaaaatcattccattcccccagtggattcagatcaaaactggtaataaaatcaggtcgactccaaaaggagacattggagaagaacgaagcggggtctataaggaattgcacgtgagatggcacacatatttatgctgtgtgagcattacaatcgcgttaccatatcaagctgaaaatgtcaccactatctggagtgttggaaatgtttattgggaatatgtnttttctctgaatctgctatgaacacgtnaattgggtgggttcaataataaatatgtgagacttttcatttcaaaataaaaaaggcaaatgatgtaaaaaaaaaat

SEQ ID NO: 5001 - DNA, 809 bp, Homo sapiens
  misc_feature 2, 5, 19, 26, 28, 30, 33, 36, 42, 45, 48, 51, 52, 53, 58,60, 91, 97, 116, 124, 137, 173, 175, 178, 180, 186, 187,193, 194, 201, 206, 210, 214, 215, 233, 244, 248, 267, 277,282, 287, 293, 297, 298, 303, 310, 312, 313, 315, 318, 322: n = A,T,C or G
  misc_feature 328, 330, 352, 357, 361, 362, 371, 384, 401, 421, 425, 427,430, 443, 444, 452, 459, 462, 477, 499, 502, 507, 533, 539,540, 545, 548, 551, 554, 555, 589, 599, 603, 610, 611, 622,627, 633, 635, 637, 653, 659, 663, 665, 688, 699, 705: n = A,T,C or G
  misc_feature 713, 720, 721, 723, 724, 735, 736, 737, 742, 747, 751, 760,772, 773, 774, 778, 784, 788, 789, 793, 795, 796, 797, 800: n = A,T,C or G
cnaanttttctaatgctgnttctatncngnatnctnggctanccnacnacnnnggatncnaattggcacgaggcttcatgagagactgacngctatnacgggtcgtggcacttaangaggactnttctggccccagngtgtgctgatgacacatacacacctgacaatagctngngtntnctctgnncctttnnctctgtnaccancatncacnngatctaaaaccctttctnaatatctatcntggntcatccttggccatgcagngtcagagctntatgnacttnattacncttnnccttngaacttntnntnagntacngataangngctatctttcagctggatgatnaacgntttnntctgtacgnacatggacgatgntttcctcaaacctctanaactatagaccagtcactgntacntntanccagacatgattnnatacatcnatgagtnagnacaaaccacaactanaatgctgtgaaaaaaatgctgnatntgatnaaatatgaaatgctatcgctatattncttccnncatangcngcngtnntcatttagcaacaacaattgcatccattaaaatntttttaaggnacantttgganngtcccccaatnttggngaaatncnanggccccaaaatgccangtgccnttananaccccggggaccccaaccttttngaaaagcgttncacaanaaggggtnaaagttnnanncgccttggccnnnaaaanaaacngggnaataacctnggttaaccctgnnntttnaaactngggnntttncnnnttnaaaaaaaaa

SEQ ID NO: 5002 - DNA, 834 bp, Homo sapiens
  misc_feature 5, 12, 21, 31, 33, 46, 47, 52, 54, 55, 56, 65, 68, 71, 73,94, 99, 104, 107, 125, 129, 147, 157, 158, 162, 169, 188,193, 195, 201, 208, 209, 210, 213, 216, 217, 222, 238, 241,243, 314, 315, 320, 323, 324, 325, 346, 347, 352, 355: n = A,T,C or G
  misc_feature 363, 385, 396, 402, 403, 410, 411, 412, 422, 428, 438, 441,446, 450, 471, 473, 474, 476, 477, 479, 481, 490, 494, 496,505, 510, 514, 515, 528, 541, 542, 543, 544, 551, 566, 573,581, 582, 588, 591, 592, 597, 606, 613, 614, 620, 621: n = A,T,C or G
  misc_feature 623, 629, 630, 637, 645, 650, 654, 656, 657, 662, 673, 675,677, 681, 684, 687, 696, 706, 708, 709, 712, 715, 717, 721,722, 731, 733, 748, 749, 750, 763, 779, 784, 789, 791, 796,800, 806, 812, 817, 828, 832: n = A,T,C or G
ctaanagtttcntaatgcttncttctaatancntaattactcaggnngctcnannnaacaggcgntgnggncnctcaccgactcctccctggtncacangcttntgnggggccaccaagcccctnctgngccccctcccatccatantgcatggcgnntggngcccccntggctccaagacagatcangcccnancttgcntctaccnnnatnccnnctganaacgtgccactgaatnaantntgggaaaccagaaaagatatacattaatttaagaatcatttactatttaaatgagacaatcaatattattnnagaancannnatcccaaatgagacaatcatnnttaanttncaagatancagaagtgaccaatgtcatttnacaacacctanaagatnnactggtnnntcaggtaaangtaganttttactganaancctgnatgnatttgacttgtgcttttgtancnntnntntnccttacttntttngntttccatancctantaannatgcattactttnactggatataagnnnnatccttnaaaagggtctttctnttagctntacaggtnnacaatnatnnctggnctcttgacncatttgnnacttanntnccttanngcttttnagtataantttcnaaancnnggccntttagcttttncntnaggncanttnacccccttnttaaaaaaangnntanttncngccnnaaatttggncntgaatctttctccannntcggcttttccantatttttataaagccntgganagggncncaaantggntttggncttaanttccntatatacttanctcncg

SEQ ID NO: 5003 - DNA, 814 bp, Homo sapiens
  misc_feature 1, 2, 3, 19, 24, 38, 53, 62, 63, 67, 71, 73, 76, 83, 373,385, 630, 636, 687, 703, 756, 764, 772, 778, 781, 788, 796,810: n = A,T,C or G
nnncctttggaacctcacngaaanccttccttctaatnctggcacgcttgganatcgaactnnctcnaaananatnggtttgnggcctggggcccttctagcctgagctggtgacctgggcatctgcaccctaaccccagctgaccgagtcagatctttgtccagtgttctgaagatcaaatgccgtgcccttttgcaatataacaccagctgcttttagtccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccanaagaagtgccanaagagacagtagtctgcatacatcgctgcaggccacagagcacttgggttggaagagagaagatgaaagggacatccttggggctgtgcccgtgagttttgctggcataggtgacagggtgtgtctcttgacagtggtaaatcgggttttcagagtttggtcaccaaaaatccaaaatacccccaatgaaattggacgcagcaatcttgaaatcatctctaagctttgctttcactttgtgaacnagttgnccttctattgatcccaaaagaaagttttctaagttaaaaggaaattcctangtgaatcaaccccacnagggaaaaacccacttgccacaataaggaaggccgggttcccccttggtgccnggtttaangggccccntgtaanggnaaacacnaccggggnaccttttttttttntaat

SEQ ID NO: 5004 - DNA, 775 bp, Homo sapiens
  misc_feature 2, 3, 4, 5, 14, 15, 28, 30, 32, 42, 48, 56, 83, 119, 234,236, 249, 404, 425, 487, 501, 566, 569, 575, 576, 586, 592,594, 598, 630, 678, 681, 684, 687, 688, 700, 714, 717, 727,730, 733, 746, 750, 763, 768, 770: n = A,T,C or G
tnnnnttttgaaanntttcctaatgcantngngaaacttctnaaaccntggcaatngctctttctgcaggcagcccagcgatncgaattcggcacgaggttagagtaagtaaagatatngttaagaaaagtacttaaatccaagaaagagagtcaacaaatatttataccattctctcattaagtgacactggttccataaatttaaagacagcggttcacccatatctatggntntgcattccatggnttcagttaccacagtcagcctctgtctgaaaatattacatggaaaattccagaaataaacaattcataagttttaagttgcatgccgttctgagtagcttgatgaaatcttacaccatccccctccatccaggctagtacatgactcatcccctngtccagcatatccaacactgnctatgctacccgcccattagtcacttagtagccaactcggttatcagatcgactgtcatggnatcatagtgcttgngttcaggtaacctttatcttacttaatagtgaccccaaatgcaagaatgacataatggtataacnggnctattnnatcattaggnaatggnantagnctcttactgggcctaaattataaattaaatcnatcatgggcatatatttagaggaaaaaaccatgggggacgtaggggtnggnccnatnngggggtcaaaanatccactgggaagnctnaaaaacatanggnccngaggaaaaggaangagncccggaaaccttnaattntncttaa

SEQ ID NO: 5005 - DNA, 817 bp, Homo sapiens
  misc_feature 3, 4, 5, 38, 46, 53, 67, 70, 72, 76, 77, 83, 420, 461, 514,586, 596, 604, 630, 635, 642, 660, 673, 709, 724, 730, 815: n = A,T,C or G
gtnnnctttctaatggcttggctactcgccttctaatnttctaatncttggcnactcgttctttctncangnaccnntcgttncgaattcggcacgagggaagggaggtttaaggaagagactgtggacagaggtgttagggaaggtgtcagagaaggttaaggagccaacatggatcatgggggtggtacagtgttgccagggctggggaggattggctgcagtgtggggtacccagccgctgccatgtggagagggacctgtcactcctgctgtgaactctcccttcttctgccctctgacctcctgctggtgcctcccattggctaaacacagttgatggccagtgcactggggagctgttcttggagcccacaggcatctgcttcttggcacagagcagacaatggattgagtccnggagggaagggaactagagaatacccaagtcccaaccccangcgtttgctgaatgtgtctaatcttccttttctacaaacccatctgacctctncccctcctctccacgccaagctaggtcccaattcttcctcaagctccactccttccaccctgtaatcttttntatcaccctnccctcctnaacaccttgggtccggctttacaagnttccnttcccgngacttagccctttccccnacctttgcccaancaaattttacttctttaaaaaaaggtggcttggaancctaaaagacattantccaanggttaaaggcctccctttttccttttatccccaaatcaaaaacccttttaaggctcttttttcattcaaaattttaaaaaccccnct

SEQ ID NO: 5006 - DNA, 871 bp, Homo sapiens
  misc_feature 8, 12, 13, 14, 17, 19, 26, 40, 45, 64, 66, 67, 68, 80, 82,85, 106, 120, 135, 165, 166, 167, 176, 189, 191, 194, 197,213, 217, 226, 235, 236, 248, 256, 260, 264, 274, 275, 284,285, 291, 298, 317, 326, 330, 332, 333, 340, 343, 346: n = A,T,C or G
  misc_feature 348, 362, 363, 364, 388, 395, 399, 403, 407, 414, 420, 424,425, 431, 432, 434, 437, 448, 456, 458, 460, 465, 466, 468,475, 478, 485, 489, 493, 497, 507, 514, 515, 517, 524, 531,536, 540, 541, 542, 545, 551, 555, 566, 575, 579, 584: n = A,T,C or G
  misc_feature 586, 588, 595, 610, 612, 613, 616, 617, 625, 628, 631, 634,637, 640, 641, 643, 658, 661, 669, 673, 675, 682, 685, 688,690, 691, 695, 697, 701, 705, 710, 722, 728, 742, 743, 745,746, 749, 759, 763, 765, 766, 774, 775, 777, 778, 791: n = A,T,C or G
  misc_feature 804, 808, 813, 819, 827, 828, 832, 833, 837, 841, 849, 853,854, 855, 859, 861: n = A,T,C or G
ttttcccnaaannngcntnggctacncgtctttcaaaatnttcanatcccttggcaactcgccncnnnacgcacaagaantntgngttggcgttcttgaggagctnagccttcgctcctnaggatcacaggcttncatgttgaagctggcagtgctagaggctannncctatctgngtgacagcatttnanatntancaggaccgactttgangttnccaaatatntataggcannctgtaaatcatnacaccgtntgcnatanctctcttcannctctgtctnnctcttntaactgnagcaaaagttctttctcangcaacaacnttcntnntatcctnagnagncnatactgtgttcctnnncatgttcggcgaacgctattacgnctgactncacncacncacntgacatngacccntatnncaaacnngntanggaaaagctanatgtctgnangntgctnncngcttgangantgctaanagcncttnagancatccattanctttctnnangcttgangttttanggctnatannnctntggaanttangtattctgggnatgaccctncatngcttntnanactattnaatccagacctcgancnntanncctggaangtnccncanccnaannantatccttggggaacnggnggtactgnactntngatcaanccnaananntggnantganccanttggnaaattgaatccntaatcntcccctgggcaacnnannggnggcttgcttnaaananntggaaccnnannatgcccgtcaaancttccctaattancctnggtanactgcnactggcanntctnnatanggcnaattccanaagnnntgantnttattcaccc

SEQ ID NO: 5007 - DNA, 829 bp, Homo sapiens
  misc_feature 18, 19, 20, 22, 23, 42, 53, 65, 68, 122, 524, 577, 631, 675,693, 708, 717, 719, 722, 723, 738, 743, 774, 783, 797, 804,815, 817, 828: n = A,T,C or G
tttctaaatggcttgggnnncnnccttgaccaccgaaaacgnttggcaacttnctctttctgcangancccatcgattcgaattcggcacgagataatttttttagtttgtttttgagactnctctgtcacccaggctgagtacagtggcatgatcatggctcacagcagcctctcaacctccctgggctcaggtgatcctcccacctcagcctcctgagtagctggtaccacaggtgtgtacctggttaattttttggtgtttcttatagaggcaggatctccttatgttacccacaccggtctcaaacttctggactttaggaatcctcctgccccggcctctcaaagggctggacaggtgtgagccaccaggcctggccccaagcttgtacagcagcatctgccccattatacctctggcactcaggcagtgatgcctcttggccctctggcaaagggagcacacttccgttagttttgtatttgtatggacttttatacctatgacgtttctggttctgntaatcttgtttttccgactgattgaaactttcatctctggtatcaattggggngttttcttagaaaaaagcttgtggtgaaaggggggcaaaaaaaaagaaaccaangttctgaaagttcacctctttgaattgcaacccacccttggtanaaagaatgggaatcaatnggaatgccttggccnaatttttgnanccnntttttttggcaaagnaaaangggatccaaaaagtggaaaccgggaaaaaanccttggggnaaaccctttgggtngggaaanggggttgggtngnacccaattccna

SEQ ID NO: 5008 - DNA, 797 bp, Homo sapiens
  misc_feature 3, 19, 25, 26, 27, 30, 31, 33, 46, 52, 72, 75, 81, 82, 83,475, 675, 789: n = A,T,C or G
tcnccctttccaaaaagcnttgggnnncgnncnttctaactttccnaatacntgggcaactcgctctttctncangcagcnnntcgttggcgaattcggcacgagactttcaacatttcatggatagaataagtaatggtgggttagaagaaggaaaacctgttgatctagttcttagctgtgtggacaattttgaagctcgaatgacaataaatacagcttgtaatgaacttggacaaacatggatggaatctggggtcagtgaaaatgcagtttcagggcatatacagcttataattcctggagaatctgcttgttttgcgtgtgctccaccacttgtagttgctgcaaatattgatgaaaagactctgaaacgagaaggtgtttgtgcagccagtcttcctaccactatgggtgtggttgctgggatcttagtacaaaacgtgttaaagtttctgttaaattttggtactgntagtttttaccttggatacaatgcaatgcaggatttttttcctactatgtccatgaagccaaatcctcaatgtgatgacagaaattgcaggaagcagcaggaggaatataagaaaaaggtagcagcactgcctaaacaaagaaggtatacaaggaagaggaagagataatccatgaagataatgaaatggggtattgaanctgggatctgaggttcaagaagaaggactggaaaaaatttttcaaggcccagttccagactttaccttgaagggaattaccaaggggcattacacaaatttccaaaaaaagcangaagaatt

SEQ ID NO: 5009 - DNA, 765 bp, Homo sapiens
  misc_feature 2, 3, 17, 18, 19, 40, 42, 46, 642, 707, 741: n = A,T,C or G
tnnctttctaatgtttnnnaatgctggtaccctttcaaancncttngcgccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagattctaacatttctgggctctctgacccctgcgctagactgtggaaagggagtattattatagtatacaacactgctgttgccttattagttataacatgataggtgctgaattgtgattcacaatttaaaaacactgtaatccaaactttttttttaactgtagatcatgcatgtgattgtaaatgtaaatttgtacaatgttgttatggtagagaaacacacatgccttaaaatttaaaaagcagggcccaaagcttattaagtttaaattaagggtatgtttcaagtttgtattaatttgtaataactctgnttaagaaaaaatcaaaggaccatgatttatgaaactaaatgtgacataattttccagtgacttgntgatgtgaaatcagaccacggaccttcagtttgnacctattggctttggaatcaaccg

SEQ ID NO: 5010 - DNA, 776 bp, Homo sapiens
  misc_feature 1, 19, 38, 43, 46, 47, 49, 51, 56, 57, 60, 99, 106, 274,299, 471, 586, 615, 639, 678, 688, 747, 748, 753, 760: n = A,T,C or G
ntctttctaattacttatntgtcatggaactcccactntctcnacnnancnaggcnntgncgaattcggcacgaggcaagagatttcacagacctgatngtttttnatgaagatcgtaaaaccccaaatggacttattttgagtcacttgccaaatggcccaactgctcattttaaaatgagcagtgttcgtcttcgtaaagaaattaagagaagaggcaaggaccccacagaacacatacctgaaataattctgaataattttacaacacggntgggtcattcaattggacgtatgtntgcatctctctttcctcataatcctcaatttatcggaaggcaggttgccacattccacaatcaacgggattacatattcttcagatttcacagatacatattcaggagtgaaaagaaagtgggaattcaggaacttggaccacgttttaccttaaaattaaggtctcttcanaaaggaacctttgattctaaatatggagagtatgaatgggtcccttaagcccccgggaaatggatacaagtagaagaaaaattccatttattaaagtctgacagaatgatattgnatttgctgaacaagcctatctttgaactntgggaaaaattattttttgacagnaatactcttttcaaaaatgggcatttgcttgatttccanaaacctttcncgttctgggaccgaattacccaaatgcccatggaatttcccactggggggtttaatgtnnaaaantcccaantaaaaagtttttttcg

SEQ ID NO: 5011 - DNA, 741 bp, Homo sapiens
  misc_feature 2, 3, 631, 639: n = A,T,C or G
tnncttcaaactttcgctcttggctttttgcaggatcccatcgattcgaattcggcacgagagttttggatgagacttggtatggtccattctgggacaaaattcctctctctctctctctgcggacccgtgaaatctagaaaataagttatttgcttctaaaatacagtgatgggacagacataggatagacattcccatttcaaaagtgagaaattgggccaggtgcagtggctcacacctgtaaccccagcacctgtaatcctagctccccaggcggctgaggcaggaggattgcttgagcctgggagatcaaggttgtagtgagccatgattgcgccacctttattggaaacttttattccagttaccaataacacattcctcatttcctccagagacctcaccagaaacacctttaatattcatatttctagcagccttctgttcataacaatatatgcatcctgttaagatgataggagatttctctgcacctctcctctttgtgagcctgcagggacattccctttaatgtccatatttctaccagcagtctcttcaaggcagtctaggtttttcctaacatacacctcaaaattcttgcagctttggccaagcacagtgcctnacatctgnaatcctaacacttttgagaggccacatggacaagatgcttgagctcaggagttcaagaccagcccgggcaacatatgaaaccctgcctttaaaaaaatcaat

SEQ ID NO: 5012 - DNA, 789 bp, Homo sapiens
  misc_feature 2, 3, 4, 5, 6, 10, 11, 12, 13, 14, 15, 16, 27, 32, 33, 34,35, 36, 37, 38, 39, 40, 45, 49, 57, 71, 88, 561, 581, 616,649, 656, 659, 681, 712, 761, 762, 765, 787: n = A,T,C or G
gnnnnntttnnnnnnntttttggaaanccttnnnnnnnnntttcnaatncttgggcnactcgttctttctncaggcagcccatcgatncgcctttattcattttcactgttatccagaattccattatatgaatatgccataattttaaagttcacgttactattgttaagtgtttctaaactggaaattactccagacaatactatgagcacacctgtctgtggcttttgatgagcatctgaatgcaggccaaacttggcctgccaaacagtttctgccgttgtttgtaccagttcacactccctgccaaacagtttctgcaatgtttgtaccggttcacactcccacggcagcacatgaaagctttatttgctccatatcctctcaaatttagaaataattacaaacttatgtaaaagttaaaagtactatacaaataattttatgcctgaaagttgccaagttcatgccatattacttctaaatatgttagtgtgtgttttctacaaacaaggagattctcctgtgtaccagacagcagtcatcaaagtcagagaaantaacatcagtacattgctgncatctaatgcttactcctactcaaagtttcactantttgcttccaaaagtgtccttttatggcagganggatcanaantaatgtataggccaagcacaangccctggaatctggaaatcccagcacttttngggaaaaccaaataggaaggttgccttggaactcctgacttaaggcganncanccaacttaaaccttcccaaagngg

SEQ ID NO: 5013 - DNA, 728 bp, Homo sapiens
  misc_feature 656, 668: n = A,T,C or G
gcttggctcttgttctttttgcaggatcccatcgattcgaattcggcacgaggttttggtactaaaggccgagactgttgtggcgacggcgacctctacggcaacggcttaagctctcggaggagtggcagagtacgatctgaaggaggggcttctggttagcccaggttccatcataatgaatggatccaatatggcaaatacatcaccgagtgtaaaatccaaagaggaccaggggttaagtgggcacgatgaaaaggaaaacccatttgcagagtacatgtggatggagaatgaagaggatttcaacagacaggtggaggaggaactgcaggagcaagacttcttggaccgctgcttccaagagatgctggatgaagaagaccaagactggtttattccctcacgagacctgcctcaggccatgggacagttgcaacagcagttaaatggactgtcagtcagtgaaggtcatgattctgaagatattttgagcaaaagtaacctgaacccagatgccaaggagtttattccaggagagaagtactgagccgagaaagctttgaggaagacttgtctgtccccacatctggggatagtaatgcacaaaatggtggagcttaagaaggggatggggccggccaaggggtgcacancgggaaagggantggtggcttacaatactgggactctgagtactaatatgctcagtcttattctaaaaaaaa

SEQ ID NO: 5014 - DNA, 735 bp, Homo sapiens; identical to SEQ ID NO: 548
  misc_feature 14, 15, 28, 31, 33, 35, 38, 39, 44, 46, 576, 687, 691, 693,717, 734: n = A,T,C or G

SEQ ID NO: 5015 - DNA, 773 bp, Homo sapiens
  misc_feature 3, 6, 7, 14, 21, 90, 91, 159, 258, 410, 457, 476, 530, 535,572, 589, 607, 617, 626, 672, 681, 687, 698, 704, 714, 735,769, 772: n = A,T,C or G
tanacnnattggtntgatgcntggtgctgcctgcgctgccttaagaagctgagactcacacaagtgttaagagggtatctctggagacanngtagagatagaccctgttacgaatcagagggccagcactaagttttggattaagcagaaacccatctnaatcgattccgacctgctctgtgcctgtgaccttgctgaagagaaaagccccagtcacgcaatatttaaactcacgtatctaagccaatcacgactatnaacacctctactttgaatcggacgctgctacccgtcaatgaaattgtgctcaaggttaactacatcctggaatcgcgagctagcactgcccgggctgactactttgctcaaaaacaaagaaaactgaacagacgtcgagcttcagcttccanaaggagaaagaaaatccgggcagcagttgacactggccttcagcctnaatctgttcccgtagcttnagaaccttgcctgccagggccaagtgccctagagcccaccccggtgtcctgaantcctngggggggaggccagccccctgggcttactgggcacanggcaagtggggctctcnggggaaaggtgtctgggngcccccttangaagggaancgctggggacatttgccattgggaccggaaagtcttggtttggcanttggctttngataanccatgctttgngggtcnagaccacccncctaaaggagccacgtggccngccaagccaccttaattgcctggcacctggcccnggng

SEQ ID NO: 5016 - DNA, 797 bp, Homo sapiens
  misc_feature 2, 3, 4, 5, 14, 16, 17, 18, 41, 48, 52, 54, 587, 599, 619,720, 740, 746, 751, 757: n = A,T,C or G
tnnnngtttcctantnnntgggctactcgttctttccgcangatcccntcgntncgaattcggcacgagaggcagtgactgccttcggctttttttctgctgactaagatctcctatagagagctacaacaatgcccaaaagaaaggctgcaggtcaaggtgatatgaggcaggagcccaaagagaagatctgccaggttgtctgctatgcttgtgcccagttacacccagaagtgaaagccctaaaaagaacatcaagttcaagggaaaatgaaagacaaaaaagtgatatgatggaagaaaacatagatacaagtgcccaagcagttgctgaaaccaagcaaggaagcagttgttgaaagaagactacaatgaaaatgctaaaaatggagaagccaaaattcagaggcaccagcttctgaaaaagaaattgtggaagtaaaagaagaaaaatattgaagatgccacagaaaagggaggagaaaagaaagaaccagtggcagccagaagtaaaaaatgaagaagaagatcagaaagaagatgaagaagatcaaaacgaagagaaaggggaactggaaaagaagacnaagatgaaaaangggaagaagatggaaaagangattaaaatggaaatgagaaaggagaagatgccaaagagaaagaagattggaaaaaaggtgaagacggaaaggaaatggagaagatggaaaagagaaaggngaaagatgaaaaagaggaanaagacngaaangaaacnggagatggaaagagaatgaagatggaaagagaaggagttt

SEQ ID NO: 5017 - DNA, 813 bp, Homo sapiens
  misc_feature 2, 10, 11, 13, 14, 18, 28, 44, 475, 522, 564, 576, 606, 636,684, 689, 692, 740, 750, 775, 780, 812: n = A,T,C or G
tntctctacnnanntcgngaacccttgntcccacgaccctcgtncgaattcgggcacgaggtgtgttctgtgggagggtgtctgtggtgatgtgactatcagggtgggcctgtgctggggatggggcaggcctgggtctggagaggattttgtgtgaaagtaaatggggtgtttgaggcgtatgggtggctgttggtgtggggaggcatcttgtgtatggctgttgggaacagcaaccaaaaggtgctttttggttttatttgagatcaagattgtgtttccgcttaattactagtttgtggtctatatcatagaagttatttcccaccccattttatcttgacaacccgtgtttgcatttctgtaaaacttctacaacttctggtgtcaagaactgtccagaagatggtactgttaactggtatttcctttgatgttttgattttgaaagtttactctcatgcaaatgtttcangcgtacatacataggcagaaagcaaatttttaggtgatttgtctgtntcttggatgaaatttaaagcaagctttaatggtctgacttgntcatttgaaatncaaaaaaagtaagtgaaatttaatggtttngcattaacctaaaggaaatcttgaagattnatggttgaaggaaattggtatgggccatgccctttggtggaaaccccngaaantcntttttaaagtttaaaaattgaaaaaaagggtttttaaatttgctttgnggccgtgttntaaaattgggaccccccatttttanaaatnattttttttcccgtcttcccttttaccaaacna

SEQ ID NO: 5018 - DNA, 786 bp, Homo sapiens
  misc_feature 3, 4, 5, 6, 7, 419, 469, 588, 679, 686, 697, 762, 768: n = A,T,C or G
gtnnnnnttttctaatagcttgggatactcgttctttccgcaggatcccatcgattcgaattcggcacgaggttctcaggccttccaggtagtccccttcctggacttaagagtgcaaactcttctctgtggttctagccttgggcagaattatatcccagagaccacagagcaactgtcaagctgcttaccccctcacccagggctacagcctgtgcccagccctctaatttgtgcctctcttgtgttgggggtggtgggggttattcctttccctttcctgctctggcctccttgaaagttcagagtacccagtacaagtcagctttaaagtacagcttttagtgtttcctgggttgtttctctggggctttagtgagggacctttgccctctggtttttcttgcctcctggtttanggagcatctcacacttgttagtatctggttgttgggccagcccgtgcctnctctagatctggagccaggccaggcaggggccacgtgtgggccagtcagccactacaagattttgctaagctttgggctgttggcagcatcttggacctcatgcctgggcctgaatgangctctttcttaagtggttttacaaagtttgggttttatttatggagtgacttaccccttccattcagagcagcccacccagccagcccttnaaccttntgggctcctgntgcttaaaggcaaaccgcctggttgggctccaccctgtgcattgggaacccaaccacccatgctnaccggnatttttcctcataaaagt

SEQ ID NO: 5019 - DNA, 785 bp, Homo sapiens
  misc_feature 10, 15, 25, 40, 632, 638, 665, 670, 690, 701, 708, 709, 733,734, 736, 745, 753, 766, 768, 770, 772: n = A,T,C or G
tctaatgttngaaanccttgttctngaccatcccgggctnatgcttgggcacgagagatgttcttatccccaagagctgtataattccagacagaggaggcaggcagacacctctatagaggacttagaaacgactgttgtgagacacattcagtgctcaggatggcaagtgtagtataccgttagaaagaacattcctttggggtgtggcctaggaagttttccagatttttcactagcgtacatctaaggaaaaccgtaaacacagagctgccctttattcctcccacaggaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaaacaatgcccagaccatgcctggtgaagttgaacagcaccctggggacagcaacatacatggcacctgaagtcatcactcgtgcccaaagaaagggccatgggcgttncggccnacatctggagtctggggtgtgttggcntaganatggggactggccaaaagcncttggcatgantattgannccacctttcaaattatgtataaanncnggggatggnacctaaanccccccaatcccngnananaattaaacccctt

SEQ ID NO: 5020 - DNA, 848 bp, Homo sapiens
  misc_feature 2, 3, 4, 5, 8, 9, 10, 11, 12, 13, 15, 18, 20, 21, 22, 23,24, 29, 30, 34, 38, 44, 47, 48, 51, 56, 57, 61, 64, 72,77, 83, 84, 87, 89, 92, 94, 99, 100, 185, 221, 322, 383,501, 507, 528, 529, 535, 547, 563, 568, 601, 625, 626, 627: n = A,T,C or G
  misc_feature 630, 638, 651, 658, 674, 692, 695, 704, 707, 714, 715, 721,733, 735, 740, 742, 763, 767, 779, 792, 803, 807, 815, 832,834, 835, 837, 839, 842, 843, 846, 847: n = A,T,C or G
cnnnncgnnnnnncnacnannnnnccggnnaacnttcnaggccnttnnaantcccnnttcnaangcttggcnatcgnctttcnncangnacncngcgtnncggttggagaaaccaagctgaccaaaacatggtccccaccttttggagcttacagtctgttctggggaacagagattcagccagnagtcaagaaacactggatgccagctagattatctgntctgtgctttggtgtctataagtacatatgtggatatgggttcattttatccctaaacttagtaccaaaccagcatttaatatctaattataaatctaatntggcctaaactttattattgcacactgcctgaacaaaacctatttgtctctatgtaaattntttcctcatggaacaagggtgtgaaatgaaaatattttaggatttattcaaaaacagactattctgttttcagcttcagaattgttctttgaatcctaaggaacctctgtcaacagtngaggcngctgttgaaaagaaagaaganngaggcngaaatctctcanggagaattatttcccnttctnttctatttcagatacctggaggggtggggagangtaagaattgtaggggaggatcannnctnggggaaanctgtgaccagctnaatgaangaatgatgattgaaanaaccctcttgcatctctnagntacccttcngcntcccttnnacccantggtataaaatntngggcntngggcaaccactgaccatttgncaangccttaattggnccccaaatatccnacactggtccnaganccttaaangtctccagcacccgacncnntnanaanncgnnc

SEQ ID NO: 5021 - DNA, 836 bp, Homo sapiens
  misc_feature 8, 10, 11, 18, 19, 20, 24, 25, 39, 40, 45, 50, 56, 60, 64,65, 67, 69, 73, 74, 75, 78, 82, 277, 312, 317, 346, 407,411, 415, 417, 425, 426, 427, 438, 443, 447, 448, 475, 483,487, 492, 497, 498, 511, 514, 516, 519, 530, 531, 532: n = A,T,C or G
  misc_feature 539, 550, 565, 568, 604, 610, 618, 623, 624, 628, 657, 682,723, 736, 740, 746, 750, 761, 771, 785, 788, 794, 797, 804,827, 830, 833, 835: n = A,T,C or G
ttctaaananntttgggnnngtgnncttctaatttttcnnatacntggcnactcgnactntctnnangnagcnnntgngttngcgaattcggcacgtagctgagcacctcgtctctataaaaacaaaacaacaaaacataaacaacaacaacaaaaaactatgtgataggcattgtgttaggcactagaaaatagtgctcaaacaacaacaacaacaacaaaacatgattcttgtctcaaagaatgcacaatgttggggaaagacaactaaaaagtnataaaacataaagtttgaaggatattatgatagangaatnataggatacgttcaatcatttgaaattcntgaatgtcatccttttgggtggagcaccgagagggtttgtgaaaaacttcccacataaagnaatntaancnatgcattnnntaaaaatactnatgtntttnnaaaaatgaatatggcaaatgaactgtnctgcctancatntgatnaaggnntcacttttccatnccnanggnattagcttatnnnacttcanacatttcaaangtggaaaagactcancanattcaaagcaaccattcttgtaaagtttaatttccntgtgantcgttcanaattnnaatncttgggaaaaatgaacctgcaataagaanaaaaattggtttcactttttcaatnggggttaaaggtttctggacttcacccaaagtggctttttncaaatgggggggncccntaaaancaantatttaatganggaacttatntttgcggtttagcnctngggggnatncttttgncaaaaggtttaaaaagccaattnggnaangnt

SEQ ID NO: 5022 - DNA, 775 bp, Homo sapiens
  misc_feature 3, 4, 9, 10, 11, 15, 36, 42, 690, 753, 756: n = A,T,C or G
ctnnctttnnncctnaagtgaaatcgttcggtttancctttngcaggatcccatcgattcgaattcggcacgagcttagttccacaaataattattgatttgtttaagcgtgatgtatgtgcttgctcaaggaattagaagatgagtatgacaaagctcattccctcagggagttgagtgtttcagagggatgaagtaaaagaagattttaaaactacaagtagagtgtaagaagtatcacgagaaacatcaacaaagggctgaggatagaaggtgataagtctcaagtatctcaagatattcagcagtgaatcttaacataaatttgcttttaggggaagaatttcaagcatattgataggtcttaaattttctagtctctctgggatagtaggaaggagaatgatttttaaaaagttgattatgtagcatggagtttggggactagtaaaaattttattgaaattatttgggaattgttttacagttgtttttagtggaggttgtatttctgaaaatattgcattttagtgtgatgatttactaaagaagtagcagggacttattctaaggtaggagatagaaaaactaataagtaaaaatctgctagcaactttaaatggctgtcaaactttttttaatgattaagtgctaatggggggcagatggaaattgtaaagccagtgccanaacaattgaggtatagaagtttttttctgtcaattgctctacttttgaaagagaagaaaattnganggcaaaatttaagtcattt

SEQ ID NO: 5023 - DNA, 816 bp, Homo sapiens
  misc_feature 2, 3, 5, 9, 11, 17, 18, 27, 34, 38, 40, 41, 48, 55, 581,620, 712, 718, 719, 721, 724, 749, 754, 762, 765, 771, 792,798, 809, 810: n = A,T,C or G
tnncngttncntattanntgggtaatngcttggntctngnnctttctncaagatnccatcgattcgcagcgatagcccaaaggctctgcagtattccctccaatggccaaggattccgtgtgtcatctgcaggagtgagtaggcctgctgtatttcttgtaactgctgggtgttacaaaataagttacaatgttttacactttaaaaaaaaaaaacagaaggaacatttgctttattggttacttactagtttagcctctaggttatggcacagcatgctaaaaaatcatgtgtttaaaagtaaatgttggtaaaatgctggcatctggtcctattgtgttgatgcattttcacttctgtggtcataggaaatggactggtctaaagagagtgaggcacaacacaagcagggcattagtttgaataggaagtcaatcatatttggttttatggcctggtgtattttgggtttaagataaaatagggaaaaatgtcagaaatgatccctatgcatttatttcatggatcccttaatttcatgggcatgcctaataatgatctatgttctaactggagcttanggcttattttagatattgggagtgtagcttttatttacnagatggattttatctttcaacatttgcattttgatcaacttttgtaatattcaccgtgtatttaaaaatattggtgcacttaaaatgttttncccctnngnttnctttttatattgggtccaaaggcantttantcaagcanctntttggnaatggaaactcaatgttaaanttggcnttgggttcaannggaaat

SEQ ID NO: 5024 - DNA, 746 bp, Homo sapiens
  misc_feature 2, 3, 4, 25, 58, 67, 77, 79, 87, 91, 92, 99, 101, 121, 150,169, 194, 197, 203, 206, 211, 231, 235, 237, 238, 251, 263,264, 265, 267, 269, 270, 272, 277, 278, 281, 284, 299, 306,312, 322, 353, 361, 369, 375, 387, 392, 403, 426, 429: n = A,T,C or G
  misc_feature 437, 438, 443, 447, 448, 453, 455, 457, 464, 472, 473, 477,488, 498, 511, 514, 535, 536, 546, 549, 552, 563, 574, 580,581, 584, 585, 590, 591, 593, 596, 598, 600, 606, 607, 608,624, 627, 631, 637, 642, 644, 645, 659, 668, 669, 674: n = A,T,C or G
  misc_feature 692, 698, 739, 744: n = A,T,C or G
tnnnctttctaatgcttggctactngtctttccgcaggatccctcgattcgaatccgncacgagggnggctgccgtntntggctttngctnnaagggcnangttcgggaaccgttccacancatcctgatgtcctgaagggactcactgngcccattgccagcagtcgncattccctaaggtgctgtgatccanaangcgggntgngaganattggggccctaccctactnactntnncccacaccatgtntaaaatactcannntntnnangggcnnaanacngctatctggaccccnatcaggnctgggnaacactgttnaaaagtcccctttcatgttggccccatgaanagaccacngaccacgnggtacntggagctcgatntcganagttctcaagngggaactgaggggacttccactnctntgggactnnggtcnactnncgtgnanancgggacnactacatnntggnctctttctgancaccaccctnttttcacgatggnacntgtagaagggaaatgctgganngatccatccntcntgntctcttcttcngccctaaatgnctgcanncanntccgnncngtncntnacctgnnnggtccttttggccccngcnttgncatgantaccngnntacctgcatcctancctgacacnntttgnctctatcgctgcagtganggaaangtgggtgggtatttttccccaataaagactttagacccctnttttnct

SEQ ID NO: 5025 - DNA, 865 bp, Homo sapiens
  misc_feature 4, 5, 52, 56, 133, 178, 186, 249, 259, 284, 291, 365, 372,378, 391, 407, 420, 474, 483, 491, 494, 534, 563, 566, 581,582, 588, 595, 609, 623, 628, 636, 638, 647, 656, 658, 662,667, 670, 676, 677, 678, 682, 683, 685, 693, 697, 699: n = A,T,C or G
  misc_feature 701, 706, 709, 716, 719, 725, 730, 735, 738, 739, 740, 743,756, 758, 759, 762, 764, 766, 767, 768, 769, 781, 782, 784,786, 790, 798, 807, 811, 813, 816, 824, 827, 828, 833, 836,848, 852, 854, 860, 861, 862: n = A,T,C or G
cgtnncccttttcaaatgcccttggctactcgcctttacgcaggatcccatngatncgaattcggcacgagccaacctgctgtccctcaagccccgcttttaccagcctgtggagttcaggaggcgagacatnctggcctcctttgagaactgatgggatctaccccctgtccacgcnggacagtntctcagaactgggtcatagaccacctgtgttaccaacagccagatacctaatccctgagcctnctttgggaangtctggggccgagggtctgggaatntgctttntttttttgggacagagtctcattctgtcactgcactccagcctgggtaacagatcgagactcccatctcaaganaaaaaanaaggancagggcatggtgntagtgtgactggggtnccagctacttcanaagctgaggtgggaggatcccttgagccctgtaagcggaggctacagtgacctntgatgccantgaacttncgnctatgcaacagaacctgtcttaaaaaaaaaagtaattaanaattttaaaattcaaaagtgggactattnatnggttaacagaactgnntttaanaatgccntaaaaatggtggcnccattttttttaanaaccnttgctggntnttattggtnaaaaattgnantggntcttnccntggccnnngtcnntnaaaaattntttngnangggcnagnttttatngtnaattgnctcgnaaatntgnnnaanatttcattcccanannaangntnnnnttcccttaaaanntngnactnaattgccnttactgttncccntnaantttaaacnacnnatttnttntaaaaccttttnaaangnaacccnnnccc

SEQ ID NO: 5026 - DNA, 989 bp, Homo sapiens; identical to SEQ ID NO: 546
  misc_feature 2, 15, 30, 32, 35, 43, 47, 49, 103, 105, 246, 253, 256, 267,276, 282, 287, 288, 290, 292, 297, 300, 301, 304, 306, 307,315, 317, 328, 338, 340, 342, 345, 347, 356, 364, 366, 368,375, 376, 379, 380, 381, 382, 384, 392, 394, 397: n = A,T,C or G
  misc_feature 400, 401, 403, 408, 422, 423, 425, 427, 428, 431, 432, 436,443, 447, 465, 470, 471, 479, 484, 497, 502, 511, 519, 521,524, 533, 541, 546, 551, 562, 569, 572, 579, 580, 583, 588,597, 604, 606, 607, 609, 611, 613, 615, 618, 620, 625: n = A,T,C or G
  misc_feature 629, 635, 636, 637, 640, 643, 644, 645, 646, 651, 654, 655,657, 658, 668, 669, 678, 683, 689, 690, 691, 693, 697, 699,704, 713, 714, 717, 720, 732, 733, 741, 743, 744, 745, 747,748, 749, 756, 757, 759, 760, 761, 762, 765, 767, 769: n = A,T,C or G
  misc_feature 779, 780, 781, 783, 786, 790, 792, 796, 805, 808, 810, 812,815, 820, 833, 839, 840, 841, 844, 847, 851, 853, 854, 860,865, 869, 874, 884, 886, 887, 888, 892, 893, 900, 905, 907,915, 916, 920, 924, 927, 930, 931, 935, 940, 943, 946: n = A,T,C or G
  misc_feature 949, 952, 959, 960, 964, 966, 969, 978, 979, 984, 985, 987: n = A,T,C or G

SEQ ID NO: 5027 - DNA, 820 bp, Homo sapiens
  misc_feature 2, 3, 25, 33, 37, 44, 342, 344, 353, 371, 389, 396, 405,415, 427, 435, 450, 453, 467, 473, 476, 477, 482, 483, 491,500, 505, 517, 518, 522, 528, 544, 549, 558, 573, 580, 581,597, 600, 602, 608, 631, 632, 638, 645, 646, 663, 664: n = A,T,C or G
  misc_feature 670, 681, 682, 688, 693, 696, 697, 700, 704, 707, 710, 712,727, 747, 758, 764, 771, 787, 788, 791, 798, 803, 805, 806,809, 811, 812, 819, 820: n = A,T,C or G
tnncctttctaatggcttggctacnggcttctnaagnatccctngtttcgcagctatagcactaggcagccttgcatcctgggtgttgaaagtgcaggccattatcctcccctctgacctccaagatgttaggtggcctttctgtgcctcagttttatcatctgtaaattgggtatgattgtactagtgcctagtacataaggagtgctgcaaagattacatgagtgtctttaaagtccttacaacagtatctcacacatagtaagcatggcatgtggtagttactatcatttagtccctcttggagcaatggatattaaaattttaaagacagttgtctgntnaggattggncatgcagcctgaagtttnaaaacaaattgcacctgnctgtgtncatgggganactttttaangccctggacctnattagctnaatgggctgtggaantgnatggggccttttgnagggcnccnnttttnnaaaccccnaaattttanaaagnttaaccccaganncttnattctncattttaactggcctnttggnagatatatnggcagaagtttttanaagggtnnaaaagttttttttgcnccnanaaaaanggggcttaaacttttttaattcnngggtgnggcgccnnaatttttcaataaaaanntttcangaattattaannggggtnggatnaanngantttnttnttnanaaaggatttttaaanaatttggggggaagaacccnaattattaacngctaanttatttnatggcttccgactttnnaangtttttngaaanannccnanntttattnn

SEQ ID NO: 5028 - DNA, 810 bp, Homo sapiens
  misc_feature 2, 9, 21, 40, 43, 52, 105, 111, 134, 136, 150, 155, 158,176, 186, 200, 211, 216, 219, 231, 242, 253, 254, 268, 271,319, 321, 325, 366, 381, 533, 543, 558, 615, 616, 631, 637,652, 683, 710, 724, 728, 739, 747, 808: n = A,T,C or G
tnccctttnctaatgcttggnataccttggtttccaatgnttnccagggttncgtgcactccagcctacatgacagagtgagaccctgtctcaaaataataatantaatgnactgagactcagaaaagatgttngntcaaggttacaaanctcanacnggacagggcagcattggnaaccaaaatnggtctgactcctangctcatgctgnaaatnacngtgcaaggcttntactatctatntttttcctaanngaatgtctaaatgnacngatggttaacatattacgcagaatatgttaaacgtcaaatgaactgtntnaacnataaatgctggagagttgaagtggccaagaactcatgcccnaggtgatctgggaangcctcttgaacaaggtggaattatagctggtttttgaagaatccgaaaggtgcttagattgaaaggtgagacatgtacaggaatggtttctaagatgtcatattttatctctgtcctcatcttgactggcactaatgaacatcaaagatttnaacctaaatncattgagtgcccagnatgtgaagggccttatttatgtaggttttaaagctttttaacatactttaaaagaannggactggttaatctncactgncttagatccctttangaccccgggagcccggattggcccccagggngcccttttgggaaatgggcgttggtcngggaccaagtcttncacnttttgggaccntaccccanagaaaaaggaaatgggtccctttgggggaatttttgccaggaccttacaattcttgggaanaa

SEQ ID NO: 5029 - DNA, 820 bp, Homo sapiens
  misc_feature 2, 3, 4, 5, 15, 25, 38, 352, 369, 381, 394, 398, 400, 408,413, 414, 416, 418, 421, 422, 426, 431, 438, 440, 449, 455,459, 460, 464, 468, 471, 474, 477, 486, 487, 495, 499, 503,504, 505, 509, 510, 511, 517, 519, 522, 524, 535, 537: n = A,T,C or G
  misc_feature 539, 542, 547, 552, 560, 562, 563, 566, 567, 571, 577, 578,579, 580, 581, 586, 589, 591, 594, 596, 599, 602, 604, 605,606, 610, 612, 613, 616, 617, 624, 625, 632, 633, 636, 639,646, 647, 648, 649, 650, 655, 658, 663, 672, 673, 676: n = A,T,C or G
  misc_feature 678, 682, 694, 695, 707, 708, 710, 711, 712, 713, 738, 743,744, 750, 752, 758, 766, 769, 776, 781, 785, 792, 801, 804,805, 810, 811, 812: n = A,T,C or G
gnnnncttttgaaancccttttaancccttgctcttgntctttttgcaggatcccatcgattcgaattcggcacgaggcagaggcagggctagaatgttggacttcagatctcttacttctgtgtgctagtgcaccattcttagtccagcacagacaattctcaaacagattagcaaaccaccctcttgaaattgcaagaattgttaccatgtgatcaaggcatcataattaatgcaaaccctagtttctagttgggaaagagattaagatggagactttgtagtaaaagatggacatatattttattcacatagcttatttattttgaatgaaagaccaagcaaactctanccttggcctgtcctgangaaggtgatctntgaaataaatgcnctgnanaatttggngacanngngnctnncctntgatntatctgntnttatccaanggttcnaatnntgtncctnttnatnccntattccctnnaatttttnttgnaacnnncccnnnatttcntnatngncccttttcttncntnacnccttntaccntttatttntnnaanncccnttttcnnnnncaatnctngntcntnaantcntnnncttntnnttnncttttannccccttnnccnttnccccctnnnnnttaanacntcctncttatttanntcntncctnttttcttctccnntttctttaactnntnnnncttccacttctttaccttatatacnttaanntctctntngtattntaaactcnttntatcttnccctntctnctaaatncatcctcanatnnttagnnnctcaacct

SEQ ID NO: 5030 - DNA, 847 bp, Homo sapiens
  misc_feature 1, 2, 3, 4, 5, 9, 11, 15, 35, 41, 102, 103, 117, 321, 384,451, 528, 549, 567, 570, 602, 615, 625, 628, 630, 632, 638,639, 642, 644, 648, 649, 650, 655, 656, 658, 662, 663, 664,665, 667, 671, 672, 673, 674, 675, 676, 679, 680, 681: n = A,T,C or G
  misc_feature 682, 684, 685, 687, 688, 689, 690, 692, 693, 694, 695, 696,697, 698, 699, 700, 702, 706, 707, 708, 710, 711, 712, 713,714, 716, 717, 719, 720, 722, 723, 724, 726, 727, 728, 729,731, 734, 738, 739, 740, 741, 742, 744, 746, 747, 748: n = A,T,C or G
  misc_feature 749, 750, 751, 752, 753, 754, 755, 756, 758, 760, 763, 764,765, 767, 768, 769, 772, 773, 774, 775, 776, 778, 782, 785,786, 787, 788, 789, 790, 791, 793, 794, 795, 796, 799, 802,803, 806, 807, 808, 809, 810, 812, 815, 816, 818, 819: n = A,T,C or G
  misc_feature 820, 821, 823, 824, 825, 826, 827, 828, 829, 830, 831, 832,833, 836, 837, 838, 846: n = A,T,C or G
nnnnntttncncccntttgcaaacccttgcttctnctttcnaattggcttggatcgattcggggaattctctgccttttggggaacagttacagaggacctnntaaacccttgtttngtgccaggccccgagaccacagagataacctgggacccaggctctgcccatggggagctcccagccctgtgaggaagacaggccatcctcacccagcacatcctactgtacccgaagagagggcgcagtgactcattttttgccgttggcattaggtttaaaagatggttgaacgtccacagaaggaaaaggaattcctggcanagggccctgcctgagcataggcagggaggctgagcagccacgtgtgcttgagcgctggtttgncgaggcagcaagcggcggctgtatggtgttgctgcagctgtatggtgaaagggtgttgaaagctganccaggaatcaaggctgctggccacagacgcattgatgatggatgacgtgctggtggggctgacacctgaaaaaaaanggtgtcaagttccaaaacaanggcctggcatacaagtanggnccacaagggagaagcatgagggaaatggcttngcccgcctggggntccctggganaantnancaattnntcngnatgnnnaaggnncnaatnnnnanaacnnnnnnccnnnncnntnnnnannnnnnnnncnaaannncnnnnnanncnnannntnnnntnaanattnnnnntntnnnnnnnnnnntnanaannncnnnaannnnncnctanctnnnnnnnannnnccnttnnctnnnnnanaanngnnnntnnnnnnnnnnnaannnaccccccnc

SEQ ID NO: 5031 - DNA, 884 bp, Homo sapiens
  misc_feature 15, 16, 19, 22, 37, 100, 101, 102, 313, 334, 530, 544, 560,571, 573, 582, 591, 632, 637, 639, 642, 664, 689, 692, 705,781, 782, 810, 831, 845, 863, 876, 883: n = A,T,C or G
cgcttggtttgagcnnctnaanccttcccatgcgatncgaattcggcacgagggacagtgggcctggcccgtggagctgccacgcaggtgcctgagggcnnngtgccacgcaggtgtctgaggaccaggtgccacgcaggtggtgggggtacagacaagatgctgggatgtcccctgccccatggtcaagggtgtcctgcctgcctgggtccagggcctgagggagccacatggatcccgagacttgtgttctcttgctgaaaacactgaggtgctcccatctgtgcgtggcccatgagctgggatggtcctncagcttgcccacaaggtccgnccctctgtctcttgcaccaacctgtttgcataaacacactttgctacaatcttgctagtgcgttttcttaaaagataatctatttactgtaaaaaataaattggactttgcaaaagcttttagaaggaaaagaaagaggattaaagagaattgctggtgaaaaaaaaaaattccataaaaaaaaaaaactgggaanccttttagaacttntagttgaggtccgtanttaccttaagntnccaagaccntggaattanggaattccaatttggattgaagtttttgggaccaaaaaccnacaancnttnggaaattgccaatttgaaaaanaaaaaatggccttttaaattttggnggnaaaaattttttgntggaaatgcctttatttgggccttttaaaatttggggtaaaccccaatttttttaaaagccttggcaaattaaaannccaaggttttaaacccaaccaaaccaanttgggcattttccattttttnaatgggttttccangggtttccaagggggggnaagggttttttgngaaaggnt

SEQ ID NO: 5032 - DNA, 781 bp, Homo sapiens; identical to SEQ ID NO: 547
  misc_feature 4, 5, 10, 12, 13, 18, 19, 28, 34, 75, 81, 95, 96, 105, 111,152, 179, 182, 196, 204, 205, 206, 213, 223, 263, 265, 272,281, 293, 296, 302, 319, 327, 333, 344, 375, 413, 426, 434,438, 442, 447, 462, 479, 481, 485, 496, 498, 501, 516: n = A,T,C or G
  misc_feature 531, 533, 538, 543, 544, 550, 569, 573, 579, 590, 596, 598,599, 608, 612, 619, 629, 642, 646, 667, 671, 673, 674, 675,679, 690, 691, 692, 699, 716, 745, 751, 761, 767, 768, 772,775, 781: n = A,T,C or G

SEQ ID NO: 5033 - DNA, 851 bp, Homo sapiens
  misc_feature 2, 3, 4, 10, 11, 12, 16, 19, 24, 102, 104, 418, 630, 669,688, 695, 710, 732, 739, 760, 766, 773, 782, 789, 808, 832,834, 848: n = A,T,C or G
tnnncttccnnnctcnacngaaancccttgtattgccctttatgcaggatccctcgattcgagcagctgcatctaggggcccttggtgagatttacactcantncctggtcgccccccgttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggcagcaacaggtaaacttcaagaaggagggcaggagccccaccctacagggcttgggangagcccagaggccccatctgtttcttcttccaggagttgtcaaggcagcagaaaggagtcacccagccaaaggaggaagatggcttcaccgggctgcaccaaggggccaagaagcccttaccccgtgtctaaacccttctctcacttccccttaagccttggtgaaaagaagtcaagaaagccccaaggcttccttttttcttggtttcttnaacttcaaccagcttaaaaaaatgggctttccagggtanttggaagttcaattgaaantttcaanaccattggtttgggnggttaaaaggttttcttccttnttggttncctggaaaaaacctttcaatnctttcntttgggnggtcttcantggtccntcaaattctttcccccttntattgaacattgccaaaaaaaccnanccttttttttttgnaaa

SEQ ID NO: 5034 - DNA, 741 bp, Homo sapiens
  misc_feature 2, 3, 4, 13, 32, 660: n = A,T,C or G
tnnnttctaatantttggatcttgtgtctttntgcaggatcccatcgattcgaattcggcacgagcccatgtcccgcccgctcgtctgcctggctgcggggtgacacggggcttcgccttgggaaggggtcgagggaagcagttagacggctgccgggcggcggctgccgcgcggcacacaatatttatttaattgcccaactaccactgatgaagatatattggagtgactgctgaaattgcctttttgtttttaaccagaggacagtccatttgtttcacttctttttgctttctttactgctatgagctttactgaacggctgaaaaacttggaaaataaaatggacatgctgtagtcttgaacataatttttttaaggaaaacttaaagtgccagagtgaaagccagaatggcatccagagagaggctctttgaactttggatgctttattgtacaaagaaagatccagattacctgaagctgtggttggacacttttgtttctagctatgaacaatttttagacgttgactttgaaaagctgcctaccagggtagatgatatgcctccaggaatatctctgcttcctgataatattctgcaggttctgaggatccacttctacagtgtgttcagaaaatggcagatgggttagangaacaacacaagccttgtcaattttgcttgcaagttcttcattattctttgcaggtatctagtagaaaaaataaccttgtt

SEQ ID NO: 5035 - DNA, 730 bp, Homo sapiens
  misc_feature 5, 6, 9, 38, 43, 45, 55, 60, 61, 85, 93, 100, 106, 108, 123,147, 148, 186, 205, 210, 225, 227, 248, 261, 262, 274, 283,285, 289, 290, 291, 297, 303, 308, 310, 317, 320, 329, 331,332, 338, 351, 364, 374, 376, 388, 399, 406, 413: n = A,T,C or G
  misc_feature 429, 435, 456, 470, 472, 477, 478, 492, 519, 524, 526, 544,557, 558, 562, 590, 591, 601, 602, 607, 647, 659, 666, 667,675, 686, 687, 689, 717, 718, 723: n = A,T,C or G
ttggnnctngttctttttgcaggatcccatcgattcgnaccgncnggccagctgncaggnnacaggggctgtaggcccagctcanaccacttnggagctntggctntnttcaaaaacattgtngactctcttacccacacattcctnngctggaaggggagattgacaaaccagcatcatctctangttactacaaaagccctcnctggnaattattcttaactnancagctggtagcgatccattcngaaaaagagtacnntagactgagttnctctgctgntnaaannnctgaanagcctnctaantntacctancgnaaaacctananncctttncatggcctgctangccctgcgccctntggcccatcntntacgaccacctntactactgccnttctgtnaggcctntgggcccaaacctgtncctatnaatccagatggcctgaattanctgaacaatgacanangatgnnaaaatggcctgatnctgccttagctgatgacattaccttgnaaaancncttctcctggctcatccnggctcaaaagctnnccanctgagcactgggacctaaacccctgtcnnccagaggaannacccnctatgactgtaattatccatacctaacccgatcctataanatggcccgcccnttctccnntcgctgancttttcggacnnancccgctgacccaagtgaaataaacagcnngttgntcacact

SEQ ID NO: 5036 - DNA, 730 bp, Homo sapiens; identical to SEQ ID NO: 5035
  misc_feature 5, 6, 9, 38, 43, 45, 55, 60, 61, 85, 93, 100, 106, 108, 123,147, 148, 186, 205, 210, 225, 227, 248, 261, 262, 274, 283,285, 289, 290, 291, 297, 303, 308, 310, 317, 320, 329, 331,332, 338, 351, 364, 374, 376, 388, 399, 406, 413: n = A,T,C or G
  misc_feature 429, 435, 456, 470, 472, 477, 478, 492, 519, 524, 526, 544,557, 558, 562, 590, 591, 601, 602, 607, 647, 659, 666, 667,675, 686, 687, 689, 717, 718, 723: n = A,T,C or G

SEQ ID NO: 5037 - DNA, 774 bp, Homo sapiens
  misc_feature 3, 4, 6, 7, 23, 24, 25, 27, 28, 56, 63, 729: n = A,T,C or G
gtnncnntttctaatgccttggnnntnnccttctaatgcttggctcttgttctttntgcaggnatcccatcgattcgaattcggcacgagcctagttatgctataatcaagcaggaaatgtttatggaatggaaagattaaggaaaaggtatgttcttattttagcaataaaacgaataccagaagctttaacattcaccagtacaaataaatagtttcaatggaataggtcgaaagtaaagggacatcactagagtaaatgctagaccttccctctccttttatttttagcaacagcaaagcagaaactaagatctacaagtgatcaaagagggtgatccattcagtttctgtgtagacaggaataataataataccttttacatattggtacagtttgtaaaaacactttcacttactcatttaatcttcatagcaacttgatgaggtagaatactataggaagcagtattagctcaggttggtacgtaaattactgtgtttaaatttcaataaaacagctatggaatccaagacattcttggcgcctaataaactgtattctttgccaacagtgaaagtgcttctctgttgcttggtaagttttttccccttagaatactaataaagtaattgattaactttcatttttattttgatttgattgggacagcaattttagcagtaaaaaatgtcacctttataaatcctgtggtttctggtcttggncaagttaaattcaacctgaccaggaaggcacgctttaattcttat

SEQ ID NO: 5038 - DNA, 771 bp, Homo sapiens
  misc_feature 2, 6, 10, 12, 16, 21, 29, 30, 37, 40, 41, 47, 61, 65, 67,98, 111, 114, 131, 158, 195, 228, 229, 246, 265, 280, 286,298, 343, 344, 351, 364, 381, 388, 393, 409, 433, 470, 475,483, 495, 498, 500, 501, 518, 537, 542, 560, 575, 610: n = A,T,C or G
  misc_feature 619, 620, 633, 644, 660, 662, 665, 676, 677, 679, 684, 721,729, 730, 741, 747, 759, 760, 762, 763, 769, 770: n = A,T,C or G
gnaacntttngnaaanccttngttctaanngctgggntcnnttggtntctgcacgatcccntcgntncgaattcggcacgaggtcagatgttcctggnttacgttgagctncantgaagtgagaggggcanagggggcttgggaagtcacaaggtcanggagaggagaagaagcgtgctggatgagtcacactgnaggactcaagccagtaggttcttggtagcccgnntactgacctggagccangcactgatagcaacgtgtnctctgagggaaggcnaatggnaaatccaagcangcactgggatctgcctgtgacactcttgtggggcctggaccctcnncctaagngagcttgggccantcagagccaccccaggngcccctnccttnatctccattgtggcangcacaggaacattgtgatacccanaaaatggactcctgtcttgtgcacaggatgcacctgngtttnctatcttncattcctgaganctntnnagccaggaggacctganttgaatcctgactttgccnatatnaatgactatgtggctgtnggtaacttacttatnctacatgagactacttgtttcatctgccggaaaangtaccatannatctgccttgccnttattgacttnaggataaatcaagtcngntantaaagggaaanntntgttncacttgaaaaatcaattaatggttcattgttcctccntttaaaanngaaatacaaangcttcngcctttagaacnntnntggagnnc

SEQ ID NO: 5039 - DNA, 744 bp, Homo sapiens
  misc_feature 11, 13, 22, 44, 527, 665, 689, 729, 732, 744: n = A,T,C or G
ttccttcaatngntgggaactngttctttccgcaggatcccatngattcgaattcggcacgaggatgcatgaattactgcattaaaattgatttatgggaattattgttgtttcagtagcatttcaattcagttgccaaatagagcagtgggcaatgttaacggaaacaactgcaattggcgcagtatggagtgcctatcgcactaggaaatctgagggtcacaaaagaaaggagatgtgaggataagaaactttgtttttcccttgttgggaactctttaggcctcggtttctggtgacagccccagggatcatcaggcccggaggaaatgtgactattggggtggagcttctggaacactgcccttcacaggtgactgtgaaggcggagctgctcaagacagcatcaaacctcactgtctctgtcctggaagcagaaggagtctttgaaaaaggtaagataaacagcataaagtcttacccttctgcagtaataactggaatatgttaataaggtcatgtgttangtagtatagcagagaaaccccaaatttgcagtatcttacctaatatacttttaattctcactcatgtaaagtcctagatggtgtcctggatgctcttccaagtgccagattcagagacccagtttccttccattttgnggctccattatcatcacttggctnccaagactgcaggggaagatcatggatttcttcatggganaangggaagaggatn

SEQ ID NO: 5040 - DNA, 763 bp, Homo sapiens
  misc_feature 2, 4, 5, 14, 16, 670, 676, 722, 723, 743: n = A,T,C or G
tntnnttcctaatngntgggctacttgttctttctgcaggtatcccatgcgattcggttgccaaggattctattgccatgtgttgaggagtaggagcaaggagatagagcaggaccaatgttacaataagaacccactattaacccccaagaatctgtcttgtgagggagataaatagttatcatacatgcgataagtcccacaccagcacatgaaaagattagaagaacaagagaagggaagaaacctactgacctgtttcagggtgggatgcttcataaagaggataacagttaagccactaacagtaatgcctctaatcttgaatctgttacctactagttttgtgtccctgggcaggtaacttcatgtttccttgcatcagcttacctttaaaatgagaataatgataattatctaacagggtccttactgaggattctgtgagataatgcatggaaagagcttaagtccatgcccaggaaatactaagtgctcaaagtaaagcatttttttttccttttttattacctagtcccacaagagcaatttttttatatcaagattagctttaaattcagaaggaaagggaatacttgaatggctcattgccagtaaccttatattgatgccatgttttgactttgagacattttttggagtctttttnaatggnaatacaggtttctggtggaaaccacccttgttgtcaaaaagtttcnntgaccttgtgtgtgtgtggngggtggtacacatgtgtcct

SEQ ID NO: 5041 - DNA, 774 bp, Homo sapiens
  misc_feature 1, 3, 7, 8, 9, 10, 11, 12, 15, 16, 29, 37, 40, 56, 62, 102,277, 280, 360, 446, 449, 467, 478, 501, 502, 548, 575, 585,649, 669, 684, 728, 748, 756: n = A,T,C or G
ntntttnnnnnnctnnttggaaacccttnaaggaaanacntggcccttcgcaactncaggancccatcgattcgaattcggcacgaggaggcaggcagggcntttgggtcccttgttcagctgttatggggcttaggccatgctcagtgctggggacaggagttttgcccaacgcagtgtcataaactgggttcatgggcttacccattgggtgtgcgctcactgcttgggaagtgcagggggtcctgggcacattgccagctgggtgctgagcatngantcactgatctcttgtgatggggccaatgagtcaattgaattcatgggccaaacaggtcccatcctcttcatgacagctgngagctccttactgtgggagagctgcagggagccaaggagggctgcctgacacacttgccgctctcgtgtgaatccaagaaactgcnttnctcaaaggggccctggtngtcaccttctnccacagccatttccacccatcgnntgtctagaatctctttcattagcacattccaacccctctgacactnggtttaaaaatgagctccctggctcantggggccttntagaatctggaaccagacggaggtggaagttaagaagataggacagaacaagcaggcccaaagngctatgggttcactgggganagaccattaattctncagatgcttttactcctgatggcttttacccattattcttttcngttttaagagacatgggctnactcttgnaaccaagctgggaatgct

SEQ ID NO: 5042 - DNA, 774 bp, Homo sapiens; identical to SEQ ID NO: 5041
  misc_feature 1, 3, 7, 8, 9, 10, 11, 12, 15, 16, 29, 37, 40, 56, 62, 102,277, 280, 360, 446, 449, 467, 478, 501, 502, 548, 575, 585,649, 669, 684, 728, 748, 756: n = A,T,C or G

SEQ ID NO: 5043 - DNA, 1068 bp, Homo sapiens
  misc_feature 8, 31, 312, 327, 329, 330, 331, 341, 342, 344, 352, 359,362, 368, 373, 378, 381, 382, 383, 384, 385, 387, 389, 390,391, 393, 403, 406, 409, 412, 418, 420, 425, 431, 433, 435,441, 443, 444, 445, 452, 454, 456, 462, 465, 471, 475: n = A,T,C or G
  misc_feature 476, 485, 492, 494, 504, 505, 511, 516, 518, 530, 534, 535,538, 542, 545, 552, 564, 569, 571, 572, 574, 577, 578, 580,581, 592, 595, 596, 604, 608, 609, 610, 613, 614, 618, 624,631, 635, 640, 641, 644, 650, 653, 659, 660, 661, 663: n = A,T,C or G
  misc_feature 664, 667, 669, 672, 675, 677, 678, 688, 689, 694, 695, 698,700, 701, 702, 703, 705, 706, 710, 712, 716, 717, 718, 720,721, 722, 724, 728, 733, 735, 738, 742, 745, 752, 755, 756,757, 763, 767, 768, 769, 774, 776, 781, 782, 783, 785: n = A,T,C or G
  misc_feature 787, 789, 794, 796, 797, 801, 807, 813, 814, 823, 825, 828,829, 831, 833, 834, 835, 842, 843, 854, 860, 866, 867, 868,874, 875, 877, 878, 879, 884, 887, 888, 889, 891, 898, 902,905, 908, 909, 911, 915, 916, 918, 919, 927, 928, 929: n = A,T,C or G
  misc_feature 932, 934, 936, 941, 949, 950, 952, 953, 955, 956, 959, 960,961, 962, 965, 967, 968, 970, 972, 974, 975, 979, 982, 984,994, 995, 997, 999, 1001, 1002, 1006, 1010, 1012, 1020,1021, 1025, 1026, 1031, 1037, 1039, 1041, 1047, 1050, 1054: n = A,T,C or G
  misc_feature 1055, 1057, 1059, 1064, 1065, 1066: n = A,T,C or G
tccctttnaactccttgaatcccttgaattncttatcccatcgattcgctgatctccagacccataagggagatgctgagtagacaactggggcttttttggtctggagttcagaggagagatcgggaaggtgtccatttggagtcatccacgcagagatgtgtgaaggctgctcaatgattttgaggtttaaagaaaaaaagagatgtgaaaccaggggccctgatgaggctgcccaggtggtaaggaagacagaagagaagccatgggacagctgagcccgggcaccctcaagccttggaggcatgaagnttggtggggatctgncnnnaaacacctgnnanctgtcagngggccancanaccctntagtntcacngannnnntncnnnangcaaaatggnctnttnaanatctcngnttatntacccntngnagtcangnnngactacntnanaacatnctnatatgnaaanntatttcgcngcactcngnctttaaccanntctgtnctttncnctgggtacatgntcgnnatntttnctnggaaaanattaattggctnttttntnnanctnngnngaactgtaaanttnnacccttcnacannnaanntttnctctcnggggctncttncaatnnacntaatanggncacagnnnannctnancanatnannaaacccttanntatannacncnnnnannaaananttannngnnntntacncccananctntctnctnaaaaatnggnnnccttcnttcnnnaaaancntcatnnntnantntatanannggcncatttnactctnnccctataanantcnntngnnntccccannaaatctggggnaacaanctttgnnntcaaannannnctctnctnnncnctcacanacgncanttnntncaanngnncacttacnnnaantntntctantatatctnncnngnntcnnnnatntnngncntnntctnaancntttttatttnnananannaacnttanancccctatnncttnntctanaagcancncnaacaanttntccnngncntcctnnncc

SEQ ID NO: 5044 - DNA, 755 bp, Homo sapiens
  misc_feature 2, 3, 4, 5, 8, 9, 10, 11, 12, 13, 100, 588, 666, 753: n = A,T,C or G
tnnnnttnnnnnnctcttcaaatccttgttctgcctttctgcaggatccctcgattcgaattcggcacgaggctgtcgggcctcagcagagctgcctacncacctgagctccgattcatgtactacgtcgatggcaggggccctgatggtggctttcgtcaagtcaaagaagctgtcatgcgttatctgcagacactcagttgacacttgttatatcatgggaccccggaaattggagtgaagctagaaacagaaaacccatgcagggcctcggattcccacaaatgtgacaagaggtatagggagtgagtcgcagcgctttgctcgtgaccctgggatcagagcacccatcaggcttccattactgtgggctccctaagaagaccatggagagcttggggactcccccaggaaggccgtgaagctggggattccccctaggaaagccatgaggaactggggactccccaagaaggccatgaggaagccagaaattggaggtggtaggaagtggtactgatcaatgatggccagcaggactcatctcctgcctaactggacaggaagcctgcacccacttctgtcttnccctggaactgggcactggcgtacactggtatccctcctaaagaagtgactcacctgactgatcagcaagaagcctanatgcaggcctaccatggatggcttcctagttgcctggggaaaccctggaatggcatcaggagaaagcaccaggaatccagtccttcnct

SEQ ID NO: 5045 - DNA, 766 bp, Homo sapiens
  misc_feature 1, 616, 648, 676, 701, 703, 718, 720, 730, 765: n = A,T,C or G
naataccagctacttgttctttttgcaggatcccatcgattcgaattcggcacgagaaggccttaggctttttttttgtagggtgagagtgggggagagatctcttgctctgttgcccaggctggtctccagctcctggcctccggcagtcctcccacctcagcctcccagagtactaggattatgggcatgagccaccacacctagccaggctttttatattgagttggttatatatgcttcatagccacactttataatattggagtatagtattaaattacagcttgttgtcaagtcagtgtttctgtaagacagtatatccaatattggttagagtaacacctatttggtgatacagatcaacagggtgtctctgattaatttagctcctacatagccagaagcaagttcattatgatttagaatattgtacatggttatgcaggaatcatcccaacctatctgtgtttataggtcagatgatgttcagtttatatctgctgatagtgtatatgcaggaaaacctataaaaccacttcagacttgttaaaacagtgagaaagccgtgattgaaatattaatacaacccgtgtggtataaatttcatttacantgggaatgtaaatgctgtcatttgaatcttgncaaagcctgctactaaaactcttaaaanccttgctaggggaataagtctttantnccaaaaacaatatananggggatgtgngtggataatacaaggacaaccatatgttggtggcnt

SEQ ID NO: 5046 - DNA, 791 bp, Homo sapiens
  misc_feature 3, 4, 5, 6, 7, 8, 10, 20, 22, 24, 26, 30, 35, 49, 50, 274,277, 514, 515, 532, 545, 562, 575, 594, 677, 691, 693, 700,704, 707, 715, 737, 739, 741, 755, 761, 769, 772: n = A,T,C or G
ggnnnnnncngggaacattncncnanatgnactcnttgcaaacgccccnnaatgcaggatcccatcgattcgctgaaacggaaacctttcgcaaagcctgtgcaggcagaggattttacacacatccttgacgtggcactgtgtcttcaggggtgctgccctcttacagagagacagatctggaggccatggccgttttggtgagaaatgccagaaacagcttcagtttccacctactgcttcatatttataatcacagtaatctatttctcgnttngctatttctagagcaacaaattgtgtgatgcgaaattagtaccagaggaacaatgactccacttaacaaaaaaatagcaagggaactatgaaaaatggcacaactgcttaactttaatagttgaagtctttaggagacttcagtagttgaaatgacacagaaaaatcctcaaactaacatacctacatgaaactgagtttctcaaagtaacccacatttatggaaatagaagtttgnnttgcagaaacatcagcncattttgtaaggngtatgtgatatttaaanttgtgatgcttgngaataagggaatggggctntaggtctgaggaaaggggagcattcattcaaactgggagggggttttgcatttttaaggctgctataagggcacgaacttggnggagacttggaccngntttccgnatgnatnggggaccntctggtctaagccattgggggngncnggactttctccaanattctntccaaacntgnctctcttaatttctccgaa

SEQ ID NO: 5047 - DNA, 844 bp, Homo sapiens
  misc_feature 3, 4, 5, 6, 7, 10, 11, 12, 13, 18, 22, 25, 509, 517, 545,547, 563, 574, 587, 590, 616, 617, 636, 647, 662, 677, 680,681, 690, 691, 700, 707, 720, 722, 723, 746, 749, 760, 763,781, 792, 793, 808, 825, 826, 827, 842, 843: n = A,T,C or G
ggnnnnntgnnnntttcnaatnctngctactcgttctttttgcaggatcccatcgattcgaattcggcacgagattacaacaatatggatagtagggaggaggaaaacaagaggagaatgggatcaacagaaggcatatatggggagtgtctggatggctggaaaattccattttttgaccaagatgtggtaaacacggggagtaaagttataattttttctcttactgtgcttttaggttttgttgctttctgtctgtatgctgtgttccacaataataaaaatatttaaaaggcaaaaaaaagtaaaataatgaatataaaattacactgaaactacatattctcatagatagaattgtaattattagagtttttgctgaataaagtcaaatagactattatagtagttataaacgcaagttaaaattttagggccgggcaaagtggctcacgcctgtaatcccagcactttgggtggctgaggcgggtggatcacctgaggtcaangtgttcangaccagcctggccaacatggtgaaagcncntatctactagaaaatntaaaaaatttncctggtttttggnggnggggctcctttaatcccaaattactnnggggagggttttgggcaangaaaaaatttntttcaaactttgggnagcccccaggttttntanngggcccttnnaaatttttnccaattncccctttcaagcntnngggggaacaaataattaaaaacnccnctttttcaaanttngaaaaaaaaaaaaaaaanaaaaatttggnncctttttaaattttnggggggggggaattttnnngaaaaccccccaatnnt

SEQ ID NO: 5048 - DNA, 777 bp, Homo sapiens
  misc_feature 6, 17, 552, 604, 613, 615, 630, 632, 636, 652, 660, 678,713, 733, 753, 774: n = A,T,C or G
aaaacnacaggctactngttctttttgcagggatcccatcgattcgaattcggcacgaggaaagttgaaatcctagttcctggagtcctctgtgatggcaaattctgccttccttgtttcttctttttttctcctctgttttcccattttagtagttcaaatggtttttgtattattgaagacaggtatgtctcaaatccatggaactcacaaaaaaggctcattttctatcctcaaggagctttacatctaatggaaaacacacagtgaagtccagaaggactcactgtggactggtagcaccatgagggctttccatgaagaaggacttaagccagacttagcagggtgggcaggtgttgaaaggagctcatagattgttccaagttaggagagcatcataaaaagagatggaaatttacttgctacagttttagatttgctctgctcatagcagagagtccatttcagagcatatagggattgtcaggacttaaaacctgctgtatttcttacttaagcacccctctccccagaatgataagagcccanctttgggccttggaatgggagtagaatgtgggtatactgtctatcatatganaaaattgcntngaaccaacccccccncncccncaaatgcctgcatgtnaaactggngaacactgggtaatatanatggattattatcaatgtcaacttcctggactggngaatttggcctataggtttnccaaaatgtccccctgaaanaaaaggtttttgggggctttnttt

SEQ ID NO: 5049 - DNA, 828 bp, Homo sapiens
  misc_feature 1, 2, 3, 4, 5, 6, 9, 33, 167, 169, 218, 304, 305, 306, 312,318, 320, 321, 326, 333, 375, 399, 413, 420, 423, 449, 463,477, 493, 499, 507, 534, 546, 548, 580, 584, 589, 599, 608,619, 627, 629, 644, 645, 646, 652, 657, 664, 667, 674: n = A,T,C or G
  misc_feature 686, 692, 693, 698, 699, 704, 705, 707, 711, 720, 721, 724,741, 742, 743, 747, 753, 758, 764, 765, 766, 768, 780, 781,782, 798, 808, 809, 815, 819, 821, 823, 824, 825, 828: n = A,T,C or G
nnnnnnttntttaagaccagctcttgttctttntgcaggatcccatcgattcgaattcggcacgagagaagctccactggcacttttgtattcacaactaccgggtgcgataaggcagtgagggttattatgataccccttttcacaggtaaggaaacaaggctcananaggttcaacaacagagtcataattcttcttgttggagaattcattttgntacatttcattcccaccatctgcagtaagggagacccattaaaatatactatcctgatttttaaagagaaggtaacattaaggccnnnaggttngggatntnnccaanttcactntgggcttctggactcccatgcccaacagcctgcatgatgcanaagtgtccctcaagagcctagtgnatgattcttttttngtgccanganacagactgtggacctggagagggttngggggctggagaantagaggaggtggantttctacaacaggggntattgngggggtantaagaccaatgactacataagggcctncgtttggtcttngnccagaaaaatgcgtctttagccttttaacgantgcngtttncctccattanataaccagntttaagccacnggtgttgngntgggcaccattccannngctttngggcncatggtnttntaaaccnaagtccccctcnatcaanngcttnnttaannangggngcctttgannttntttttctttcctccagnnngaanggaacntgttngggctnnntntgcctttttggnnnaaaaaatttttttttnccgggttccnnaaaaancttngntnnnttn

SEQ ID NO: 5050 - DNA, 834 bp, Homo sapiens
  misc_feature 2, 7, 9, 16, 733, 761, 810, 811, 814, 832: n = A,T,C or G
tncaatncnggctctngttctttttgcaggatcccatcgattcgaattcggcacgagcggacctctagtgcctgatgttcactttcttcaggtcctcaatttcctacatttaagctgttcggttaaacttttccatattcagcttgagatcaacctcctttacataactgattatttttgccttgaggagaaaagatgacgctaaacacagcacacatgtgtttattatatgttggtaatgtggaattcaaagatgaaagagacgtgagctgcatcactaaaaaagaaacatattacataaatgcaatgctgatatcatagataataaaattaacactaattttttgatattatcaattatgcagtccataatcagatttgttttgtgcttagaaatgactttttacagttggtttgttcaaatccagatcagataagtttcacacattaaatctgtttaaaaaccaatttttaaaacagacgactgttaaagggccacatggggaagctttatggaatcttccaacaattttgttgtcccagctacttgggaggctgaggcaggaggatcccttgagcccaggagttcaagactgggcaacacaaagaaaccccatcttttggctgggtgcggtggctcacacctgtaatcccagcactttgggagcccgaagcaggcggatcatgaggtcaggagtcaagaccagcttggccaacgtggtgaaaccccgtnttcactaaaaattcaaaaattagctggncatggtggcgtgcgtctgtaattcccagcttcttggaaaggttgaggcnnaanaatctcttgaaatccagnat

SEQ ID NO: 5051 - DNA, 782 bp, Homo sapiens
  misc_feature 6, 9, 17, 313, 361, 642, 646, 658, 687, 693, 705, 707, 710,715, 732, 735, 743, 759, 772, 773, 776, 779: n = A,T,C or G
ctaatnctnggctactngttctttttgcaggatccctcgattcgaattcggcacgaggacacccagtttaagggacattctgtacggtgcctgaatggcgctcctgaaaactgtgcaggtcctcaaggctgaggaaagcgtaaactgtcccagaccagggaggccaaggaggcgcgatgactcaatgtcatgtggtgccctggatgggatccagggacgggaaaaggacacttgggaaaaactggtgaagttcacgcaaagtgtccgggttagttcagcatcagagaccaatgatggtttcttggttgtgacnaaaatgttccatggtctgaaaggtgtcaacaccaagggaagctgggtnagagggctaccagaatcctctctactgtcttttcagcttttcggtaaatccaaaagtactttcaaatgaaaagtttaatttaaaaatgagaagccacctcccccacgagatcatgaagctccatgaaggccaaggccatgttaatgccaaatgcatgttggttgaattcactcgtgtttggttgaatttactgatgttggttgaatttactgatgttggttcaattttactggatgttgggtgaaatcatttcatgttggttggaattcacttattactgnggtncttaccatcttngttgcagccctcttcattctttttttctnaatggncaaacaaataantnggntgtanttacatatttattgggngtntaaatggnggataatttaatattntgtttttaaatgnnggnatnaat

SEQ ID NO: 5052 - DNA, 882 bp, Homo sapiens
  misc_feature 3, 4, 5, 6, 7, 8, 19, 20, 28, 36, 211, 222, 223, 229, 232,237, 246, 259, 261, 268, 276, 277, 280, 282, 295, 297, 298,307, 315, 316, 320, 322, 331, 343, 350, 375, 386, 390, 395,447, 454, 459, 460, 466, 468, 484, 490, 499, 506, 508: n = A,T,C or G
  misc_feature 510, 515, 519, 521, 531, 534, 535, 540, 544, 546, 550, 551,552, 553, 569, 571, 572, 575, 579, 583, 596, 604, 621, 628,638, 639, 641, 643, 644, 645, 647, 656, 659, 665, 671, 673,680, 685, 686, 687, 690, 692, 694, 697, 702, 704, 716: n = A,T,C or G
  misc_feature 719, 722, 727, 729, 730, 737, 739, 740, 746, 748, 751, 753,754, 758, 759, 778, 780, 784, 793, 797, 798, 799, 801, 804,807, 810, 812, 820, 842, 851, 864, 866, 869, 876, 880: n = A,T,C or G
atnnnnnntttctaatacnnggctactngttctttntgcaggatcccatcgattcgaattcggcacgagcaaataagttaaatgtatatggcattggattggaattggaggtatcagtgtgaactcatggttttgggttttttgttttttgccttttttgttttgtttttgttttttgaggcagggtgtcactctgttgcccaggctggangaaatactcannaacganacnctatngtgtatcanaagctgctacgcntntcatggntttgttanngancnacacagatagtcntnntgtattcancgacttannctananagagacagnatgggaattaantgttaangtgctagccaacaagtaaagattcncataaaacaanggtnatatncccagtcatcaaagtgataaattttccctgctaactttagattaaaaagtantttttangccannttgtgngnggctcacacctttttntccctncactttttngcaggcntnanggttngacnanatcccctttnacnnttcangaantnttcnnnnaccctccccttgggcnanncantggntcgnaaaccccccatcntttttccncaaaaaaattcccaaantttcgcngccacccggnntngnnntnccgtggtanccntgattnttttcncncttccanccggnnnggncncnacngccananaaaaaaccttcnttntanccctngnngaggccncnngtttcncnatngnncccnnaaaattggggtcttttagnanctcnttacccctngccnnncnganttnaancnattctttnaaataaaaaaaccctccttaancttattatngagtccgtatttncntancaacccntacntc

SEQ ID NO: 5053 - DNA, 881 bp, Homo sapiens
  misc_feature 1, 2, 4, 5, 7, 8, 10, 11, 693, 695, 697, 698, 699, 700, 702,703, 704, 706, 707, 709, 710, 711, 712, 714, 715, 716, 717,718, 720, 721, 722, 723, 725, 726, 727, 729, 730, 731, 735,736, 738, 739, 740, 741, 743, 744, 745, 746, 748: n = A,T,C or G
  misc_feature 752, 756, 757, 762, 763, 767, 768, 772, 775, 778, 779, 780,784, 785, 787, 788, 790, 791, 792, 794, 795, 801, 802, 803,804, 805, 806, 810, 811, 813, 814, 815, 820, 821, 822, 823,824, 825, 826, 828, 830, 831, 833, 836, 837, 838, 839: n = A,T,C or G
  misc_feature 840, 841, 842, 843, 844, 845, 848, 849, 850, 851, 852, 859,860, 861, 862, 865, 866, 867, 868, 869, 870, 871, 873, 877,878: n = A,T,C or G
nngnntnntnntttctaacgttggctctcgttctttttgcaggatcccatcgattcgaattcggcacgagagaaagattttctttattaatgaccccaaccgtatttctttagatacaggagttttgaactcaaatacttaggagaaaacaagttatgactgcattatcctgcaactcattaccagtaatatattgcaaagcgaaacagcttggaaaagagggtgggagaaaagggaagtgagggagggaagataaagaaaaggaattaagttgatcaagtggaattctttttttttttttaattcttgggaactatgaagtctttgcaagcacagctcgtttctgcagattattttccaaacgtgtacaaaatggaaccaaaacggagaatcccttaagaacctgaagaggcgcaacattaaaagctacgattatccagtagcaagtgttccagccttcagttgccagccgcttcctcctcttattcccaagattagcgggatgaaaacgtcttccccgtgattgttttcatttcttttttctcggcatctgggcgtgcgcggttcagcaccttgaggaagtcagacgttttcgcccgcatcgtgtgtgaatataggccttagagcacttgatgtggtagtgcaggtagtcccggaacgtgtggatcaggttgatggtgtttgtctcgagcncncnnnntnnntnntnnnntnnnnntnnnncnnntnnnctcnntnnnntnnnncncttncctnnctctnnctcnnctcnctnctnnntctnncnncnnntnntttctnnnnnntttnntnnnctctnnnnnnncncnntntcnnnnnnnnnnttnnnnnccttttnnnnctnnnnnnncnctcnncct

SEQ ID NO: 5054 - DNA, 785 bp, Homo sapiens
  misc_feature 3, 4, 5, 6, 7, 8, 9, 11, 12, 13, 304, 511, 514, 608, 642,653, 689, 699, 773: n = A,T,C or G
ggnnnnnnntnnnttttaagatcagctattgttctttttgcaggatcccatcgattcgaattcggcacgagatcacatctctcaagttttaaaatgggtttttttgttgttgttgatgggggggagagggtccagcagcttttaaatgttttcacatcgtgtgttccaaaaataactggttagcctaagtcacttccaccctccaatgttgtgaatgcagtctctagcattcgctatttaatgtcttcttcctgcactatttgagaaatcgcgaggtcgacttaataccgcagtcgccacttcncggaccggagggcggagtctgcttagttctgaggactgcgtgggtccgcgcagagagctcctgctaggcctgcgcgtcccgttctaaattcttaccctttagttcttgtcaccacccccgccgtgggaacggcctgacagtcactcgtcaaaggaagtggctgccggcagctcttgacccggaatcggatcctagtcccaccccctncgnccaggctttcttctgcaacaggcgtgggtcacgctctcgctcggtctttctgccgccatcttggttccccgttcccttgcacaaaatgcccggngaaaccacagaaacccgtccctgctacagagcangagttgccganccccagctgagacagggtctggacaaaatctgacantgatgaatcntcccagagcttgaagaacaggatttcacccagcaccacacaacaagcccagctggcggcagcagcttgaaatcnatgaagaccatc

SEQ ID NO: 5055 - DNA, 839 bp, Homo sapiens
  misc_feature 2, 4, 7, 8, 9, 16, 21, 23, 24, 33, 40, 45, 47, 49, 51, 194,204, 209, 320, 364, 463, 485, 496, 518, 526, 528, 553, 556,575, 578, 580, 603, 607, 622, 631, 632, 651, 658, 679, 684,688, 693, 713, 715, 717, 721, 726, 734, 736, 737, 738: n = A,T,C or G
  misc_feature 740, 743, 751, 758, 763, 766, 770, 782, 788, 790, 799, 803,817, 826, 836, 838: n = A,T,C or G
tngnctnnnttgttanatctngnntttctaatncttggcnatcgnantntntgcaggacccatcgattcgaattcggcacgagccgactacttgtgcagtttgccctgctgagccctcctcgccccgggaggcagaaggggaggggtcctcagcaatatgctgagcacctcctaaacaacatcacctgaaaaangaacctagangaganccattctcaaatctgatcctggactgagctcgagagctgggttgagagctgggttgatcaaagttgggattttgctattattgtgacaaagggtccagccttgcagtccanatcctgaaaggcctgggacaaggccaggtaatttggggagtccntcctgcatttgtgcaggatgttcagcggcatccctggccacccactatgatgcccgcagcaaacccctcagttgggacatttaaaaatgtctccagacnttaccaaatgggacagcattgnacccatttganaagcaccggttgagagcaaatncacaaatntntaaaatgggagatttgggccgtggnggngcaagcctgtagtccaatntcntnggaggccaaggctgggaggatcntttnatccccaggaggtanctttccggnngggcgaataactgcaccantgaactnccatattgaattgaacagaancccangacnctttntttttttaaaaaaaaatatntntntaanaaaanaaaacttngnnncnttnttaaaaanttttatngggangtnggtnttaccgttgaancccccncnttgaaaaanaaancatttggtttaagntttgggccnaaacccacancnt

SEQ ID NO: 5056 - DNA, 794 bp, Homo sapiens
  misc_feature 3, 4, 5, 6, 7, 8, 11, 12, 13, 14, 18, 21, 22, 23, 30, 655,668, 707, 728, 762, 763, 769: n = A,T,C or G
ggnnnnnnggnnnnttcnatnnnagctctngttctttttgcaggatcccatcgattcgaattcggcacgagagtttaaaaatacttctttgtaaaagttattgcacaaagaaaagacatgaatgtgtccctgttatgtactcacaaggataatgatggggttgttgctcattaatactgtttcttgtgcaataacttttacaaagaagtatttttaaactgatcattaattttatgaccacagaaatgagatgcaaaatttatgctattgtcagtggcacaggctcacagcaccactgacattttgtgtgattgtaatagaatggctgccaactaatgattctgtagacatttcatttgagtgtgcttttctttagatgtgtgattagctgtaatgctttcacttatgtctgtaaattatattggatatgtttacctgatgcctattgttgatttggagttcagttttgtattacataaatgcaagttgaactttttttttttaatttatagaagtctttgcaggtataactacaaatactcagcccctggggaggaaaaatgctttgcactactcaacagtaacccctgcgttcagttaaaactccttataagacagcagcttttactctttattgggtcgaaaaaaaaaatangggggaggaaaangggatggaccatcctgggacaatggtaagaatgaagaanaccatcttggaaaaatgaggngtccttcccttaatgcaaggttaaaaaggggctnntccttnatatatagcaatatagaatctttgg

SEQ ID NO: 5057 - DNA, 775 bp, Homo sapiens
  misc_feature 1, 2, 9, 653, 699, 716, 735, 766, 774: n = A,T,C or G
nnttaagancagctcttgttctttttgcaggatcccatcgattcgaattcggcacgagcagagaggcagggataccagatatggggaaatctgtaattacatgcaggcattaaatatttaaatatatattttcttcttttaattgtggtaaaacacatataacataaaatttatcgtcttaaccatttttaagtgtactgttttgtagtgctgagtgtattacattattatacaaccaatttccagcaccttttcatcttgcaaaactaaaactctttacctattaaacaactactccctgtttctccctcctcccagtccatgagaagcaccattttactatcttttctgtgagtttgactctacaaacctcatgtaagtggaattatgcaatatgttgacaaaccaaattctgtacaatatttaaagaggtttagtctgagccaaatatgagcaaccatggcctaggacacagtctcaagaggtcctgagaatatgtgatgtgccttaggtagtcaggtcacagcttggttttgtcattttagggagacagaagttacagacaaagacatacatcaatacccgtaaggcacatgttggttaagcctgtggaaagataggacatcttgaaaccaggccatcacatgtcacangtggattcaaagatttctgattgggtgaaaatctttggttgggtgnaagaagttaagctttgnctaaaggcttggaagtcanggagaaacaattgctttgagttaaaggtaangggggtgng

SEQ ID NO: 5058 - DNA, 797 bp, Homo sapiens
  misc_feature 2, 3, 4, 5, 10, 17, 62, 70, 78, 84, 89, 96, 117, 123, 129,133, 143, 150, 153, 155, 159, 163, 170, 171, 172, 198, 199,201, 220, 225, 226, 231, 236, 243, 246, 257, 258, 260, 268,270, 275, 280, 293, 297, 300, 301, 308, 309, 314, 316: n = A,T,C or G
  misc_feature 319, 320, 321, 322, 328, 330, 332, 335, 338, 339, 341, 346,352, 354, 355, 360, 361, 375, 378, 392, 400, 403, 405, 406,408, 409, 412, 416, 424, 425, 435, 452, 458, 467, 469, 473,492, 495, 496, 502, 509, 529, 532, 537, 542, 543, 547: n = A,T,C or G
  misc_feature 549, 565, 567, 569, 586, 588, 590, 593, 598, 604, 609, 611,618, 634, 646, 660, 664, 684, 690, 691, 702, 711, 716, 721,725, 733, 753, 757, 758, 759, 764, 769, 781, 790: n = A,T,C or G
tnnnntttcnaatactngctatttgaactttatgcaggatcccatcgattcgcaaaccgganatgggttntttttcgngggggnggganggaacanatttgcattaacaactactgngaattntccatncaangataatctcncatgtcnaanancccntttnttaaatnnngaatggggttgggcttatcagaatanntntttattagaggcttttttncaaanntcacnggttncacctgnaancccccataatnntntttttaancngctgntctanggatgagccccanttanttnntgcaagnngggananacnnnntgtgtnantncanatnntntgctngaaccngnncactnnttcataactagctngancccatttcccgtgnacttcggncgntnnannttnttangccggccnnaaccaatgantaggtgaaaaggacccncatgtnacccccaangnatanaccccatatttccatgaantannaccttnttctgtngggatgccccatcttagaanctntgggncatgnngagngnaagccctgagcatttntntnaacatgcctacttactncncnaanttgcnagggantgtgncngtgccantccatgaatggggtanggcgcagatccncgcaaacagcccanttgntacccatgagatatggaatnttcctnnctatggcaaantaatggccnatttncaaanttgnggacaaantgaaaggacttgtgttgctnggcnnnaaaanagggnggggggtggggnatttttaanaatcctt

SEQ ID NO: 5059 - DNA, 846 bp, Homo sapiens
  misc_feature 3, 4, 5, 6, 7, 8, 9, 11, 12, 13, 14, 19, 35, 37, 39, 41,46, 48, 50, 98, 104, 106, 118, 119, 120, 121, 123, 141,146, 150, 161, 164, 168, 170, 177, 180, 181, 182, 184, 185,197, 201, 206, 208, 209, 210, 212, 214, 238, 240, 246, 255: n = A,T,C or G
  misc_feature 256, 257, 262, 267, 281, 284, 285, 287, 289, 297, 302, 303,307, 312, 313, 314, 315, 316, 318, 321, 322, 323, 325, 332,338, 340, 342, 348, 358, 367, 368, 370, 372, 376, 384, 403,407, 412, 413, 426, 433, 434, 440, 442, 478, 479, 484: n = A,T,C or G
  misc_feature 492, 500, 502, 503, 504, 508, 511, 512, 516, 519, 523, 540,542, 548, 553, 555, 557, 559, 562, 568, 578, 582, 590, 595,598, 599, 607, 615, 620, 621, 636, 640, 657, 663, 670, 671,675, 677, 678, 679, 687, 690, 701, 707, 711, 712, 715: n = A,T,C or G
  misc_feature 716, 733, 735, 741, 760, 761, 762, 775, 785, 800, 814, 817,820, 823, 831, 834, 835, 838, 839, 841, 842, 845: n = A,T,C or G
ggnnnnnnngnnnngttcnaatgcttggcaatcgntntntnggggncncntcgagacgctggctcctttatcagatattactggatcatcacctgtgnaggctntntgtttaatgatnnnnancatttgaatggcaacagntgcgnatgnatcctgcctanaancacncntactcgntannnannttggtgtgtgcntgcntctantnnncnanatcctgtgcacacatcggaatttnantagaancagtacagnnncttangcagnataaaccatcctgnggnnananatgacacnctgcnngacntattnnnnncncannntnatggtgntgggcncngnaaaggncttgaaacangtcgtatgnncntnacanggcaccgngctaatatgctactgtgtnaacncaggnnatgagctgcagcnttgcctnncttacnantgctcactgggtgtgaaggacctgcttgtgaggttnntgttngccttttnctggactnannntaanccnntacnaangccngcattgttcattaccantngccttntgaantntnanagnagatgncattgggacnaatnggacagtntaaangannaccgcttngatggagnggacnngaatcgtttcttacntcanggggccactttattaanatgggngaacttnncacntnnngctcctangcncttccaaggtnaccttngggnnccnntggggaatttaaacaantncacaanggtggtctgaaaatcttcnnnggggacttaattnaaagaaattnattcggggttttccngggggttcacccangangtnttnaactttcncannccnnannttnt

SEQ ID NO: 5060 - DNA, 860 bp, Homo sapiens
  misc_feature 2, 4, 5, 6, 7, 8, 9, 10, 15, 19, 46, 809, 813, 823, 824,833, 840, 859: n = A,T,C or G
gngnnnnnnntttgnaacnttgctaatgctggctactcgttctttntgcaggcatcccatcgattcgaatttcggcacgaggttgtaccaataaagtttgcaacctacagcaatagccagtcaataaaggaaatgatgctgatgtagcatttatgagccttaaaaaacaaacaaaaaaccttaagatgttaaatttattccaaggattctttttttttgttgtacatgaatgttcatatcaggtttatttgtaatagccaaaacagtatacacctgaatgcccaccaacaagtgactagataagcaaagtacggtacatggatatgatggactacctcagagcaataaaaaagaatggactattgatacatgctacaacatggatgattctcaaaggaatgacgttgagttcagaaagcaagacaaaaaagtacattctatatgattccattaatataaaggaatatattatattcaaggaatagtatataaatataaaggaatattttatattcaaggaatataaatgaatataaatgatataaagcagatcagtgattgccaggagatgaggtggagaagtagagaggggaggaaagaagggattactaaaggacatgaagaaacttttggggataatgtttatgttcactattttgattgggctgatggttttacatatgtatacatatatcaaaatgtatcaatctttatactattaaatatgtgcagtttggttgtaagtcaattatacctcaatgaaacctcattaaaaattaccatattttgggggatctaaaaaaaaaagncttntagaacttanntgagtcgtnttccgtngattccagacattgataant

SEQ ID NO: 5061 - DNA, 714 bp, Homo sapiens
  misc_feature 2, 3, 4, 5, 6, 10, 13, 20, 23, 24, 37, 41, 45, 46, 47, 129,438, 546, 556, 569, 593, 595, 623, 630, 641, 642, 668, 699,703, 709, 712: n = A,T,C or G
gnnnnnttgntcnaaagccnggnnaaggaactcttgnaacncccnnngcaggatcccatcgattcggttttgcccctttttagcctcccagagcttcgaggactcaattttaacccgaaatcctgccgngggggaggggttgcgtcgagacctgggcccggggaggttctcctgcgtcactttctgtcctgaaaggcgcccttcctggtttctgtggctccaattttctatgcagccccacaccccttgttgttttgatcctgagaaataaaagggaggctgaattattcaaatttaaatgaggtttccccttcatggaagtgctgctgacccttcgtgcagaaatggggagcacttgaggacacaggtgggtggaggccctttgtgcgtggctggtcgtattcgggcagccctccgtcgctttttataaaactttgngtgagaagaatatattgataatgtcagtgaaacaagcagacattgaaatggaggcacagattactccacaaggagttcttctgtatattttttctagatgcaaatccntttaatatgnaattaatgtaagntttctagcttatatcgaactgggngnggcacgggggacactgtactggataagntgggcanacatcctgagnncgaatgcctgaccacggaaaatatanaatttattgctttaaaaaaaaaaaccacctnacangggcgnacnac

SEQ ID NO: 5062 - DNA, 849 bp, Homo sapiens
  misc_feature 2, 3, 4, 5, 6, 7, 8, 9, 13, 14, 36, 764, 793, 802, 822, 827,829: n = A,T,C or G
gnnnnnnnntttnnaacttgcaatcgctggctactngttctttttgcaggatcccatcgattcgaattcggcacgagaaaggctagctatattagctggggttccccccaaaagcaacattggagaaggactcatgggcagatactttcttctggaaaatgatcccgtaggatatgggtagaaaaagaaattgggaccagaaagaatgaaacaggaaagaaagaaagcctattgaaggatataaaatttctgtaaacaactggagcttagtcccactgaggccccctgaggaactgcgcagaatgtaagacagaggaggaaatatttagccaccagttcctatctcccattggccaacttgatgctgagttcaggagtggtggctcacacctgtaatctcagcattttgggaggccaaggtgggtggatcgcttgagcctcagagttcaaggccagcctaagcaacatagcaagaccccatctctacaaaagaaaaatttaaaaattggctatggaagtatgaaggtatatgcctgtagttccagttactcaagaggctgaagcaggaggattgcatgaacccctgaactcaagactgcagtgaactataactgaacgatggcactgcagcctgagcaacagagcaaaactcttgtctcaaaaaaaaaaaaaaaaaactcgaggcctctagaactatagtgagtcgtattacgtagatccagacatgataagatccattgatgagtttggacaaaccacaactngaatgcagtgaaaaaaatgctttatttgngaaatttgnggatgctattgctttatttngtaancntttttaagctgcaattaaac

SEQ ID NO: 5063 - DNA, 794 bp, Homo sapiens
  misc_feature 2, 3, 4, 5, 6, 7, 9, 10, 11, 15, 23, 28, 29, 34, 36, 638,698, 701, 736, 747, 782: n = A,T,C or G
gnnnnnntnnnaaancagctctngtttnnaaaanantgctacttgttctttttgcaggatcccatcgattcgaattcggcacgagaacaactccctacgtcctgtgtggggccctgcccaagtggatgaggcattccttgaggagtatcattttccctgacaatccccatcacctttaggggttccctgcttggctcctttccagctgaaaaactagacctgtgccattggggaagctggacaaagtctagggggcccgcctggtagagggtcccgggaagctggatctgtcagcctcggccctgaggcccctgttaactcaagactgtgagctgcctctaggtggtcacgtctgggagctagcttgtatggcttctgaccagtatcaggatttctgttctgagagcagcgtgggcagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtggganggttttttaattcgcgggccgcggcgccaatgcattgggcccggtacccaacttttgttnccnttaatgaggggttaattgcccccttgggggaaaanatgggcatagnttgtttccttgggggaaaatggtattcccttcacnaattccacacac

SEQ ID NO: 5064 - DNA, 825 bp, Homo sapiens
  misc_feature 4, 430, 458, 471, 481, 488, 502, 524, 525, 526, 532, 536,542, 556, 562, 565, 566, 575, 577, 587, 592, 595, 613, 616,618, 619, 628, 641, 644, 655, 657, 696, 713, 718, 731, 734,739, 741, 758, 769, 776, 800, 810: n = A,T,C or G
atanagctattgttctttttgcaggatcccatcgattcgcgcccctgcatgatggcagccgcactcctgcccagagtggggcctgggaccccaacaaccccaacacgccgtcacggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcanaactccagcgactgggtaaccactgacnttcaggggaaggngcgggacacntacctgnatacacaggggggngggacaaaacaggtgttatccnnnagttgncacnggtacngtgggggcccaagngtgggnggnntgaaacagntntttttttttntttgnttncccccttaaaattggganaanannacccttttncccaaaaatgggnganaaccccaaaantngggcaaaaaacttggggatttgggggaaaacccttaaanggggcaaggggggagcnttttntgaaaccccaaanggnggggntntttaccctggatttaancgggggaaatnaagggangggctttcctttggggaaaggganaaaattttgngcccaaaaaccttgt

SEQ ID NO: 5065 - DNA, 819 bp, Homo sapiens
  misc_feature 3, 4, 5, 6, 7, 17, 21, 30, 631, 693, 715, 735, 747, 752,754, 757, 760, 762, 764, 767, 768, 769, 770, 771, 772, 773,775, 776, 777, 778, 779, 780, 781, 782, 783, 784, 785, 786,787, 788, 789, 790, 791, 792, 793, 795, 796, 797, 798: n = A,T,C or G
  misc_feature 799, 800, 801, 802, 803, 804, 806, 807, 813, 814, 815, 816,817: n = A,T,C or G
cgnnnnnttgttgaaanagcnaggctactngttctttttgcaggatcccatcgattcgttttcttgcagttactatgctgtccttcctatcactacctgttggctgaggtagtgataggcctaaatgattcattatcttaaatgtactaaatatgttgagtaattttttcttctaaactaacagaaagagagaacctaggagttactcccttaggctggttaaagtgaaaggtagccaagtcaacccagcttgtttccttctctcattaggaaagaactattgttcattctcataacacactttttccaattgcaaacatactcagggttaaaatagtttagcacaaattgcagcccatttcatttgttcttcacaagctggaacttttcttgtaagctaaatattaaatggttcaagtaaattggatacataagcctgaaactaggcgtttctcattatacatagagtataaattaagacagactttttcatggtgaaaggtttacagcctttaaaacatctgggaagaagtgggaaagtagggaataactctgttaaatatgataaaagacaaagcaccaacaaaggcctagttctaaacttgttataatttctcatggggaagtttgngggttgtcacaaggttatgggcggtcccaagcaagtttaccaatatttttttagaaataatnacctccccagaaaatatttttnaaaaataagggaccctttcnttttaatatggnaaaananaanaanananaannnnnnntnnnnnnnnnnnnnnnnnnntnnnnnnnnnntnntttctnnnnnct

SEQ ID NO: 5066 - DNA, 766 bp, Homo sapiens; identical to SEQ ID NO: 5045
  misc_feature 1, 616, 648, 676, 701, 703, 718, 720, 730, 765: n = A,T,C or G

SEQ ID NO: 5067 - DNA, 873 bp, Homo sapiens
  misc_feature 2, 5, 6, 8, 9, 10, 11, 12, 17, 21, 31, 60, 64, 77, 100, 121,133, 134, 161, 162, 164, 173, 192, 244, 247, 249, 265, 279,295, 330, 358, 408, 422, 461, 476, 507, 543, 570, 571, 627,650, 657, 676, 679, 680, 696, 744, 753, 758, 761: n = A,T,C or G
  misc_feature 762, 765, 766, 776, 790, 794, 801, 806, 826, 828, 831, 837,846, 855, 858, 859, 864, 871, 872: n = A,T,C or G
gnagnntnnnnntttgnaacnctggctactngttctttttgcaggatcccatcgattcgnattntgaacaagctgtntcgtgtgtacagttgctgctgtnattgagccagcagtgccctgncctgccctgcanngtctgcacagctcccactgcttctatnngntgttgggcncgtgaggcatgacttggangggggcctggtgcctgaggacctgctgaagagaatgctcaccaccagctctntgntnccctttctgctttggnaatcaacacgtgtntgcctgcagtggccgngaccgtgactgtttctgcccttgtgcctagttaanagccttcaaaagcataatgaacactttngatatgatattggaactttagtaaatgctttacttccctctaattgcccncaaatgccttaatnttgtggactgtttatttcaacaggtggaagtgttggtcntgcgaaatcttggtnttcgcatttcaagaagggagtgctttattanttcttctttctatggaacgtttcaagtgattggatntaaagaagggctctgaagcaggagttnncacctgctctgagggaacttggggctccagggacgtaccccaaatgtgcgcccagntttgaaactccctgacagcctgntactacntagtgggctcgagggtttncannatgaagaagagttgtncccctaaaagtggttgaaaccctgtggctttcaaagcaaaggtacccnttgtcccancattnttnncgnnaggtaggggnctcattggaaaacntgtngggcaancctgntggtttttggtcccccctgntngtnacaatngggaccttnttttgaacngtnnggaangggctannt

SEQ ID NO: 5068 - DNA, 776 bp, Homo sapiens
  misc_feature 5, 14, 96, 97, 497, 534, 561, 607, 650, 651, 652, 653, 654,656, 661, 662, 664, 665, 666, 668, 669, 670, 672, 673, 674,675, 677, 678, 679, 680, 683, 684, 685, 686, 687, 690, 692,693, 694, 695, 696, 697, 698, 699, 700, 701, 702, 705: n = A,T,C or G
  misc_feature 706, 707, 708, 709, 710, 711, 718, 719, 720, 721, 728, 732,734, 737, 744, 746, 747, 748, 751, 755, 756, 766, 767, 768,771, 773, 776: n = A,T,C or G
caaancagctttcngaccccttcggacccatcgattcgttgctctatgtgatgtttattatcaaatacatataattttgaagattttaatgaatgnnttaagattttatctttgtgtagaatgtggctaaagaaaccttagttgagattcaagaagttggtgtctgtttctgattcttatcacaacttgctacttagtgtctaccaagtcctccacctctttgctcctcaaagagctgtgaaaaatgatggcaggagccggtacaacaccacagacttagagaagggcacagtgctgctttattgaatgatctaccaaggtaaaattttgccgggtcaagaaatagcaatttaatccatttaaaggaatgaatataatttgaaacattaacttatttcaagactaacatctcaaagtgttgagaccttttttaaaagagctttctggattttgagcatactttcactggctgtgatttataagaatttgtggtttgnggagtactgcctaaatgccagggtaaaataaggcagncccatgccttacctgccctgggctcanggcctcacatccttttggtacgcacatcttttctcttctcccttgntctgctctcccgcagcatatacctcctagcccccagagcaaannnnnanaaaannannngnnncnnnnannnnttnnnnnccnannnnnnnnnnngannnnnnnaaaaacnnnngcctttnaaananatnggggggncnnnttnccgnnaacccccacnnngtnanaan

SEQ ID NO: 5069 - DNA, 869 bp, Homo sapiens
  misc_feature 5, 6, 7, 8, 9, 15, 40, 44, 686, 796, 799, 813, 819, 842,862, 864, 866, 867, 869: n = A,T,C or G
gagtnnnnnttttgnaaccttgctaatgctggctactcgntctntctgcaggatcccatcgattcgaattcggcacgagagcagattcagtgtcgatgagagcctgcttcctgcttcatagatgatagaagtgcaaagccagctgtctgggccttttttatgatactgatcccattcatgaatgctctgccctcatgatcatttcaattcccaaaggccccacctcctaatattatcacagtgataattgggttttcaacacatgaatttgagagaaacacattcagttcctagcattagcttgcttatatttatttcatctcattctctctcatagcttttatttttgtttcccctgtccaatttattatagttttttgtctttttataacttttaaccatcttttaaatttctcttatttatttctctttttactgttgagttacaactctcggcttattcagtggcaaagcaggaagagatggcactgaggcatcttgatcctgaaggatcttttaattcctcttagcagtcttaacattttttccatcagcccctgctatagtttgaatgtttgtgttctctttaaaatccatgttgaaacttgatctccaatatgacagtggtaagaggtagggccttatatttgagagcactacagggtgagtacactcaataataatgnattggatatttaaaataactaaaattgtataattggaaatggtccctaaccccaaaggaaatggataaatgcttgggggttgatggatacccccaattaccccttatggngantcatttacatattnaaatgncttggatcaaaaccattcaccancattccccaccattaaatgntntnncn

SEQ ID NO: 5070 - DNA, 763 bp, Homo sapiens
  misc_feature 2: n = A,T,C or G
tnaaaatacaggctacttgttctttttgcagggatcccatcgattcgaattcggcacgagagggacaaggctataaatatcattaataccaggttcaggagtttgcactgcactaaaaatcaactcagctatttgagcaccttttatagagtggaaatggggttgggcagtagagaagagcacttttagagaggcttttctgcagtagtcaggggttacacctgttaaccagccataattttttttttaagcggctgtgctgaggatgagccccatgtagttggtgcaggtggggacacactgcctgtgtaactagaaaaactaggcatggccgggcacggtggctcacacctgtaatcccagcactttgggaggtcaaggggggaggaacacttgaggccagagacaatataatatataatataatatattgaccagcctggacaatataataagagcctctctgtacaatttaaaaactaaaagcctggggtggtggcacatacctgtagtcctggctacttgggaggctgtggcaggtggattgcttgaacctaggagttcaatgctgtagtgagctaggatcgtgccactgcattccacctgggttggagtaagaccctgtacacacacacacacacacaaaacaatgcacaatgtgcatcaaaagggaagcgaataggctctgtagtaggtggcaaaaggtggtggtctgggaaacaaggccacctgtggtgtggggtgggaaaatgtttaaaccctt

SEQ ID NO: 5071 - DNA, 865 bp, Homo sapiens
  misc_feature 2, 3, 4, 5, 6, 7, 8, 9, 10, 14, 15, 31, 727, 752, 753, 754,755, 756, 757, 758, 759, 760, 761, 762, 763, 764, 765, 766,767, 768, 769, 770, 771, 772, 773, 774, 775, 776, 777, 779,791, 792, 800, 803, 808, 811, 821, 822, 832, 840, 852: n = A,T,C or G
  misc_feature 854, 857, 860, 864: n = A,T,C or G
gnnnnnnnnntttnnaacttttcaaatatcngctacttgttctttttgcaggatcccatcgattcgaattcggcacgagggccgctgcttctttcccgagcttggaacttcgttatccgcgatgcgtttcctggcagctacattcctgctcctggcgctcagcaccgctgcccatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgcctcattgagttcggtgcatctggccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaatttttttttaacaacattaacttgtggcctctttctacacctggaaatttactcttggaataaataaaaactcgtttgncttggcttctgcaaaaaaaaaaaannnnnnnnnnnnnnnnnnnnnnnnnnanaaaaaaaaactnngagccctntanaactnttnggggggccgnntttaccttanaatcccgnaccttggattangnatnccntttnt

SEQ ID NO: 5072 - DNA, 1228 bp, Homo sapiens
  misc_feature 5, 8, 38, 41, 46, 52, 53, 74, 106, 108, 134, 164, 193, 217,229, 239, 260, 261, 277, 278, 292, 297, 299, 304, 309, 315,323, 324, 332, 336, 340, 344, 354, 355, 369, 378, 384, 395,406, 408, 411, 412, 437, 443, 447, 451, 462, 474, 475: n = A,T,C or G
  misc_feature 483, 484, 485, 490, 492, 494, 497, 502, 504, 507, 510, 514,517, 521, 526, 529, 530, 532, 533, 540, 541, 548, 555, 559,561, 564, 566, 572, 574, 575, 579, 580, 582, 583, 586, 588,590, 595, 596, 605, 606, 607, 616, 620, 621, 626, 627: n = A,T,C or G
  misc_feature 630, 635, 636, 637, 638, 653, 660, 663, 668, 670, 673, 674,675, 679, 682, 683, 684, 686, 697, 701, 703, 704, 706, 719,725, 729, 733, 735, 736, 738, 740, 745, 747, 759, 764, 776,784, 787, 795, 803, 805, 806, 810, 817, 820, 831, 840: n = A,T,C or G
  misc_feature 841, 846, 848, 849, 853, 859, 865, 875, 877, 880, 881, 886,895, 897, 908, 932, 936, 940, 942, 945, 946, 953, 958, 959,965, 973, 980, 984, 992, 1002, 1005, 1013, 1021, 1022, 1023,1032, 1036, 1038, 1042, 1044, 1047, 1048, 1052, 1060: n = A,T,C or G
  misc_feature 1063, 1072, 1073, 1077, 1078, 1083, 1091, 1093, 1099, 1103,1109, 1114, 1115, 1118, 1121, 1125, 1127, 1128, 1131, 1134,1140, 1147, 1148, 1155, 1178, 1195, 1205, 1211, 1213, 1214,1215, 1216, 1217, 1224, 1225, 1227: n = A,T,C or G
ggccngtnccccttattggaacctttctaatgctggtntantccangtaccnntcgtacccacgattcgaattnggcacgaggctccacccagttctcccagttcntnatggacgactcgctactgctggcctngggggtgttcctggggccgcacaactcctnatccggcgagattgctgtcatcagcctanactccttcgcgctgctgtcccgcntgcggaacaagncctatgacgngtttggctgttggctcacccnngaccagcctcatcttnnggaacctgcaccgnattgnanatatnacctnctgctntgtgctgnngcttaacnttgnctanaacnatgtggagtnngagaacgtcaacgnggtgaagcnggctgnttaagatccanaacctcaatgncngcnncgtccgcacggtgatggtggcccgnctgcanccgnttcnacagtcctganttaaaacagttnngcctaccnnncaaanancnatncatantnctnatntctnttntttncttcnaanntnncatctcnntacttanaatttcncttncnaancnttttcntnntttnntnntancntnttctnnctcctcccnnntctctatcntgannttcanntantcttnnnntactacattcttcanttcatantcnctcananttnnnctcntannntncattatccttnctancnnanactcttatcaccntcgcanacanctantnncntntcacncnatcttctaatanacatncctcctctcgcncatctctnacnctgtaacntctatatntnnttcnctgcatnctnaataatatatntacactcannacaanannacanacaccnctcatnttcatacttntnaannctccnctcctcatntnttctcgtcttntacatactcaactactctatatancgtngacncnggnnatctctncgaannttctcnctcacttnagtcacnattntatcactntcacttcatntcncgtctccntctaacannnccattaccntcantngtgntnttnnctcnctcactcnctntacatcatnnactnntctantcatgctnanatatangtcncttcanatacnncgntancccngnnatnttntctcanaaccacnnctctatntttattttcgtacactgcaatcncataatcttcggcatcnttccatccgncatctncnnnnnatatcanntnt

SEQ ID NO: 5073 - DNA, 920 bp, Homo sapiens
  misc_feature 2, 4, 5, 6, 7, 8, 9, 14, 36, 528, 531, 533, 541, 544, 551,594, 595, 597, 600, 611, 625, 632, 645, 665, 666, 675, 676,682, 685, 689, 698, 702, 704, 705, 707, 710, 711, 714, 716,717, 718, 720, 722, 723, 732, 736, 738, 740, 744, 754: n = A,T,C or G
  misc_feature 759, 761, 762, 766, 767, 773, 774, 776, 781, 783, 784, 793,796, 803, 804, 807, 809, 812, 815, 820, 826, 828, 831, 834,835, 836, 837, 844, 845, 846, 847, 848, 850, 853, 856, 858,861, 864, 867, 869, 872, 873, 877, 882, 884, 890, 892: n = A,T,C or G
  misc_feature 893, 897, 900, 904, 908, 913, 916, 917: n = A,T,C or G
gngnnnnnntttgnaacttgctaatgctggctactngttctttttgcaggacccatcgattcgccaacatggtggtctcaaactccccacctcaggtaatccacctgcctcagcctccaaaagttctgggattgcaggagtaagccaccacacccgtcctcagtgcctggacttctgcagtggacttcctttaaaaatcctggaatatacactgcagtagaagaacaaagcatacttcagtcgtttaaggctgaggtatgctttgttcttttactgcagtgtatattccagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctaaaaaaaanaananaaaaaaanctngagcctntagaactatagtgagtccgtattacgtagatccagacatgatnngnatncattgatgaantttggacaaacccncaacttngaaatgcatttgnaaaaaaaatgcttaatttgnngaaaatttnngggaanccntatnggctttcantttngnnanccnnttntnnntncnnggcctttanaccnangnttanctaccaaccnaattngnnattnnattttnnantggtntnnaagggtttnaanggggggnnaangnttnggnaaggntttttntnaanttnnnncgggccnnnnntnccnaantncanttnggncnccnngccncccanantttttngnncccnttntatngagngggtnaanncct

SEQ ID NO: 5074 - DNA, 810 bp, Homo sapiens
  misc_feature 2, 3, 4, 5, 6, 12, 13, 14, 15, 16, 17, 18, 19, 20, 25, 28,583, 633, 679, 699, 712, 714, 715, 716, 717, 722, 723, 724,725, 726, 727, 728, 729, 730, 731, 732, 733, 734, 735, 745,750, 786, 789: n = A,T,C or G
gnnnnntttaannnnnnnnnttttnaanatacaggctcttgttctttttgcagggatcccatcgattcgaattcggcacgaggtgattcctatttcaatatgtgaaacacttaaccaaagaatatatttcgatgaatcttaaacttgccttaaaaacagaagaggttaaaaagaatttagaaaaaataaagttttagagtgtttgagaatgtgtatataaaatattttcaaagccataatatggatgctcttatggctcagaagcatgcctactagaacacgtctcggaatgagagatgtttaattctgtcacctcccagaaagttttgcagggtttctcacttgaatttgcttccctttgcaacctcttgtcctgaaggcccccttcccacctggaaatgctgaggcatgggtgtgataagaatcagtcattttgaagagaataagatgatgactttattaacatttccatatatgctgattgtgtgtgtggcggggtgggggctggggtggaggcttaaggcaaaagctagaattagtcatatgaattatgggcttgtttggagacccacctgaggctcanccctagccctcacccacctggggagtttactacctgggggccccccttgnccatgcctccacttccaaaacaattcaattgctttttttttgggtnccaaaataaaaccctcagcntagcttcttgccnannnnaaaannnnnnnnnnnnnnaaaactcganccctntaaaaactataagtgaggtcggttttaccgtagatnccnaaccttgataagaaaacattg

SEQ ID NO: 5075 - DNA, 810 bp, Homo sapiens
  misc_feature 2, 3, 4, 5, 6, 18, 607, 608, 609, 610, 611, 612, 613, 614,615, 616, 617, 618, 619, 620, 621, 622, 623, 624, 625, 626,627, 628, 629, 630, 631, 632, 633, 634, 635, 636, 637, 638,639, 640, 641, 642, 645, 651, 670, 678, 680, 681, 686: n = A,T,C or G
  misc_feature 687, 689, 696, 699, 703, 706, 709, 712, 713, 716, 718, 721,729, 738, 745, 747, 748, 749, 751, 764, 772, 775, 782, 787,788, 795, 797, 798, 807, 808, 810: n = A,T,C or G
gnnnnnttttcaaatacngggcctcgtgcttttgcaggatcccatcgattcgaattcggcacgagagtcattacaagttaggatcctgggtaaatggcaacctccacctcccaggttcaagcagttctcctgcctcagtcccccacatagctgggactacaggggcacaccagctaatttttgtattttcagtagagttggggttttaccatgttgaccaagctggtctcaaactcctggcctcaagtgatccgcccaccttgacctctcaaagtgctgggattacaggcatgagccatcacgcccggccacgctgttggttcttaatgacacagcttaactttattgtgaaaagattgcagcaacaaatgagattttacctgtatttgttaaaaatgcttatccttgtctaagactggcaacataagcagttcttaggcttctatgccaatggacactaggcagtaatacatgtgcagtgctaatagaaaatattggagtaagggtgtactaaggaagttctcaatctttccccttcactatcttctgtaatgtaacttcaataaatgtgattctcatcttggcacaaaattgggaaaaaaaaaannnnnnnnnnnnnnnnnnnnnnnnnnnnnnnnnnnntcnggcctntaaaactttaggggggtcntttttccntnnacccnncnccttganaangaanccnttnggnnggngnttngggcccancccccaacntggaatngnnngngaaaaaaaaaggntttttttnggnaaaattnggggnnggctttngnnttttttttnnan

SEQ ID NO: 5076 - DNA, 794 bp, Homo sapiens
  misc_feature 7, 8, 16, 101, 344, 349, 373, 394, 431, 446, 455, 477, 544,559, 574, 587, 594, 619, 638, 646, 656, 658, 660, 666, 677,684, 703, 721, 729, 738, 750, 766, 770, 777, 788: n = A,T,C or G
caaatcnnagctactngttctttttgcaggatcccatcgattcgaattcggcacgaggtcatgcccggctaatttttgtatttttgtagatacagggtttnaccatgttggccaggctggtcttgaactcctgacctcaggtgatcacccgcctcggcctcccaaagtgctgggattacaggcgtgagccactgtgacgggccttacatgcaatttttatttatagccagtattagagaattactaggaaatttcatttttatatttagtgggagaaagccatctacagcatgtcttcaagcatggactatctgtaacatacagtgtgcttgcttttgaattgnttgantgttaaatggccgtaactgattgnattttcgttaattgttaatanataaaccagatgttctgaaatctgttcttaaagcagntgccctcaatggtgnttttgcctncctgcttctgagcctcttgggnttactggagagtacaggtcataaagagacctgaactcttgttgtatcaaccattatgtcatcctctnactgccaacattttnaaacagactgaggtntgcctttcgtaanaaacatntacttacatattgccattccttggnttacctgggggaaagcccnaatcgttnttaggacttnananggaganacacaggtctnttgaaanggatgccgggggcttaatnaaataaaaaacttttggntcaataanaagtctggnattaaaaacaanattaattcaacatttntggnagaaggnaccttggggcngggaat

SEQ ID NO: 5077 - DNA, 927 bp, Homo sapiens
  misc_feature 1, 2, 8, 13, 14, 15, 16, 18, 28, 37, 41, 43, 75, 85, 88,133, 136, 155, 175, 223, 233, 238, 242, 255, 263, 272, 273,275, 286, 289, 291, 301, 302, 308, 316, 321, 332, 333, 337,341, 342, 343, 344, 350, 352, 355, 369, 370, 385, 408: n = A,T,C or G
  misc_feature 433, 435, 442, 446, 451, 467, 473, 479, 487, 490, 492, 500,503, 509, 512, 517, 527, 530, 538, 539, 543, 551, 560, 561,569, 573, 576, 577, 580, 587, 588, 605, 607, 627, 636, 638,642, 645, 653, 654, 655, 658, 667, 676, 681, 684, 697: n = A,T,C or G
  misc_feature 702, 707, 716, 721, 724, 727, 737, 740, 747, 749, 750, 755,757, 766, 768, 769, 775, 787, 788, 795, 796, 797, 804, 812,816, 817, 818, 819, 822, 830, 837, 850, 851, 857, 872, 881,885, 889, 895, 901, 902, 905, 907, 911, 913, 914, 915: n = A,T,C or G
  misc_feature 918, 920, 921, 922, 924, 925, 927: n = A,T,C or G
nntggggntttcnnnncntgggatactntctctctgnaggngncgatgggattcgaattcggcacgaggcggagnaagaggggtngtnggttggaaggaggaattctcctttagggaagatgtctgggaaggnctntctgagagagtggcctttngaaaggagaccctaattggntgacggatgagaggctgaaccatgtaagtatctggttggaaaacattncaagcggctncaganggtntgtgcaaaggccnttggacanggtcacccnngnttacatggccnccntnagccagcctnntaaagnaaagggtntcatnaacaaattgcnnaaancctnnnnaggttngncanaggagggagaggcnntggaatgttttgctngaatagggttagtagtgcccctncatgattgaccagttccccctctcnanaatgttncctnactgncgcaggtttatgtagngggggnctgccntcccatanttngncccctctntancttggnccntgggntgggatgaangtncatccgannacanctttttanagttgcccnnctgtctcnattnacnnatnacccccnncgaaactttgtctcccnancaccccaaggatttcccttngggtatcgncnccanaanaaagcaannngtnggatcaaantaatgggcncccancantttttgaattatnctacncctgnagactcccnttcanttngcnttttaaaaanccnctttttntnncgggntngggtgcaantnnctcttnaaattctaaacnnatcttgnnnacccccncctaaacntggnnnnggncccctaanctttccnacttcaacaaaanngtgaanttgcatattatcttncattttggntctntaangacccnaatgcnnggngntatnannncanannncnncn

SEQ ID NO: 5078 - DNA, 809 bp, Homo sapiens
  misc_feature 3, 4, 5, 6, 7, 8, 9, 11, 12, 13, 17, 19, 22, 26, 27, 28,29, 30, 40, 499, 517, 520, 598, 628, 650, 651, 653, 661,662, 667, 668, 670, 676, 680, 703, 710, 714, 732, 734, 749,767, 770, 774: n = A,T,C or G
ggnnnnnnngnnngttnanacncccnnnnnttttcaaatnctaggctactcgttctttttgcagggatcccatcgattcgaattcggcacgaggtttagtcttgtagctgtatagcattccattgtataacttataatttatttatgggttgtactattgatgaacatttgagtagtcttcagtttggaactaccacatatggtgctgttatgaatacttttgcacaggtatgtgaacacatgtacacattgcagttggtatatatacagtactgaattactggcttataaatatcattaaattttaaaaacaaaattaattgccacaagcatattattgtatctttgaattttaaaccaaattaaaaattctatgagttgttgaatattataattgtactattaagtttaaattgtctgtgactatagctataagacgatgcccatggtactttgaatggcaacactagcaaaataatattctaaggaagagggacangttttgggggacaactancantgtctgtagcataatatagactacaaattgattactatatcacccatgaatttagctcagactcaaacacaaatttantttctttaaaaaatagaaagtccatttatntttaaatggggcctgattttcnnanaaaaaacnnaaaannanaaaaanccgnccctttaaaactataggggagtncgttttncttnaatccagaacttgataananacattgttgagtttnggccaaaccacaactagnatngcantgaaaaaaaatgcttttttttgggaaatttgggat

SEQ ID NO: 5079 - DNA, 853 bp, Homo sapiens
  misc_feature 3, 6, 7, 8, 9, 10, 21, 25, 32, 625, 678, 723, 755, 758, 763,769, 788, 791, 795, 799, 804, 805, 808, 816, 817, 818, 822,823, 826, 832, 834, 836, 842, 848, 851, 852, 853: n = A,T,C or G
agngtnnnnnttttctaacgntggntactcgntctttttgcaggatcccatcgattcggcacaattggtattcaaacccaagtctgtttgactcccaaacccatactttgaacctgaagtctgtactgctgaaagtttctccttattgaagaatttatattttgcattaatttatgtcttcagaattatacaaagtattgggccacaccaaatttgagtctggtatagtagccttcttgtaaaaaattatatcatataacatttttatgactgtgaagacctcttaattcttcaggaaggagggccctttttcaaatcagacatcctggggtttttactgaccttatttcattctctgaagaatgaaggaatttcccactttgtagtaagtcatggaatgtatagcattccttctatagttgaaccagataaatattagcaagtctgtttagaatatgacactggaagttttttcctgtctttttttaaaagaggtttttggaattatagtcaatctgaaacttggtcttactaataaagaagtgaaacctaagtgagctcccttgctccctgatggctcttggtataagtctcacttaagtttctctgacgattttcagggttnatttttgtgagtgacccaaggaacggtgtattttgatttgaaaactgaatggntggaggtgtgtattggaagcaatagtctgaatctttttgggggtnatatactcctttttgaagctgatgaaagcttnggnaaacntcccanaaaataaacccttaatccngcncatnaaanggaannttngcatttcnnntttnngcngacccngntnaatatncaattnttnnn

SEQ ID NO: 5080 - DNA, 787 bp, Homo sapiens
  misc_feature 1, 2, 3, 4, 5, 14, 670, 672, 725, 737, 760, 772: n = A,T,C or G
nnnnnttttaagancagctcttgttctttttgcaggatcccatcgattcgcttgctcatcctcatttggtaaactgctacgttaaatgtttcaggtatgtctgattgacctgggctgcttccgagaaattgatgagctaataaaaaaggaaaccaaaggcaaaggttctttggaagtactcaatctgaaagatttgaagaaggagatgagaaatttgaatgacacccatcagtctcttcacctctaaaacactaaagtgttttcgtttccaacagcactgtttcatgtctgtggtctgccaaatacttgctcaaactatttgacattttctatctttgtgttaacagtggacacagcaaggctttcctacataagtataataatgtgggaatgatttggttttaattataaactggggtctaaatcctaaagcaaaattgaaactccaggatgcaaaatccagagtggcattttgctactctgtctcatgccttgatagctttccaaaatgaaagttacttgaggcagctcttgtgggtgaaaagttttttgtacagtagagtaagattattaggggtatgtctatacgacaaaaggggggtctttctaaaaaaagaaaacatgagcttcatttctacttaatggaacttgtggtctgagggtcattatngnatcgtaatataaagcttggatgaatgttcctgattatcttgagaaaccagatnttgaaaaattgnggtcgggccttaaataatttcgntggacatgctgncataacttaaaatat

SEQ ID NO: 5081 - DNA, 819 bp, Homo sapiens
  misc_feature 1, 2, 3, 6, 7, 10, 13, 17, 18, 23, 25, 33, 42, 52, 56, 67,84, 99, 103, 104, 109, 132, 134, 149, 151, 158, 163, 167,170, 171, 176, 188, 195, 196, 201, 205, 208, 212, 221, 225,226, 230, 233, 253, 262, 264, 267, 288, 293, 299, 303: n = A,T,C or G
  misc_feature 309, 323, 326, 335, 336, 338, 347, 350, 351, 352, 388, 407,413, 414, 420, 427, 439, 440, 443, 452, 455, 458, 466, 489,495, 498, 499, 503, 504, 512, 513, 532, 542, 560, 564, 582,595, 598, 608, 609, 611, 627, 634, 636, 641, 645, 648: n = A,T,C or G
  misc_feature 656, 660, 663, 664, 666, 671, 679, 680, 696, 697, 703, 714,716, 725, 727, 733, 738, 740, 742, 746, 747, 748, 760, 761,762, 763, 771, 776, 785, 799, 807, 809, 815: n = A,T,C or G
nnncgnngtnttnaacnnccagngntttagccnagctatcgntctttatgcnggancccatcgttcnaattccgcacgagaaancatcaaggtggctgnttgnnagcantgatgatgacgaatctgattctnangatgacagtaatacntnaaaattnaaccncaanttnngggcngagctggacaanaaggttnntgaanactnaanatanttagacttncctnntgtnctnattttttgacataggtcctnaaatctggntnaangcaggcgccccttatcctacnttatntcatcngggngtctantaggagagtgaganttntgtgatccnntntgattgggncannngtagatggaggcggctcacataccaatgttggaatntaagcagtgcggggaggtntacatnngcagtnctctccncaagctaattcnnggngcaggggcnatnatncatggttnttgtctgtctgtggaaacaatgnatttangcnncccnnctggcacnnctgacagatcttcggatgntgctcttgtntctaaaaactgggtgtcnagangaacactgatgtatgtanatgaaaaaaaatnctngcttaggganngnggaatcttgctgaagngaaaaantnaaagncctngantttttttncaanggnntnttgcnaaaataannttaaacgaattgtacnnaacacntgaaaccgtangntggtttttnantttttnggggngntnaaannnttttggtccaannnnggcatggnccttncccctttcntatttaaaaaaggnttcggtancncaaaangaat

SEQ ID NO: 5082 - DNA, 1421 bp, Homo sapiens
  misc_feature 2, 4, 6, 12, 16, 18, 26, 28, 29, 37, 39, 42, 44, 46, 49,53, 57, 60, 61, 65, 68, 71, 74, 81, 89, 90, 91, 95, 98,104, 109, 113, 114, 117, 121, 123, 126, 130, 136, 155, 156,163, 165, 169, 171, 172, 173, 177, 182, 183, 187, 189, 190: n = A,T,C or G
  misc_feature 191, 192, 200, 204, 210, 211, 212, 224, 238, 241, 249, 251,256, 261, 262, 265, 266, 279, 284, 286, 290, 293, 304, 313,320, 337, 340, 345, 348, 355, 357, 368, 369, 372, 376, 377,385, 399, 419, 420, 425, 436, 440, 441, 447, 449, 456: n = A,T,C or G
  misc_feature 480, 483, 484, 490, 494, 497, 507, 512, 520, 527, 533, 540,546, 552, 554, 558, 561, 565, 570, 586, 593, 609, 611, 616,627, 629, 631, 639, 645, 648, 650, 662, 663, 673, 679, 685,689, 697, 707, 711, 720, 726, 730, 737, 742, 743, 744: n = A,T,C or G
  misc_feature 745, 749, 750, 751, 755, 757, 776, 777, 789, 790, 793, 799,800, 801, 808, 810, 817, 818, 825, 827, 833, 845, 848, 851,860, 861, 869, 885, 890, 901, 907, 912, 915, 916, 917, 922,923, 933, 941, 956, 957, 961, 968, 969, 979, 992, 995: n = A,T,C or G
  misc_feature 1003, 1010, 1030, 1036, 1039, 1045, 1048, 1050, 1071, 1084,1087, 1094, 1098, 1103, 1107, 1108, 1110, 1113, 1118, 1131,1159, 1160, 1165, 1168, 1174, 1176, 1185, 1191, 1196, 1210,1213, 1226, 1231, 1243, 1246, 1256, 1261, 1266, 1268: n = A,T,C or G
  misc_feature 1273, 1276, 1279, 1285, 1286, 1289, 1291, 1297, 1299, 1306,1307, 1308, 1310, 1313, 1317, 1324, 1327, 1330, 1352, 1353,1357, 1358, 1363, 1369, 1372, 1377, 1385, 1388, 1389, 1391,1394, 1409, 1418, 1419: n = A,T,C or G
gngngnaacacngaanancgaaaccnannaaacggcncnaanancnggnaaanacangcnncggnccncgncangaacccnttgcaacnnncctntangcagancccancganncgngtcngnaangccngctgcntgggaggccaggggcaggnntaattcncntganannnagancaggnngaanannnngccgggcngggnagaagnnnaacggacaatgncacattcaaagcanganccacccananagcgnagcannggnngaagccagggaanggacncnctgncanttggaaaactngggaagccngaaggancgaggggccctgccggnccnacaanagnagctcantngaagggacgtnnacncaanngggacgcnagaacgcggccaancaagatacgaaaggggaaannccggnacgagagcccngggnnacggcncncggaaanggctagaaaaaagaataaaggggnaanngatcgnaggnatngagggccatngggancacaggcncaaaagnggccancaaagancacagnggaagngnccanagnactncgggncgggagatcagggggngataaantgaataaccaaggccnanggacncgaaaaaaggngngnccaaaaangggggnccnanaaggggggagcnnccaaagaggncaaaanaaaatngccngaggggcnagagaaaccncccncagaaggangggggncaanaaaatcnaaccnnnngggnnnaaangnggggggggggaaagggacnntcaccaaaggcnncanaaaaannngaagggncnccccccnncaaaaangnaaaaangggaaaaacccnatntcnagttcaggnnaaaaagtnggggggaaaaggcccnaaaanaaattaaattnaaggangaaanccnnngagannaaccccccanggcaaatngggccaaacatgggnncacncgggccnnggggggcatngggcccccaaatnggncccccccnaccgggnaaaggggggcaaaaaaggancggggnganaaaaanggncngcctcccatagggcaaccatntgcacgggggccnccncaaattngggnagggnaaanncnaantcgcncaccaatgttaangggaaaagcaaccggcaaaagggccatnnggaangangccccngnaaaccaaanagacancaggntagtgaaccttccnaangggaaataagatnccggnaaaaggcaaggncgnaaagaaagtngaaanccgangnaaccnganganaaggcnnaanangggaancnattacannncnaanaagnaggcaanggntgnggaaagaaagatccaaagcccnngggnngcagnatgccnggnaaaantgggaagntannangancctgccaaaggcttnggaaaaacnncc

SEQ ID NO: 5083 - DNA, 864 bp, Homo sapiens
  misc_feature 2, 3, 6, 7, 8, 9, 10, 11, 15, 19, 20, 22, 60, 61, 63, 65,75, 85, 87, 94, 100, 101, 103, 111, 153, 156, 163, 170,171, 178, 179, 189, 194, 196, 202, 220, 237, 243, 246, 252,266, 277, 293, 294, 309, 375, 387, 393, 416, 418, 422, 428: n = A,T,C or G
  misc_feature 457, 571, 583, 589, 610, 611, 613, 627, 628, 630, 633, 634,638, 658, 659, 662, 667, 679, 695, 699, 706, 708, 717, 734,736, 751, 755, 756, 757, 762, 794, 797, 805, 809, 823, 844,859, 860, 863: n = A,T,C or G
gnngtnnnnnntttncaanntnggctacttgttctttttgcaggatcccatcgattcganntncnaggccggggncctgtcattntngatcatnatcttnngntatgaatnggacctttacagtcactgacaggacaacaacaggctggagtnggngcccatnctgctgnngtgcctnnaagaccacanccctnanaggctnctggtcctgctgtgcatngcccattggatgccgangggctnatnactcanactagtacctcacntgatcagatgncagaatcaaccaaatnntgcagatttcagtcngttgtgaagtatttgctgcatcaacatgtagaacgactaacattcatgatgaagccgagaaacatncacaagtcctgncggctnaaaaagcttatgatcctgcacgntntctnatagtnggctaaacagatggtataaactgacgaanagacagctgctactgctcctgccaatgtgagcaaaggcacaatactacttgctccaggacctaaacctgttcgaagaagattgtaaattggaagatgaatttaggccagaagtngatgaacatacncaaaanacgggtgggcttagctgctgnncntgcatcacaacctnntnttnncagntctgctgggaacgataaganngtnttcangcatcaattagncgtaataaggaaaccngcancgatttngnccaaatggnatagcctattgcagggncnaatttaaaggatgtncttnnngaganaaattacctgggaagttcaactgggaacaacntcnaaccattntctnacctataagccaantggccgttaactgtgaacatncttgggttttaaaanngcnt

SEQ ID NO: 5084 - DNA, 468 bp, Homo sapiens
  misc_feature 1, 11, 15, 17, 250: n = A,T,C or G
ntccttttgantacntntacaagctacttgttctttttgcaggatcccatcgattcgaattcggcacgagatttcaacatactgttgtctaatcatcgtgactcccccaatttctcttttttagaggaaagtattgtacagatgtatcttgaagattataatcttggttgattattgcctattctcactttaggaatagatggtgatagcttatgacttgtgttgtataacgaggtagaaatattgctgncttctctgacatagcttctcaaagagatcattaatgtatgatatctaataaaccatctaatgcatgtaacagtgatcagcaaattaataaattagacctctattcatgcttaaattatcaaagctaatatttaaatgagatgttctattttaattaaaatttctggcaccatcgttaatgagacttagaatttcaactagtgtatttagctcttactt

SEQ ID NO: 5085 - DNA, 476 bp, Homo sapiens
  misc_feature 3, 4, 7, 8, 9, 10, 16, 18, 93: n = A,T,C or G
gtnnttnnnntttgantncaaatacaagctacttgttctttttgcaggatcccatcgattcgaattcggcacagaagaccaagcgcatgcgancctctttcaagcatcaccagctccggaccatgaaatcctactttgccatcaaccacaacccggatgccaaggacctcaagcagcttgcccagaaaacaggtctgaccaaaagagttttgcagggagaacaaatcttggggcattacagccaaacatcccgacgtttgaaaattccctaaagtattaaaagaaggggaaaagtttgatcggaaatccactgcagtgaagacaaagacactattaggttatgataatcatacattaaaaaatttattaagccaaaaaaaagagagagagagagacttaaatgtcatttactgaatgttaacgaaacttgtgttctttatggtgtctaacacaactgaaggcctaaaattatgtgg

SEQ ID NO: 5086 - DNA, 846 bp, Homo sapiens
  misc_feature 3, 8, 10, 13, 14, 16, 31, 62, 135, 141, 145, 165, 176, 205,207, 253, 379, 391, 393, 394, 397, 402, 423, 435, 444, 446,451, 474, 484, 485, 499, 510, 519, 522, 546, 547, 552, 564,593, 611, 612, 624, 625, 633, 638, 643, 648, 650, 656: n = A,T,C or G
  misc_feature 670, 676, 695, 702, 707, 714, 716, 723, 727, 738, 742, 743,748, 750, 756, 759, 760, 764, 772, 781, 786, 790, 794, 798,809, 812, 814, 816, 817, 819, 822, 825: n = A,T,C or G
gtntttcncnaanngntgggaactcgctctntctgcaggatccctcgattcggaaatatagngagatgtgggatgtgaatgcccatgaaagacatattattacacttgaatatattcttgcttcactttaccctncataanatgntgtacattagtgctgatcangtttacagagntacatgggcgctttcctaaccattcagtnangaattaaaatatggcattgtataacaactgggaagaagctcatagnggatataaagtagagtagataatgggtcaccttggatagcctctgatacattcttgtatatgggcaaaataatgattacctatacgtgtatttaagcttaagcatcatataaacagtctttttaancttatggtaaantnnatnatatntaaaagctgtgatctctaggnagtccttaagtnattagtacngnacttnaaaaagatttttaataggtccgncaccggtggnntcatgcctgtaatnccagcacttcnggaaggctngangcaggccgaatcacctgaaggtcnnggaanttcgaggatcanaccttggccaaacattggtgaaaaccccntggtcttaaacttaaaanntttttaaaaaanntaagcccnggccnttggntgggnanaggcgnccctggtaaacccnaagctntcctttaggaaaggcttgnaggccanggagnaaattancnttggaancccnaaagggggcanaaannctttncngtctcngcnnaagnaatcgcantcaaatggnaactntcanaccntaanggggaccaagnaancncnnanacnttnattcttcaaaaaaaaaaaaat

SEQ ID NO: 5087 - DNA, 789 bp, Homo sapiens
  misc_feature 2, 4, 6, 10, 12, 14, 16, 24, 27, 35, 618, 662, 665, 693,705, 708, 722, 748, 753, 781: n = A,T,C or G
tnananctgntncncnttcaaatnctnggctactngttctttttgcaggacccatcgattcgggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcaacggcctgaaagcctctgagctacctcgactttggacagagtaatgacttccccagaaaacgtcatataagacttttaccagcccctgaangaccaagagggagccattcctttgaactttcatttaactttggnttnacttctctttaaaacttggggtagaaantgcaaaagcccncanaaattgcttttccnttcccccgccttttgaacatgaaggnccttnaattaaaagaagcttcccggaaccattnaaaaaaaa

SEQ ID NO: 5088 - DNA, 759 bp, Homo sapiens
  misc_feature 1, 17, 23, 37, 95, 114, 131, 474, 554, 618, 624, 659, 693,724: n = A,T,C or G
nttcctaatgtttcggntccttncttccgcttctaangcttggcgtgcactccagcctacatgacagagtgagaccctgtctcaaaataataatnataatgaactgagactcanaaaagatgtttgttcanggttacaaagctcagacaggacagggcagcattggaaaccaaaattggtctgactcctagctcatgctgtaaatcacggtgcaaggcttctactatctatgttgttcctaaaagaatgtataaatgaaaagatggttaacatattaagcaaaatatgttaaacgtcaaatgaactgtataaacgataaatgctggagagttgaggtggcaaagaactcatgcccgaggtgatctgggaaggcctcttgacaaggtggaattatagctggtttttgaagaatccgaaagtgcttagattgaaaggtgagacatgtacaggaatggtttctaagatgtcatattntatctctgtcctcatcttgactggcactaatgaacatcaaagatttcaacctaaatacattgagtgcccagtatgtgaanggccttatttatggtggtttaaaagctttttaacatactttaaaagaagggactggttaatctncactgnctagatccattagaccccggaccggatggccccangggcctttgggaatggcgtggtgggacagtcttncacttttgcacatacccaagaaaagaatggnccttttgggaattttgcagacctacaatctggagg

SEQ ID NO: 5089 - DNA, 842 bp, Homo sapiens
  misc_feature 12, 16, 29, 32, 34, 40, 41, 51, 56, 59, 60, 65, 69, 74, 78,81, 82, 84, 90, 91, 100, 109, 111, 115, 117, 127, 128, 133,149, 153, 154, 160, 164, 168, 187, 203, 212, 213, 214, 224,230, 231, 260, 272, 274, 281, 283, 284, 300, 308, 309: n = A,T,C or G
  misc_feature 315, 319, 320, 321, 328, 330, 331, 337, 342, 352, 367, 369,388, 405, 407, 408, 409, 412, 415, 436, 487, 488, 490, 491,493, 497, 506, 516, 533, 535, 537, 543, 544, 559, 568, 573,587, 590, 600, 605, 612, 623, 627, 648, 651, 655, 656: n = A,T,C or G
  misc_feature 657, 685, 688, 691, 696, 700, 702, 704, 706, 708, 718, 719,720, 731, 734, 738, 739, 740, 741, 742, 745, 746, 748, 754,758, 759, 763, 768, 775, 776, 777, 778, 780, 787, 794, 796,799, 801, 809, 816, 818, 823, 824, 826, 827, 832, 834: n = A,T,C or G
  misc_feature 835, 839, 840: n = A,T,C or G
tccccttgaaancccntaaccaggcttcncangncaaacnntttggaaaanccaanacnnaaaanaaangggangggnacnncngcacgnngcaagagantacacagancngacngnttttaacgannatcgnaaaaccccaaatgganggannttgagncacntgcnaaagggcccaactgctcantttaaaaaagagcagngtccgacannngcaaagaaangcagannaagaggcaaggaccccacagaacacatanctgaaaataatncngaataantnnacaacacgggtggggnaattcaannggacgnaagnnngcatccntnnttcctnataancctcaaatgnaatcgggaaggcaangntggccacaattccacaaancaacgggatttaccatnannnctncangatttcaccaggataccatantcaaggagtgaaaagaaaagtggggaaattcaaggaacttgggacccaccnngnnanaccnttaaaaatnaagggactcntcaagaaaagggaaccntnangagtcnnaaaaaaagggaagangaatggaanggggnccataaaggccccnggnaaaagggatncaagnaagaaanaaaaatgcaanttanaaaggactgggaagaaagganaanaggnnncaggcgaaaacagggcccatctaggaanccnggngaaantaantncngncnagaaaacccnnngcaaaaagggnaantcgnnnnnacnnantaaaancccnncaanggatnggcaaannnncnaaagggntagaaangncancngagcgagntacacgnanaaaanncnnataananntaanncc

SEQ ID NO: 5090 - DNA, 740 bp, Homo sapiens
  misc_feature 2, 3, 9, 10, 13, 18, 541, 665, 699, 737: n = A,T,C or G
gnncccttnnctntacantacaagctacttgttctttttgcaggatcccatcgattcgtatctgtctgtcttgatctctattctagcctctttttctgattggccctctcccctctcttctgtctgattggcctgtatccttccatcaccccatctgtctgctggattctccctgtctgcctgcagtaatgtatgtgatagcactttataaattataaagcactatgttgtataaaacaccattatcactttgtcttccttcttaccttattttttcttcctttatctggcttcccttcttctctctttctctctctctctgtttgcctgtctgcatcccttttggtgattttgcctgccttctctgtcagtcaatctccattccctccctgccagcctatttttctgccatccctcttctctgtctgctcagttcttgcatctctccttctgtgtttccaggtttctctatatttcttttgcctgtgtagtctctctgtcgttaggccttttatctatgcctgtgtgtctcactgtctanctgcttgtctccctgcctgtcactttcattgtggggcatcaagtctctgccttcttctgtctttcaagtacttcaaaaaataaaaattaaataaaaaattaaatccttatgataatgggtacangagaaattttttgtttaatgagaagatataaggngagacaaagaactcaaaattactgtgaaagcaatgaanaaa

SEQ ID NO: 5091 - DNA, 465 bp, Homo sapiens
  misc_feature 11, 14, 30, 93, 192, 198, 206, 273, 283: n = A,T,C or G
agccttttgcnacncgtttcaactacttgnctttttgcaggatcccatcgattcgccagaaagtgcctttacatttttgtcttggaacaactntgcaatttcatcttgatttaatatttctagtaataaagcatcttccgactccacattcttatctctgggcagacattttattcttaagaattgtagtgnttgatnagaagctnaatggagatgattaacgtgtcaatgattaataattataacaacattcaaacacttagaaattatagnatttcatcanatgtctttttaaagaggcatttctggccagttgtggtggctgacctttgggaggctgagacggctggatcacttgaggtcaggagttcgaggtgagactggccaacatgatgaaaacccttctctactaaaaaaaaaaaatacaaaaattggccgggcatgatggcaggcgcctgtaatccc

SEQ ID NO: 5092 - DNA, 1070 bp, Homo sapiens
  misc_feature 4, 9, 10, 17, 18, 22, 23, 24, 25, 26, 27, 28, 30, 31, 41,76, 78, 90, 101, 110, 115, 163, 165, 193, 202, 230, 329,338, 357, 383, 395, 445, 512, 578, 640, 686, 765, 785, 865,870, 888, 899, 1023, 1043, 1059: n = A,T,C or G
gggnggggnnttttttnnaaannnnnnncnntttttttggngaaaaaagtccccgccagggccttacctttgggtntncttttttttggnccaggggaatncccccaatncgggnatttcccggaaaatttccggggccaccggaaggaaaaaaccaaattantnaaaccttcaaaaaatgggccctttttcntaacagggnacttacccaaaaagcctggtcctggtantcaagggtttaatggggtggtttaaaaatccataaaattttctggggaatccatggaatccttaaaaaccttttaaattgggtttcccattttcttacntttacttcnttttactaaacaaaggtantccctggaatgggcctggaaaaaatnccatggtttggnaaaattttggaaaggtttttggaaattttttcccaggaatccaaaaatantggaaaaaattttaattttttccaattttttttaaaaggtaccaaaaaaataatccaagtttggtantaaatcaattgggtaaaaaaaccattaaaaaatttttggcttattaaaaaaggaattttttaaaangggcctaattttggaatttaaaaaccattttaatttaccttaaaaacctctttttggcttangaaattttttttttaggaaaatttcaagccattcggggaagggaanggaaatggtggaccattaaattaaatgggatccgaaaaggcccgaaaaggttttaaaaaaggtttggtggaatggcccntcacaatggggttggggaanggggttaattctaagctttcttaaagggactggaatgggtttggtccacaaaggaagtggtccatcaaggtcataaattngggtnaagacttaatgggcttanaattttatggnatttataccctgatggtattggaattgagatgaatattttatgaaccaaaatggagccattgtgtaagaagtatagtattaaatataagttaaaacttggaattttaaatccttggagtatgtnagcccttcaaagctcttgangctgaaggcccgattntttgcagtggg

SEQ ID NO: 5093 - DNA, 1336 bp, Homo sapiens
  misc_feature 4, 5, 6, 8, 9, 10, 11, 12, 13, 14, 15, 16, 17, 19, 20, 21,23, 24, 25, 27, 28, 29, 30, 31, 33, 35, 36, 38, 39, 41,43, 44, 45, 46, 49, 50, 51, 52, 53, 55, 57, 58, 60, 63,65, 68, 70, 71, 72, 74, 75, 76, 77, 78, 79, 80, 81, 82,85: n = A,T,C or G
  misc_feature 86, 87, 88, 90, 92, 93, 94, 95, 96, 98, 99, 100, 101, 102,103, 104, 105, 108, 109, 110, 111, 112, 113, 114, 116, 117,119, 120, 121, 123, 124, 126, 127, 128, 129, 133, 135, 136,137, 138, 140, 141, 142, 144, 145, 147, 148, 149, 151: n = A,T,C or G
  misc_feature 154, 158, 161, 162, 164, 165, 166, 167, 168, 169, 170, 171,172, 173, 174, 175, 176, 177, 178, 179, 180, 181, 182, 183,184, 185, 186, 187, 188, 189, 190, 192, 193, 194, 197, 199,202, 204, 215, 221, 237, 239, 240, 247, 250, 251, 253: n = A,T,C or G
  misc_feature 269, 270, 276, 280, 289, 290, 309, 310, 313, 319, 326, 328,335, 345, 348, 351, 354, 355, 356, 357, 359, 364, 365, 366,367, 368, 369, 371, 372, 373, 376, 377, 383, 384, 385, 386,387, 388, 390, 391, 393, 394, 404, 406, 407, 410, 416: n = A,T,C or G
  misc_feature 419, 423, 425, 426, 431, 432, 433, 434, 437, 438, 442, 444,445, 446, 447, 455, 469, 472, 480, 482, 483, 484, 492, 495,498, 500, 501, 503, 509, 510, 512, 520, 521, 535, 537, 538,543, 549, 552, 553, 554, 557, 558, 559, 561, 562, 563: n = A,T,C or G
  misc_feature 567, 568, 572, 577, 578, 579, 582, 584, 586, 589, 593, 594,596, 603, 607, 610, 612, 614, 616, 618, 621, 625, 626, 628,631, 635, 642, 652, 663, 666, 667, 672, 682, 684, 685, 689,698, 712, 718, 725, 731, 737, 746, 750, 754, 756, 762: n = A,T,C or G
aggnnngnnnnnnnnnngnnngnnngnnnnngngnngnngngnnnnggnnnnngngnngnggngnggngnnngnnnnnnnnngannnngngnnnnngnnnnnnnnggnnnnnnngnngnnngnnannnnagangnnnngnnngnncnnnangangggnggnngnnnnnnnnnnnnnnnnnnnnnnnnnnngnnngcngntangntgggaaaaaancccccntttttggggaagaaanannccccccnggnntnctttttttttgggccnngggggnaaancgccccaannccgggggaagggggcgggnnaanatgtgncgggggncnaaccggnaagggggaanggnganagnnnngngggannnnnngnnnggnnaggggnnnnnngnngnntttttttttntnnaanaggccnagncgangnnggggnnnnggnnggcngnnnnaagggggngggggggggggagntangggggcangnnnaggggggncantancnnangggggnngngagaacgnnaaacaacacagggncnnggaanggaggnggnnnagnnngnnngagnnacgnggcgnnnggngngnaangccnncngggggcngggngangngnanancangggnnanagnagangggaggngggaaagggnggggccggaantgnnggagnggcaagggangnnggancggagggangggggcgagaggangagccnatcgagngggggnaggggngacaggaangganaagnangggggnaaggcgngaancgaaggggggggnatgaggaggaganngngagngctggggggaagggggnanngggggggggnngnngagnnggnnagngggngggnggangangatgggagcnaancggtggacaaaacggcggcncaggnggggcaggnanaaaagggccgggagcggngcngngggggaggngcggnggtgtangaggcaggnaaattganngggagacnnggngngcgnnggagggnngaanagngnnngaannaagacggaacnaagtggaggagggggnannnggcgcaggagagngagggngtanggnagananananggnnaggacnggngncgnggngnngagtgagnggcgcganggagngngaggngagcggnganngagggnnggnacggggatggggangncngggggngnnncgcggggcgtggggacnccnggggggggggggggnnaagnnancnngggggngnannagangangggngnncgntgcnggngngggggggggagagnaangagnacgnggggggggnnacgnnggggnngagngcgagnnngcgcgg

SEQ ID NO: 5094 - DNA, 817 bp, Homo sapiens
  misc_feature 3, 5, 22, 25, 31, 41, 58, 60, 68, 70, 76, 77, 89, 121, 133,142, 146, 148, 164, 165, 170, 204, 212, 215, 259, 267, 306,339, 348, 349, 363, 372, 373, 422, 436, 439, 440, 445, 473,487, 488, 504, 517, 534, 539, 541, 550, 557, 563, 564: n = A,T,C or G
  misc_feature 568, 576, 581, 591, 592, 597, 616, 621, 628, 638, 642, 646,649, 655, 659, 660, 661, 665, 676, 677, 679, 687, 696, 702,706, 708, 713, 718, 727, 728, 734, 756, 775, 777, 781, 787,792, 795, 802, 812, 816: n = A,T,C or G
tcngngagtggtatgtctcgcntcnccgaanagcaggcggngcgaattcggcacgagncnaaaacttngnaataanncactttcatttnttttctagattttgtacatctcaggccatatnagcaaagcttgntgatagtgnaggntnctaaacgctgcaaatnngcagnctttaccactacaaagaagtctggatgatggatnctctgctnttngtcaaaatagttactgctgctgtagaaatttcatttttagattnaactgtgntggatgagctatcataattcaagtatacattgtcttagnctatcaaatattcattgtcatgcagtagtagtnaaaacatcnnagatgcagcaagcntattaaganntatttactaaaagaaataggaggcatttacatctttattattgtactcngggatatgcaaacnctnngatantataaacagttatgtcccctataaatcnggtcagcaacctcnnttgattatgctggggnaagtcaaatagtntggaagtaggtagagtnctggncnacaaggtgnttcaaancttaannattnggaacacnggggnccaagggctnnaatcnttaaaaggaaaactggggntttantgcactnaaaccgtttntggngccntanggttcnaaannnccanaaccttgaatnnantgtggtancccctgggncaaaanaaangncgggnattancccactggnncggaanaacaattgcctaaataaaggtncccccaattgaattccccnanaaanggcctnaaaanggntcccctntttccaaagnaaant

SEQ ID NO: 5095 - DNA, 1351 bp, Homo sapiens
  misc_feature 5, 24, 28, 34, 39, 51, 54, 58, 59, 60, 67, 72, 75, 78, 83,86, 87, 89, 92, 94, 95, 100, 101, 108, 110, 117, 122, 124,126, 129, 132, 133, 138, 142, 145, 148, 151, 152, 155, 160,161, 162, 164, 169, 171, 172, 173, 175, 178, 180, 187: n = A,T,C or G
  misc_feature 188, 192, 194, 195, 197, 206, 207, 211, 217, 220, 221, 225,227, 233, 234, 237, 244, 245, 246, 247, 248, 252, 254, 261,262, 269, 270, 271, 275, 280, 284, 288, 290, 292, 293, 294,299, 300, 303, 304, 305, 308, 309, 311, 313, 314, 316: n = A,T,C or G
  misc_feature 318, 320, 321, 323, 327, 331, 333, 337, 342, 344, 347, 348,349, 353, 356, 358, 361, 365, 369, 370, 375, 377, 382, 383,386, 392, 393, 398, 402, 403, 406, 410, 416, 417, 418, 422,427, 428, 430, 433, 435, 436, 441, 443, 445, 446, 451: n = A,T,C or G
  misc_feature 453, 454, 457, 459, 461, 462, 463, 464, 469, 475, 476, 484,486, 491, 497, 500, 501, 502, 503, 504, 505, 506, 509, 512,514, 516, 517, 518, 525, 533, 534, 535, 537, 546, 547, 548,555, 556, 557, 566, 571, 574, 580, 584, 585, 592, 593: n = A,T,C or G
  misc_feature 594, 595, 602, 607, 611, 612, 615, 619, 620, 626, 635, 637,642, 643, 644, 646, 648, 649, 652, 654, 655, 656, 657, 668,671, 672, 675, 680, 684, 697, 698, 702, 711, 716, 718, 722,723, 726, 728, 739, 744, 745, 753, 759, 760, 761, 775: n = A,T,C or G
  misc_feature 780, 781, 782, 789, 792, 794, 795, 797, 799, 801, 802, 807,812, 820, 823, 826, 828, 836, 837, 840, 842, 849, 863, 866,869, 873, 874, 875, 880, 883, 887, 889, 896, 901, 912, 913,915, 920, 925, 926, 927, 930, 931, 936, 941, 950, 955: n = A,T,C or G
ttggnggaaaaccctttttccaangagntggganaaacnccgatcgcccgnaangcgnnnggggcanaaagngcnatncagancgnngnaantnnagccnntttttancncccacgngcaananangcngannaaccngggnatnaanaannggngcccnnngncaaanannnanacncnatggccnngaangnncnacccttacnnaacncaatanccnncganancagaannagntgaaccnnnnncacntnacaaaanntctagannnccgntcacncaanaagncncnnngccannacnnnacnncnanncnancnncngcanggancncacnccccncncgnnnccanacnancangacngacnnaatantncagannacncgagcnntgacntaannacncaantagcannngccnctcgnngnacncnnaactntngnngagcncnnagngntnnnnagctntacgcnncgatagananagcgnaaaacngannnnnnnctntcnanannnagactangacagacnnngncaacacatnnntagaacnnngcacacatntctancgntatcancagnncaggcannnnacacaanagcancacnngantganncacaanaatcacgcntngaatnnncntnnctnannnnacacaaccaanatnnaanaatgnaagnacaccgaacactnnacangcagactanactcngncacnnaananaagaactgacngacannacaaatanaaacgnnntctacatcacagangtacnnncagacanaancnncngnannacaancggcncacacagntanacntntcatagcnntcnancatcccncagtgcacacaagngcncgnaaannntcatntcnctananacggatnccatnataggaacagnnanctgcntacannnctnncaagnaatgnacagatgcncgcanganacgnaagnnncnnnatnctgcatgcntngcnnancaaatggnangatnatcnnanatncaannngcngcatacaanngntcgnctaacacngatctgcatccatngacggatanacgtngagtangcctnntcacctcnnnagatctgcgtnncganatcancacnatangcntnaanagtnnncagaacagtacnagactggnnantnaagntannatngtntnnagtataataanncacangnagntagacnncaancgnngnacnanatnccnngcanncgcaaanagagcanccnnangcgnaccgaccgcagctaanacanacnactntacnncacaaancntnngaggccgntctaatnctncatcnnnncacctgnacgngacccg

SEQ ID NO: 5096 - DNA, 759 bp, Homo sapiens
  misc_feature 5, 6, 8, 13, 17, 24, 93, 200, 215, 218, 226, 231, 257, 321,326, 338, 344, 359, 362, 364, 373, 377, 380, 394, 397, 401,410, 415, 421, 426, 428, 430, 439, 443, 447, 449, 452, 459,462, 468, 472, 487, 496, 507, 516, 521, 534, 539, 557: n = A,T,C or G
  misc_feature 564, 596, 602, 609, 611, 614, 627, 647, 674, 677, 686, 688,690, 697, 698, 713, 715, 716, 717, 725, 750, 755, 758: n = A,T,C or G
taaanntnatggntggntacttgntctttacgcaggatcccatcgattcgaattcggcacgagggagcccagtgttcctgttcatgaaatctnccttttactggaaaacaggaatattgactaccaaatcacaatgcaattgaagccgtactgcttttttgagcagttattcattccagtgattaaaactgattgtgcanaatattctaagaggncanaaattggngtgtntaactacatttttagtgatgcaattnattgattagtgagtaagatactgagttttattgagagatttgattattataaagtaaaaatacngctgnattagggttacnaacagnaaagtgtcttaatgnctnangagggcatnttanctncactacaaaaccanatnttgnctgtacttntgaanagaatnttgtngntnctcagctgntatncaananctnaggaagnctntatggntgcnttctatgacatgtgnattgtgatntgcatataagnatgggtggngtgcnataccatattctnggttnttaaaatctatcactttncaccttncactttgacgtggtaaaactttaaaaaccaangtgtgnaaacccncnggnttcttaaaatacnaggccttagatcttatcagncgttttgacaaagcaggttttttcaanggntccctcctnananttttttnnaacggtcaaactaangnnntttgaggnaagctcttagtttgaccggaaaagntgggnccnt

SEQ ID NO: 5097 - DNA, 1382 bp, Homo sapiens
  misc_feature 1, 2, 3, 7, 8, 9, 11, 12, 16, 17, 20, 22, 23, 24, 25, 26,32, 33, 41, 42, 45, 48, 49, 52, 53, 56, 59, 60, 62, 63,64, 65, 66, 67, 68, 69, 71, 72, 74, 75, 81, 86, 87, 101,104, 107, 108, 115, 116, 117, 118, 121, 123, 124, 126, 128: n = A,T,C or G
  misc_feature 131, 135, 137, 139, 140, 145, 150, 155, 162, 169, 172, 179,180, 185, 186, 187, 188, 191, 192, 194, 197, 198, 199, 202,204, 205, 206, 207, 208, 209, 210, 212, 213, 216, 217, 218,219, 220, 222, 226, 227, 230, 231, 234, 236, 270, 271: n = A,T,C or G
  misc_feature 278, 280, 281, 282, 284, 285, 286, 288, 291, 295, 296, 297,298, 303, 307, 314, 319, 327, 329, 334, 337, 338, 342, 347,351, 352, 354, 361, 375, 376, 377, 382, 386, 387, 391, 395,396, 397, 398, 402, 414, 416, 418, 422, 424, 425, 428: n = A,T,C or G
  misc_feature 430, 434, 437, 439, 448, 450, 451, 454, 458, 463, 464, 465,467, 470, 484, 490, 491, 498, 500, 501, 506, 508, 509, 517,525, 541, 542, 545, 548, 550, 557, 562, 564, 572, 575, 578,580, 582, 583, 589, 592, 595, 596, 597, 602, 612, 615: n = A,T,C or G
  misc_feature 621, 624, 625, 626, 627, 630, 632, 637, 641, 645, 648, 650,651, 654, 667, 672, 673, 683, 684, 685, 687, 689, 690, 696,697, 699, 700, 701, 702, 705, 710, 711, 712, 718, 719, 733,741, 744, 749, 750, 755, 756, 762, 767, 777, 783, 790: n = A,T,C or G
  misc_feature 793, 796, 798, 804, 805, 813, 819, 820, 824, 828, 830, 842,844, 864, 865, 882, 885, 890, 891, 894, 900, 901, 907, 911,913, 914, 917, 923, 925, 926, 934, 935, 949, 951, 960, 968,971, 976, 979, 981, 986, 992, 995, 998, 1001, 1004: n = A,T,C or G
nnncggnnnanngaannggngnnnnnaggggnngggggccnnggngannggnnaanggnngnnnnnnnnanngnnggaagnaaggnngggaaaacaggggnaanggnngacaaannnnacnanngnanaanaggngngnnggggngggangaaanagggcgnaaggganggnaaggaanngggannnncgnngnggnnncancnnnnnnnannccnnnnngngggnnccnnttngntgggaaaaaaccccctttttgggggaaaaaaaannccccccngnnngnnngnggnaaannnnagggngaanaaccccnacgcngaaagaangnggaanggnntcanggacnacgnnangggcgancgcccgaggggcannnggggnagcnngcanccannnntttnccaacgaagggnananaacnannagncngcanccngngcagggggngnncgncgangcgcnnnanagnacacacaaactaanaagaannggaaganannaacanannaacgaaangaaccggnaaaaagagacgggcanngcngananaggagcnggacngnaggggganccnacngnannaagcgnggnagnnnggggnggaagaggcngcncggaangcnnnnacnantccgnaacnaaanagnannaangactaggcaaccngaacnncacgacgggnnncnanngcgganncnnnnacnagcgnnngagggnnaagcgcgcgggacnaacggggnccncggannggganngaaaangccgnaacaaaaganggacgnaaaaacnacncananaacggnnagggcccngcagcnnaagnaggngnggagggcagggnangcgggaaagcgggagacgcnnccagcgagaagcgcgcnaangaaanngancgggcnncgcgcngggnanncgngccggnannagaggacnnataggaagtgcacnancaaacgcancggcatcncangaggngangngatgnggatanagngancgngananncnanagaganggggagagnaagnagancgcggaangnacancaangcgnagaaccgngagagcgnnccangcangngagaanggnanngaggnnanngananacggngcgagngangnnnngacacganggacacgcgcggagaganncgcnaacatgaagnaancggnnggatgggaaannnganngananacgganggaancnggggncgagangaganggngaggcncaccnaacacggagggggagcnaggtagnggcannnaangagacgcggacgaaaacggganaaccgaaanggnggngcaanganannangggaagacgcacgngnggnngggagnaaannangngggaanacgaanaaaancgcc

SEQ ID NO: 5098 - DNA, 1245 bp, Homo sapiens
  misc_feature 12, 14, 15, 16, 28, 31, 35, 46, 49, 51, 53, 56, 68, 69, 70,80, 82, 84, 86, 100, 105, 107, 125, 126, 133, 208, 282,332, 335, 341, 358, 363, 366, 381, 385, 407, 426, 444, 445,450, 460, 466, 474, 476, 477, 489, 491, 513, 517, 518: n = A,T,C or G
  misc_feature 519, 535, 538, 546, 548, 550, 562, 565, 568, 574, 575, 578,581, 582, 588, 592, 595, 596, 597, 601, 613, 614, 616, 617,624, 629, 631, 633, 635, 641, 644, 647, 648, 650, 659, 665,668, 669, 686, 702, 706, 707, 708, 709, 713, 715, 716: n = A,T,C or G
  misc_feature 717, 718, 723, 725, 726, 728, 734, 738, 752, 756, 778, 781,784, 787, 798, 800, 801, 807, 813, 815, 819, 821, 823, 826,832, 834, 835, 840, 848, 851, 856, 861, 866, 875, 879, 894,896, 910, 915, 922, 925, 931, 961, 962, 963, 964, 966: n = A,T,C or G
  misc_feature 980, 984, 987, 990, 997, 999, 1006, 1014, 1015, 1019, 1029,1030, 1033, 1034, 1040, 1041, 1043, 1047, 1048, 1053, 1055,1059, 1060, 1061, 1067, 1069, 1071, 1075, 1078, 1080, 1082,1093, 1094, 1101, 1111, 1124, 1125, 1128, 1129, 1131: n = A,T,C or G
  misc_feature 1132, 1143, 1148, 1149, 1152, 1160, 1164, 1170, 1176, 1181,1183, 1189, 1197, 1200, 1204, 1214, 1215, 1216, 1217, 1219,1222, 1223, 1239, 1243: n = A,T,C or G
cgatacacatcntnnncaaatgatatcnatntaanatatcaatatnttncntnttnatactctgcaannnaagaaaagananantnaggtgctgttgaanccatnanctcttgtttttttgcagnncccacgnttcgaattcggcacgaggttttcctcaggcacaatgagccactgcaggcttttgaggagaagagtgacaagctgnagagctgtgttttaggacagctatcctagagctatgtgtgggcagagagtacaagcaggttatttatgaggctngggtaaaaaggcagacaggggacacatttgtcatatgccctattgaggcncanaatcanggaacaggaggtctgcnggttncangacaggccaaatcangganaaaagggactatccgggattancaagtcactggtgatcganatatcactttctttgaanntttanaaatggtttntgttancacttgcnannctcttcattaananaacctgccacaaaccaataaanttannngtttaaaatagaatcntgnagttatananancccaatgggaanctnggntaatannttntanngggaanactnttnnngttnaaaaagggaaanntnngggaaancccgntnanangagagnggnagnntntggcataanagacgnggnntctctcctctaaacganatacgaatacctcttncgcnnnntacncnnnnggtgntnnanaaacgntatntttctacacgggantctntgtcgtttttttaaagataatnagnagnacncaatacataantnncaagcncgcgtnanaaananantgnacgctnannataanaactcttntcngtatnggccnctaanctacttaangganaaagcttaatataangntgatggcaagggtnccccntgtagantcnttaccnattgtctcaacgatctccctaacgttatcnnnntngacaccatgacgcnattngangcncacttantntgaacgngtaaaagnntttntgggggtgcnntannaatacnnangtcnncatcncntttnnnggttanantntccncancntngatataaagannaaataantggtgcaacntatatttttcggnnacnnanntatattctctntgggnnatncatgtctncatncgtgcnttatcnatttntngtaagnagaaaccngtnaatntcttatgaannnntntcnntttcgtaatttgaaanaccncg

SEQ ID NO: 5099 - DNA, 768 bp, Homo sapiens
  misc_feature 4, 7, 13, 14, 15, 16, 17, 24, 26, 27, 28, 31, 609, 751, 763,768: n = A,T,C or G
aggnggnattaannnnntttttanannngcngctcttgttctttttgcaggatcccatcgattcgaattcggcacgagaaacaatataactcaaatgcctttctacaggactacaaagctgtctgtatcaggttatggtgttaaatcataatttctggatcatgatcttaaacctttaattggttccatttctactttactctttactaacaagtatcctgatgggcctgaaaatccatgttgaaatttgaagtttgaattttccagatcaaatatgaaatttattttcattttttaaagtacaaaatatcagttgtataatcatggtaaaacataaaattttgctataaaagatttttaaaggctatttgattaaaacatttatttacttaaactctttgctagaattttttttagaattcagcatcggaggaggaatgtgacataataatgatcgaaagccgaaagtttaaaagttgtgatgccctcacatggttggagggttattctagcttctaaggactgaatgttgtccacaagagtgtcatcaggtcataaattggtaagacttaatggcttagatttatgtattatacctgatgttattgnattgagatgaatatttatgaacaaaatgagcacattgtgtaagaagtatagtattaaatataagttaaaactttggaattttaaataccttgggagtatggtaaagccctttccgaagtctcttggaggcttgaaaggccgnattcttttgcantgggn

SEQ ID NO: 5100 - DNA, 749 bp, Homo sapiens
  misc_feature 4, 6, 11, 13, 15, 16, 18, 26, 624, 631, 726: n = A,T,C or G
tggngntttanananncnggctctcntctttttgcaggatccctcgattcgaattcggcacgaggtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgtattacttaggccaaaatctggcctggatttatgctataatatatattttcatgttaagttgtatatttttcagaaattataaatattattaatttaaaatttgaatttgtgtttgactaacaacctcgatggatcttcttncaacctnccattaagatcctgcagaagaaatagaaatattcaaatattgcaaggtgtaattgtgagacaacttattataatacgtgttaagttctactgganccatggaaatggtttaagaaaaa

SEQ ID NO: 5101 - DNA, 466 bp, Homo sapiens
  misc_feature 3, 7, 9, 11, 54, 60, 61, 84, 85, 90, 91, 93, 98, 106, 107,109, 110, 115, 117, 130, 136, 137, 138, 139, 144, 145, 146,150, 151, 152, 158, 161, 163, 166, 168, 178, 179, 182, 194,198, 200, 205, 211, 212, 218, 231, 234, 242, 244, 248: n = A,T,C or G
  misc_feature 252, 255, 256, 258, 268, 272, 273, 274, 275, 276, 277, 278,290, 293, 294, 296, 300, 304, 314, 321, 324, 334, 335, 339,341, 347, 349, 371, 382, 392, 395, 402, 414, 415, 417, 418,420, 427, 430, 437, 448, 464: n = A,T,C or G
tgnttcnantnttttacaactacttgttctttttgcaggatcccatcgattcgnattctnnacgaggctgcttactaaggcttnnactgnnanatcgnttgacccnntnngtcgntngctgcacatgccnatattnnnncgacnnngctnnntcctgngcngntangngatgacctgnntcnggacacaatggngaangngtagnggtgcnngacatnggcgaaattgtgngcnactagaantngtgncaangcnngntttcacatancctnnnnnnnctacttgccatnttnnantgancttnctgcctcacnacattcntgngttcataacnngacncnctaagngnacaactccgaacccacattggncaaaaaaaacnacatatgctnacngttcctnctgcccatgtgnncnntnaacttgnatnatcttanactgaaccagngctccacccattcatnct

SEQ ID NO: 5102 - DNA, 464 bp, Homo sapiens
  misc_feature 2, 6, 47, 76, 77, 135, 142, 159, 163, 164, 171, 179, 180,182, 203, 205, 225, 228, 231, 232, 233, 234, 241, 249, 278,280, 284, 288, 289, 305, 308, 310, 326, 332, 344, 354, 363,379, 380, 383, 384, 390, 397, 398, 400, 405, 416, 436: n = A,T,C or G
  misc_feature 441, 448, 457, 462, 463: n = A,T,C or G
tngatnccttcgatcagctcttgttctttttgcaggatccctcgatncggcctatcttagagaatcatctgctcannccttattcctgcagaatacaaatgtcacattctaacctgttcagagattgtcttcaanataaaantgtgattcctacatggnatgnnaaacaanctacactnntnggcaaaaggcattattagggntngattccataatgattgagtnctnttnnnnagtatantcatgcanctgaacaaaatgaagctcattccactgcntngaanaatnncacaaatgtgatgctnaananaggaagccacgtgcanacactnactatataattntatgtacatnaagttcagnatccggatagttaccnntgnnaaggangtaactnnangagtntgaggaggggnttctggtatctggttaatgnacttngtaccanttacccaanagtgnnt

SEQ ID NO: 5103 - DNA, 882 bp, Homo sapiens
  misc_feature 2, 6, 8, 9, 10, 11, 12, 21, 673, 679, 681, 685, 716, 720,721, 726, 728, 730, 736, 739, 754, 755, 758, 761, 764, 774,777, 782, 784, 789, 793, 796, 797, 802, 805, 808, 809, 810,811, 814, 815, 822, 827, 832, 838, 842, 856, 860, 862: n = A,T,C or G
  misc_feature 877, 881: n = A,T,C or G
gnagcntnnnnnttttctaangttggctactcgttctttttgcaggatcccatcgattcgaattcggcacgaggcatcctgtccttgggaaccctttctcattctccaagcctggtcagctgcctgcacaggcagaggtgccctcagcccaggttagcaacactcatagttttgccaattaccagtagacactagtggaaccatctaactggaacttcctctctccttccacttatttcctcaaacttgttgctttacactagacacatgcaaatgtatgttttaaacacaccaaaacagatcatgccaaatgagttgcctgtcaaaggctggagggcaggaggagggcctgggtttgggttctttcctcccagcctttggatggtgccttgggccccttagccccagcgccagggccttccagctgaggccacaggaaagcacttttttatgatgtactaaaagccacagtatgtggcaactgcaaaaggatcaggaatttagggtatgatctcggtcacgtgtcccgggccgctgaggggaaaggaagcgggcatgattgtagacaatgagggggttctcttgatgtaatgaaatgcaattttatggtttggtgcaaaaactcctattttccagttaattaactttatttctaaagcatatttttgatttnccatcnanagcnataaagcattaaaattctttaaaaaaaaatnatcnntctcnantnctccanatncaaaaaaaacttcgnnccnttnaanacctttttgnggngttcntnttttnccgngannccccnccnttnnnnctnngattccntttgnctgtnttttgngacnaaccccccatactnagantnctccgcaaaaaaaantccnt

SEQ ID NO: 5104 - DNA, 755 bp, Homo sapiens
  misc_feature 1, 2, 6, 8, 11, 15, 21, 32, 34, 35, 36, 45, 49, 50, 51, 52,69, 71, 81, 83, 84, 85, 97, 99, 101, 106, 114, 119, 121,124, 127, 130, 131, 134, 136, 138, 144, 145, 147, 148, 150,156, 158, 174, 175, 178, 183, 190, 195, 205, 211, 235: n = A,T,C or G
  misc_feature 238, 243, 244, 245, 246, 251, 253, 255, 259, 270, 272, 285,307, 329, 335, 346, 349, 354, 357, 363, 369, 370, 393, 412,414, 428, 436, 446, 470, 471, 474, 485, 500, 581, 652, 660,693, 696, 699, 730, 733, 735, 737, 738, 739, 750: n = A,T,C or G
nngtgnantgngatnttggcnagcgccatgantnnnggagtcgancgannnncggcacgaggagaaccncntaaagccctnannnttcctttttttngnangaagngggagtanatggntngcnatntannccnananggcacnntnnanggaggngnaaccactctgacgttnnatnggcantgagagntagancagaggctgncctgcntggaagctgatataccctataatncanagggnnnnagacnantnttgngaaactcggtnanacattctatttanagacatgcctgctgatatgacntatatttttatagggatacccntttatngctgggacatnaancctgnttncactcnaaatgnncctgctttcagaaaatagaacangagacatgccgaaaacagngnttctattattgtgnattatganttttgttctntagaactattttccaactcatctnnttncctgcagctgnggaatctggacagcnaaatcttgtggacgtttattccactaagcccagggatgagatggcactcaggttaaagaactaacattttctgaacccttnattaactatttaccagcatcaggccctctaagtacaagtgtcagaatccttcatttcaattttttcactcngggcattncccattacaaagcccatcctattattgaacccnaanttnagcaaaccacttaggtctgccacttaagaantcngngnnncaaggttgccnaagaa

SEQ ID NO: 5105 - DNA, 738 bp, Homo sapiens
  misc_feature 11, 12, 19, 20, 32, 33, 36, 59, 61, 66, 67, 69, 70, 80, 81,84, 85, 89, 90, 92, 98, 102, 104, 106, 108, 110, 126, 129,130, 131, 132, 133, 134, 137, 140, 146, 148, 152, 153, 156,164, 166, 168, 169, 170, 178, 183, 185, 188, 198, 201: n = A,T,C or G
  misc_feature 203, 204, 207, 209, 218, 219, 222, 224, 228, 231, 233, 236,241, 244, 247, 252, 262, 264, 265, 266, 276, 277, 280, 281,286, 287, 292, 297, 298, 314, 316, 325, 326, 330, 334, 337,338, 346, 347, 348, 364, 370, 374, 377, 378, 395, 404: n = A,T,C or G
  misc_feature 410, 417, 418, 419, 425, 436, 437, 446, 447, 449, 460, 461,473, 493, 495, 505, 506, 507, 509, 512, 520, 521, 526, 530,532, 543, 544, 548, 554, 555, 556, 559, 567, 569, 570, 580,598, 612, 617, 631, 640, 643, 645, 648, 651, 657, 677: n = A,T,C or G
  misc_feature 683, 687, 689, 701, 711, 720, 722, 725, 728: n = A,T,C or G
tgtgttttctnnctgtggnnactggcctttcnncangaagcctggccggtcgaactgcnancggcnncnncggaaagggnntgnncaanngnaatttntgcngntnangntgtatacaccttggangannnnnntgngcnattgcngntctnngangtattcangncnnntaaattcntcatnanccncacttccatngtntnntcngncacatgctnncantntatnatncntgngaaangcngantatcnatgctagacntnnntgcaggctgnngcnncgganntgtcntgacnncaaactgtttactctnantgactgtgnnggcntttntcnnatgaaaannngggcagtattcccttnctaaangagntcnnaggaagaagatgagaancggggtggnatcagnaactgannnggcacngaagcacgtgnnagaccctcnnanaatgatgtgannggaccaaaagcntgatcaccaagcgctttcangnctggattccnnncncgnatccatannagtcntgtnanccaggaccttnnaggnatcatnnnccnggcgtgtngnnaatgagcatngtgtggtacacttgacgntgtcccctggtgcntactntgtaattcatgctncactagatnagncnagnacntatatncgcttcggcactgtgtgctngtaccnaccncncgttggaccgtnattccccttncaatgtgtnanatnttnggttgggcct

SEQ ID NO: 5106 - DNA, 461 bp, Homo sapiens
  misc_feature 1, 4, 6, 13, 84, 128, 182, 188, 198, 202, 266, 307, 357: n = A,T,C or G
ntcntngatacanctacttgttctttttgcaggatcccatcgattcgaattcggcacgaggcaattgtctatttatcttttatntttttaagtcagtatggtctaacactggcatgttcaaagccacnttatttctagtccaaaattacaagtaatcaagggtcattatgggttaggcattnatgttnctatctgatnttgngcaaaagcttgaaattaaaacagctgcattagaaaaagaggcgcttctcccctcccctacaccnaaaggtgtatttaaactatcttgtgtgattaacttatttanagatgctgtaacttaaaataggggatatttaaggtagcttcagctagctnttaggaaaatcactttgctaactcagaattatttttaaaaagaaatctggtcttgttagaaaacaaaattttattttgtgctcatttaagtttcaaacttacta

SEQ ID NO: 5107 - DNA, 749 bp, Homo sapiens
  misc_feature 2, 3, 6, 7, 11, 12, 31, 33, 34, 36, 43, 50, 75, 76, 77, 81,85, 93, 204, 332, 392, 655, 662, 663, 664, 671, 673, 674,676, 677, 678, 691, 692, 694, 701, 703, 705, 707, 708, 716,718, 724, 727, 734, 735, 736: n = A,T,C or G
anngannctgnnggtcgtgtaacgccctttntnnangaagacnggcgatncgaattccgaggatccaagagggcnnnactngggngggcttcntttcagctgaaggctgctaccgtaccgtgtgggagcgcctgggtctggccttccagaccccagaggcatactgccagcagcgagtgttccgctcactggcctacatgcggncactgagcatatgggccatgcagctagccctgcaacagcagcagcacaaaaaggcctcctggccaaaagtcaaacagggcacaggactaaggacagggcctatgtttggaccaaaggaagccatggcnaacctgagcccagagtgagccgtctgaactgtgggagggaagtgctaacagcccagcctncagcctggcctttcctccttcccctctgaacctcctgcaaccctgagccatcaggacaatcataccccttcccttctctccacccaattgtgccagtaaatgggggttgagggtgacctaggcagcattagaatcacttatttatttctttcctacctgttccctgactgcgtgaaatgttcagggaggtcagttgatttccccaggtacattcatggtgtgacagacacatgggtacaaataaaagacccagaaagccaacnaaaaaannnggttttnanncnnngaattttaaaaanntntaaattncntngnnttaaaaantncttttntgnaaaaaannnttttggccttttt

SEQ ID NO: 5108 - DNA, 747 bp, Homo sapiens
  misc_feature 1, 7, 14, 329, 391, 427, 436, 475, 490, 502, 556, 562, 630,685, 723, 725, 730, 741: n = A,T,C or G
nggggtntttatanaatccaggcctacttgttctttttgcaggatcccatcgattcggccacatcgggggcaccaccctccatgcctttgcaggcatcggctcaggccaggctcctctagcccagtgtgtggccctggcccaaaggccaggcgtgcggcagggctggctgaactgccagcggttggtcattgacgagatctcaatggtggaggcagacctgtttgccagtggccaggcctatgtggccctttctcgggcccgcagcctgcagggcctacgtgtgctgactttgaccccatggcggttcgctgtgacccccgtgtgctgnacttctatgccaccctgcggcggggcaggagcctcagtctggagtccccagatgatgatgangcagcctcagaccaggagaacatggacccaatcctnctgagcctnacccacaaagaggagacaaaagggttggcctgtggcctncccgtcctcctgctncctatggcccanggccccagggaataactggagtaggcaggcagtgtccccttctgtattttttanggactntaaccttctgcagggttaaagggagaagtctttaaacccatataccaactgtgcttcagttcttttanttttgcctgggtaaactgctgtagggtcagaattaccctttctgtgccaattganaatgaacctgtgtggtactgatgtcagaggacaaactntntgaanggcttgaacanacttga

SEQ ID NO: 5109 - DNA, 793 bp, Homo sapiens
  misc_feature 1, 3, 13, 16, 29, 98, 99, 455, 524, 545, 592, 596, 601, 624,625, 627, 659, 669, 677, 685, 688, 697, 752, 760, 772, 780: n = A,T,C or G
ncntttatcaaancgnttgggctactcgntctttctgcaggatcccatccgattcgaattcggcacgagaaagaaagggctcgtgacagagaaagatnnaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacacttgaatcgaangaaagtgatactaagaatgaggtcaatgggaccagttgaagacattaaatctgaaggtgacactcagtncaattaaaactgatctgattnagacctcagatcagacagaggactactggttcgaagatttttggaanaatnctgangaacgggataaagtgaagatcgnncntttaaaaaaatgaggttgaaaagaaagctatnagtggcattnaaaaagtnttaagctncanttagttttntttattattattattatttaaaaggttaatttcaaggacttgatgttgacctccngatttccngaacatgtgttnaatagttnttattccccttgg

SEQ ID NO: 5110 - DNA, 811 bp, Homo sapiens; identical to SEQ ID NO: 3884
  misc_feature 2, 3, 4, 9, 11, 12, 13, 25, 41, 44, 69, 88, 99, 102, 171,210, 239, 268, 292, 307, 332, 339, 348, 391, 403, 439, 440,448, 451, 454, 455, 475, 481, 487, 496, 508, 514, 548, 565,567, 575, 593, 599, 648, 671, 672, 706, 712, 713, 717: n = A,T,C or G
  misc_feature 736, 738, 748, 753, 757, 763, 765, 771, 772, 797, 801: n = A,T,C or G

SEQ ID NO: 5111 - DNA, 469 bp, Homo sapiens
  misc_feature 1, 3, 6, 10, 11, 13, 18: n = A,T,C or G
ntnccntttnnantacanatacaagctacttgttctttttgcaggatcccatcgattcgccatgcccagctgtaatttcttattaggtgccagacattatgaattttaccttactgggtgttgggtacatttggatgtctttaagtattcctgagaattattctcaggtgcagttaggttacttatgaatagtctaattctttagagtcttgctttcaagctctcttagggcaggagcagcctttagtttatgactaatatggccctggtactgagacactaccattctaagtacctaaatacccaatgccctgtgtagcatgaggcatttcactctggctgataggactgtgaactagcctcaaccttatatggtctttgatgattgttttgcctgttcccttctgtggttcttttcccgtgtcttccttactcacgcttactgctcagtactcagcccgaagactct

SEQ ID NO: 5112 - DNA, 463 bp, Homo sapiens
  misc_feature 356, 377, 442: n = A,T,C or G
cgttacttcgatcaagctcttgttctttttgcaggatcccatcgattcgaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttctgaattaatctgaaatgtcaagccctggatttgctacagagtgagaagttattttatttttttttatttttaattntggaaattctgcagaaatcanaactcttaccatggtttgaacaaaaaaaggggaaatggggaggggaaaagggtgggattgtccancatgcttgtatgtatatttca

SEQ ID NO: 5113 - DNA, 468 bp, Homo sapiens
  misc_feature 6, 10, 21: n = A,T,C or G
tccgtntgantaccgttacangctacttgttctttttgcaggatcccatcgattcgaattcggcacagaagaccaagcgcatgcgaacctctttcaagcatcaccagctccggaccatgaaatcctactttgccatcaaccacaacccggatgccaaggacctcaagcagcttgcccagaaaacaggtctgccaaaagagttttgcagggagaacaaatcttggggcattacagccaaacatcccgacgtttgaaaattccctaaagtattaaaagaaggggaaaagtttgatcggaaatccactgcagtgaagacaaagacactattaggttatgataatcatacattaaaaaatttattaagccaaaaaaaagagagagagagagacttaaatgtcatttactgaatgttaacgaaacttgtgttctttatggtgtctaacacaactgaaggcctaaaattatgtg

SEQ ID NO: 5114 - DNA, 765 bp, Homo sapiens
  misc_feature 1, 2, 9, 704: n = A,T,C or G
nncttactnaaaccgtttggctacttgttctttttgcaggatcccatcgattcgaattcggcacgaggacctatcttgatctggatagtaaagtgaggactttaaaaaagtttattaaattactgggagaaatcatggagcacagattcaagacatatcaacaatttagaaggtgtttgactttacgatgcaaattatactttgacaacttactatctcagcgggcctattgtggaaaaatgaattttgaccacaagaatgaaactctaagtatatcagttcagcctggagaaggaaataaagctgctttcaatgacatgagagccttgtctggaggtgaacgttctttctccacagtgtgttttattctttccctgtggtccatcgcagaatctcctttcagatgcctggatgaatttgatgtctacatggatatggttaataggagaattgccatggacttgatactgaagatggcagattcccagcgttttagacagtttatcttgctcacacctcaaagcatgagttcacttccatccagtaaactgataagaattctccgaatgactgatcctgaaagaggacaaactacattgcctttcagacctgtgactcaagaagaagatgatgccaaaggtgatttgtacttaacatgccttgtcctgatgttgaaggatttgtgaaagggaaaaaaaattctngactcttgatataataaaatgagactggaggcattctgaaattgaaaaaaaaaaaaaaaat

SEQ ID NO: 5115 - DNA, 466 bp, Homo sapiens
  misc_feature 1, 2, 5, 6, 9, 11, 14, 300, 451: n = A,T,C or G
nnccnnttnantanagatacaagctacttgttctttttgcaggatcccatcgattcgcttggggccaggatcctggagtccttgcttggggataacttcctggagagctgctcagtcagctatacccttgggagtcttttgttgagggagaaataaatgtcattttgcaaagccactgatattctgtggttatcacggcagtttagagaggaaggatgggggaaagctgggttgcgctctagccttgacacttcctgcctttgtagtgttaggcaaacatggcaaccccagaaaactcanctgcctcagttttaaggcatgcagggtctttgtgaggaccatataagccacgtggaggggtctagaccaagcatagtgcttggaagaaagggcgtgtgtgctaatgatttatgtctcttttctttctgagagtcttgctccccaacaccanaggtgagaccacctg

SEQ ID NO: 5116 - DNA, 465 bp, Homo sapiens
  misc_feature 4, 9: n = A,T,C or G
ttcnctttnatatagatacagctacttgttctttttgcaggatcccatcgattcgaattcggcacgagctttagccccagtcaagttacctcagcaaagactagctgaccctgccaagccctgcccaagttacagaatcatgagcaaataaatggctgtttctgttttaagcttttaaattttgggggtggtttatgtgtcaataataactgaaacagataatatatacagaataaactttagttttaataatctaagtaaaagcccactaattcattatgcagaaaaaaatgatttttttgagacggggtctcgctctgttgccaggctggagtgctgtggcacaaccatagctcactgcagcctccacctccctggttcaagcgatcttcccacctcagcctcccgagtagttgagaccacagtgcccttggtgtggtggaagcaaggtgccatgtgataagt

SEQ ID NO: 5117 - DNA, 630 bp, Homo sapiens
  misc_feature 1, 2, 3, 4, 8, 10, 13, 14, 18, 19, 20, 22, 25, 27, 28, 29,30, 31, 37, 42, 47, 48, 49, 53, 55, 57, 65, 66, 67, 69,70, 71, 72, 74, 75, 77, 78, 81, 82, 83, 84, 85, 86, 87,88, 89, 90, 91, 92, 93, 94, 95, 97, 100, 113, 117, 118,127: n = A,T,C or G
  misc_feature 128, 129, 130, 131, 136, 137, 140, 145, 148, 155, 157, 160,162, 163, 165, 169, 175, 180, 183, 184, 185, 189, 192, 193,207, 208, 215, 217, 220, 229, 235, 237, 239, 245, 255, 258,261, 262, 264, 272, 273, 280, 281, 282, 289, 300, 302: n = A,T,C or G
  misc_feature 316, 320, 329, 331, 333, 337, 340, 345, 347, 349, 352, 359,361, 368, 369, 372, 374, 377, 382, 386, 388, 391, 399, 402,404, 406, 407, 413, 423, 428, 430, 431, 432, 435, 441, 442,443, 451, 458, 461, 470, 473, 476, 484, 485, 486, 492: n = A,T,C or G
  misc_feature 493, 504, 508, 511, 512, 516, 523, 524, 527, 530, 536, 538,539, 541, 546, 559, 572, 573, 575, 589, 597, 599, 603, 608,610, 611, 613, 620, 621, 626, 627, 629: n = A,T,C or G
nnnnactntntcnncatnnncngancnnnnntctcgngacantttgnnnaacngntntgtggggnnngnnnnanntnngcnnnnnnnnnnnnnnncnaanccttggaaacctncctnngccgatccnnnnntgcannatnccgcnggngggactngnaancnngnccanataatnagggnttnnnctgnacnnggcaaaaaccccannattaggnanggngcgctaggnggcccnananccatgnagtggcacgncgncanncngttgtttnnccaatcnnnaattcgnatcgcctcggnancgcccctggggtangggnacactctgncnantggnccnactgntnanaanaagggancnagtgtcnngangnccncggcntacncnagngaatcctnccngngnnccgggngactaggggnggatncnnncangaaggnnnggagccgnagaacanacntgggtgacnggntgngacaaagnnnccgtcnnaaaaatgctangggnaannacanaaggagnntcnaantgcatnannangtgangttccaacgcccnatgaaaaagggannanggaaagtcgcacantgattganangggncgccngnngngcatatnnaaatnnanc

SEQ ID NO: 5118 - DNA, 618 bp, Homo sapiens
  misc_feature 2, 3, 4, 6, 7, 10, 11, 13, 14, 15, 18, 21, 22, 23, 24, 26,27, 28, 30, 33, 35, 36, 37, 38, 39, 40, 41, 42, 43, 44,45, 48, 50, 55, 57, 58, 59, 62, 63, 67, 70, 71, 75, 76,77, 81, 83, 85, 91, 94, 95, 97, 99, 100, 101, 102, 104,105: n = A,T,C or G
  misc_feature 106, 112, 116, 117, 118, 119, 120, 121, 122, 123, 124, 125,126, 127, 129, 133, 152, 153, 154, 157, 162, 164, 167, 172,183, 187, 190, 192, 195, 204, 216, 217, 219, 221, 229, 230,231, 236, 240, 245, 247, 249, 254, 257, 263, 266, 273: n = A,T,C or G
  misc_feature 277, 291, 298, 300, 307, 308, 309, 332, 335, 338, 340, 344,347, 349, 354, 360, 367, 368, 377, 380, 382, 391, 401, 402,406, 411, 416, 428, 433, 447, 448, 450, 453, 456, 463, 468,478, 482, 502, 507, 509, 510, 515, 528, 530, 544, 550: n = A,T,C or G
  misc_feature 553, 558, 563, 566, 574, 578, 581, 582, 586, 587, 603, 604,606, 616, 617: n = A,T,C or G
tnnncnncanncnnnccnctnnnncnnntngantnnnnnnnnnnnacntnctcangnnngtnncatncannaagnnngtantntngtcgcntgnncntnnnncnnntatcgnaatnnnnnnnnnnnntncttncctttggtaaccccttttnnnccntggcntnacncatgnaacccgtaagncggngcnangcnatagctatnaacgaacatttnncntngctacggnnnattgnactnacgcngncntgtangangccacnttnacatgcnaggncggcacaccggtgnaataatngngtcgctnnntgggtgcggccctaacgcttccnttngcntnagcncangngcctnagactnttacagnngcattgganaangncgcggcgtnacccgctgcnntacncaatnaaggngtgtgaaacacnggacntgggttgaaaaacnntnaanccngatggcngagcntaagccccgngggngcctgaggaagcgtgcagcnaggtncnnatganaaatcacttgtgncnaaacggacaatganctgcgnagnggaantctgngcncgttaggncacncanntgtnnattgggcgcattgaanngncatgactccnnc

SEQ ID NO: 5119 - DNA, 1446 bp, Homo sapiens
  misc_feature 2, 3, 5, 7, 9, 10, 14, 19, 21, 22, 25, 30, 32, 34, 36, 39,40, 42, 45, 48, 50, 52, 54, 57, 61, 62, 63, 67, 68, 70,71, 72, 82, 87, 88, 89, 93, 95, 101, 104, 105, 107, 125,131, 132, 139, 146, 159, 160, 166, 168, 173, 176, 180, 189: n = A,T,C or G
  misc_feature 191, 192, 195, 198, 199, 204, 207, 208, 213, 222, 225, 226,227, 228, 229, 232, 233, 244, 247, 253, 255, 261, 262, 265,266, 269, 272, 275, 277, 278, 279, 285, 288, 291, 295, 297,298, 299, 300, 307, 309, 312, 316, 326, 331, 332, 336: n = A,T,C or G
  misc_feature 341, 342, 344, 345, 353, 354, 356, 365, 366, 374, 375, 380,382, 384, 385, 390, 397, 399, 402, 403, 404, 405, 410, 419,429, 432, 438, 439, 444, 455, 456, 459, 460, 463, 466, 475,477, 481, 485, 486, 492, 493, 499, 502, 504, 506, 508: n = A,T,C or G
  misc_feature 510, 516, 517, 520, 521, 531, 533, 534, 536, 548, 549, 559,560, 570, 578, 582, 593, 594, 597, 601, 602, 607, 608, 609,610, 614, 623, 624, 637, 638, 639, 642, 643, 647, 650, 655,657, 660, 665, 669, 675, 676, 677, 689, 694, 697, 702: n = A,T,C or G
  misc_feature 716, 722, 724, 726, 727, 732, 733, 734, 737, 739, 741, 745,749, 754, 757, 761, 767, 775, 780, 781, 786, 791, 797, 803,830, 834, 846, 851, 869, 870, 878, 879, 885, 890, 891, 895,905, 916, 921, 922, 935, 948, 950, 956, 964, 967, 985: n = A,T,C or G
  misc_feature 987, 992, 993, 1001, 1004, 1015, 1019, 1023, 1024, 1027,1033, 1036, 1037, 1039, 1057, 1059, 1066, 1067, 1071, 1091,1093, 1117, 1130, 1132, 1133, 1145, 1154, 1171, 1177, 1199,1216, 1217, 1232, 1234, 1236, 1237, 1245, 1247, 1249: n = A,T,C or G
gnngngnanngggnggggnannggngaggngngngnggnngnggnggngngngngangggnnngccnnannnggccggagcnggggnnncggngngagagngcnngnaaagccctttggaaaggncggagnngagtggngggccgncggagaggggggnnggggangnggggnagngggnggggggggngnngcncgnntgagnggnnggggngagaggggngcnnnnnggnngggggggggcngcngggggngngagggnnggnnggnagnggngnnngaaggnggnggncgangnnnnagtggangncgngagngcgggggaanggagnngcgnggggnngnngggggggnngnggggagggnnaggagggnnagagngncnngtggnagggagncnggnnnnggaangagcgaccnggaggggaanggnagggannggggngagggagaggnnggnnagncgnagagagggncngggnggannacggannacgggngcnangncntngaggcnnccnnggggaggccnannanggtccggggggnncaggaagganncaagggaatnaggaaaanaagncgccaaggggnnggnaagnngaaannnngcanggggggganngccgggagcggannnggnngagnganagggnanggngggangaangcgggnnngggggaaggagnggagnganaaaangggccagggagggnggagangngnngaccnnnggnanancaangggngaaangcnggangggggnagagaggngggannaaccngaganggaaanggggangggggccaaaggggggggggagccccngggngggaaaaggganccagnttaagaaaagagccgggnnagaggggnngggaanccaanngtgngagagggcgnccgaagatggngagannaaaccaggggganagcatgggggatnanaggganaacccganganggaaaggcaaggggaacncnggganngggggaancgnaagccgggggnggcngggnnaangggaanagnngngagggggggaaggggaanantgaaccnngggnaggaaaaaacgggggggaantnaaaaaaggggggggaaaaggaaantgcgggagccaangnntgaaagaaaaanaaatagggnaagggggggggggaganaggggnaaaaagggcctgacatagaggnggggggcgagtatgggnnaaagaaaaagggggngntnnaaaagggncncngngaggtangaggggagggngggtngggaganagngaanagaagagcgaagagatnagtnnnaaaaaangggngganaaanntgcgcaggggaagctggggaaaggggnggggaccccannagccncgggaanatgtgncngggaaaanaagggggggggngnnaaganagggggaaaanaaaagggcccaccnggg

SEQ ID NO: 5120 - DNA, 762 bp, Homo sapiens
  misc_feature 10, 12, 14, 15, 16, 17, 26, 28, 68, 163, 179, 185, 186, 197,209, 230, 252, 255, 267, 296, 308, 309, 326, 364, 365, 370,387, 390, 391, 392, 395, 400, 406, 407, 408, 409, 410, 414,415, 423, 435, 436, 437, 440, 449, 452, 454, 470: n = A,T,C or G
  misc_feature 478, 485, 487, 490, 500, 504, 509, 515, 527, 532, 533, 536,537, 545, 551, 552, 556, 559, 564, 570, 574, 575, 587, 599,605, 608, 616, 635, 641, 652, 654, 662, 663, 665, 683, 686,697, 705, 709, 711, 717, 721, 736, 740, 748, 750, 751: n = A,T,C or G
  misc_feature 756, 757, 758, 759, 761, 762: n = A,T,C or G
ggtggttttnangnnnntttttctantngcagctacttgttctttttgcaggatcccatcgattcggntggctctcccagcgtctgacctggcgtgtctctcagtcccatcccaaggcgatgttctctaccgctagatggagcatcagacctcaagtcaagancatcccagttcactgntgcttnnggtggctctantctgggaggganggggagacttgaaaatgggangatctcattggcttgctaaggnttnggatttacctcntatcactggagacccattgtagcgacaangtcaagggaacnngaacttgtttactatcngtgcgctctacattgaatttaccgacaaactctgtgannaatcngatatgaacaatgcacnctnnnctngtctnagacannnnnttannaagaaggngcacactgaacnnnctnacagcactnttngntaggggcactgtactntgacctgnatgaaantntanccgaggccanaatngaccnactatnaagcttaacacngattnnagnnatataatnaatgannattnaanatgancctganctannagcttaatagtnctgatgggcctncatgtnatntcaaaggnctttgaattggctacttanaagganaatggccaatngnacgtgttnnangaaagggaaacaggaaangcncctagtcccantgtaatgngtcntnggcaancaanctgtttaaaacggtntcgnaaaaaaanannttccnnnntnn

SEQ ID NO: 5121 - DNA, 793 bp, Homo sapiens; identical to SEQ ID NO: 5109
  misc_feature 1, 3, 13, 16, 29, 98, 99, 455, 524, 545, 592, 596, 601, 624,625, 627, 659, 669, 677, 685, 688, 697, 752, 760, 772, 780: n = A,T,C or G

SEQ ID NO: 5122 - DNA, 903 bp, Homo sapiens
  misc_feature 6, 10, 15, 16, 18, 24, 27, 32, 39, 40, 42, 68, 71, 75, 87,97, 101, 104, 117, 123, 125, 127, 132, 134, 143, 146, 153,158, 161, 164, 181, 197, 198, 200, 218, 321, 386, 397, 408,409, 422, 480, 495, 511, 525, 529, 531, 537, 539, 545: n = A,T,C or G
  misc_feature 562, 580, 583, 591, 592, 593, 596, 602, 604, 606, 609, 619,621, 629, 633, 640, 648, 655, 657, 659, 665, 666, 669, 670,675, 676, 688, 689, 692, 700, 706, 707, 709, 711, 722, 724,735, 749, 750, 751, 755, 762, 774, 780, 782, 784, 785: n = A,T,C or G
  misc_feature 786, 789, 797, 798, 801, 803, 805, 807, 808, 817, 820, 823,832, 836, 837, 839, 847, 848, 872, 874, 878, 882, 883, 884,891, 894, 896, 900, 901, 902: n = A,T,C or G
ggtttntttntttgnngnttttgngcnttttnaggcgtnntntctgatccccgctaattgcattcggncgngctnccctacagatantgcatgcacnttgnagntaattcagtgttnttaacngntncatantntatcaagcngtncatgaangtgtngtnatnaaatgtctatgtatctntagttacattcaaatnngnaactttataaacatgttntatgcttgaggaaatttctaaggtggtagtataaatggaaactttttgaagtagaccggatatgggctacttgtgactagacttttaaactttgctctttcangcagaagcctggtttctgggagaacactgcacagcgatttctttcccaggatttcacaacttttnaagggaagatnaatgaacatcnnatttctaggtatngaactatgttattgaaaggaaaaggaacactggtgtttgtttcttagactcatgaaanttaataattatgaangcaatgaaaaattaanttgaaacattaaantctncntgacantnggaatnattcctttgccactttnttgcattaatttcagaanacnattccgtnnnttnttccantntngcnaacccatttntncctggatnttgngccatanttttgacntcccggntntnattcannatnnccttnncccggtaatcgnncantttggganatctgnnantnttaaaatatgncntttatatatanttaatttctttcannnaaanttctggnataggcctggtnatttanantnnnttnttatttgnnggnanancnntttatcgtntanaanatttaaccncttnntnttttctgnngcccttttcgtataaaaaccttcntntatntttnnngacaatnttntntttnnnc

SEQ ID NO: 5123 - DNA, 866 bp, Homo sapiens
  misc_feature 2, 5, 22, 38, 40, 43, 54, 55, 56, 64, 69, 74, 81, 85, 87,91, 107, 111, 112, 121, 123, 126, 138, 139, 141, 150, 157,158, 171, 173, 180, 187, 188, 203, 206, 215, 237, 263, 271,274, 277, 286, 293, 294, 305, 318, 319, 333, 339, 342: n = A,T,C or G
  misc_feature 345, 350, 357, 374, 377, 382, 386, 392, 394, 407, 414, 417,421, 426, 428, 432, 434, 436, 441, 442, 452, 487, 499, 511,512, 518, 520, 525, 527, 536, 538, 545, 553, 560, 561, 562,564, 567, 569, 573, 575, 582, 601, 611, 632, 635, 638: n = A,T,C or G
  misc_feature 643, 650, 652, 653, 659, 663, 667, 671, 684, 691, 694, 705,710, 716, 718, 720, 723, 726, 734, 745, 758, 770, 782, 786,792, 806, 812, 838, 847: n = A,T,C or G
angcnagagcccacggaatttncatgcctttatcgagncngcncccgcgcggannnaaacagcnggacntgccncacgagnggantntgcncttttttttgggccgnccanntcccacagncnganggggggttaatnncngaacgctgnagaatanntattgatgagcancngagaagnaacatgnncatggccaccaggcncgnccactcacngcaaaagtgaccaagccagcangtcacccttaactggcagaaaccaanatcagggnggnagnccggacttnaaatgcnnagaaacctgtnagtgatggaaggnnaagaaaaattcagnatgganaanaanaatcngggcacncaaacaaattcactganaantccanaagnctattnanaaacaagatagcnatgagtncanatcnatccnantggncntntaatnntacaaccaanccttaaccttccactctaaagggaaggaatactangaatggattacntttccggggtannataaancnggggnantaaatgatnangggaaancccaaaanctacccnnnantcnanggantntggaatnccttactcttcatcaagancatttccagnttctaaggggacccctttacnaanttnaaaanggattcnannttggcntctnaagngggntcgcccggccccnaaaaatnatnataatggaccnggggntcaaangnanctnacnggaaaaangaaagcccggnaaaggaccaggcntttccaaggaangaagggaaaatncccncgaaancccccggaataaanctcaanggggttacacaaaaaagccatccccncgaattaancccaaaaaattgggcagcc

SEQ ID NO: 5124 - DNA, 750 bp, Homo sapiens
  misc_feature 4, 10, 12, 17, 145, 538, 582, 719, 721, 726, 730, 744: n = A,T,C or G
gaancactcntnatcgnttgcaggatccctcgattcgaattcggcacgaggctgggactgacagcctgcagggtttccttgggcgcggccccaaaattgccttcaaaacaaacccgggacggttgaaagccttcgaaccgtgcangggatgcctcgggccctggcccttcgcttcctctcttgtgttatggaaataaaaacaaataaaactacaaaaaaaaaaaaaaaaaaactcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaattcgcggccgcggcgccaatgcattgggcccggtacccagcttttgttccctttagtgagggttaattgcncgcttggcgtaatcatggcatagctgtttcctgtgtgaaattgntatccgctcacaatttacacaacatacgagcccgggagcataaagtgtaaaagcctggggtgcctaatgaagtgagctaactcacattaattgcgttgcgcttaattggccgcttttccaatcggggaaacctgtcnangccanctgnattaatgaatcggncaaccg

SEQ ID NO: 5125 - DNA, 1094 bp, Homo sapiens
  misc_feature 4, 6, 7, 8, 10, 12, 15, 17, 22, 24, 25, 27, 28, 34, 36, 39,41, 47, 49, 54, 59, 68, 70, 78, 79, 86, 88, 90, 91, 92,93, 96, 104, 107, 114, 116, 125, 127, 128, 135, 138, 139,144, 147, 150, 151, 152, 161, 166, 168, 170, 175, 179, 183: n = A,T,C or G
  misc_feature 187, 205, 213, 216, 219, 224, 228, 231, 233, 260, 262, 265,270, 276, 288, 304, 305, 320, 323, 326, 330, 331, 335, 336,343, 347, 349, 352, 353, 354, 364, 368, 371, 373, 388, 389,392, 394, 403, 404, 408, 411, 416, 426, 441, 449, 456: n = A,T,C or G
  misc_feature 469, 470, 484, 507, 514, 523, 526, 534, 559, 563, 565, 589,591, 594, 595, 597, 598, 599, 603, 610, 615, 620, 621, 623,628, 629, 632, 639, 649, 650, 661, 662, 665, 666, 671, 674,680, 688, 690, 691, 703, 704, 713, 716, 718, 721, 730: n = A,T,C or G
  misc_feature 733, 740, 741, 747, 749, 750, 751, 776, 786, 787, 788, 792,794, 796, 799, 806, 808, 809, 810, 823, 824, 825, 828, 836,839, 842, 853, 858, 866, 868, 871, 876, 878, 885, 892, 901,902, 906, 907, 909, 911, 913, 916, 919, 921, 924, 927: n = A,T,C or G
  misc_feature 928, 936, 946, 950, 952, 955, 960, 961, 978, 981, 983, 985,987, 989, 995, 997, 999, 1003, 1008, 1026, 1038, 1039, 1040,1044, 1046, 1051, 1054, 1062, 1064, 1068, 1072, 1073, 1075,1077, 1090, 1092: n = A,T,C or G
cctntnnncnantanantacananntnnttcacncncantntaatantntcctntctanctctcttanantttacgcnnacatatncncnnnnctnatcttctncanattttananatatacctnannctccatncannaggtngtnacnnnggataaatnggggngntngtaangagngctnatcnaactactaggttggaatnaattcctnccnttnttctnactnagntnaatcatcgtacgaggaaaaaacaaagnantancttangccttngacaaggatatnagcacctaatgtactnntaagcttaacctggnggnaancccnnatanncgtaaantganantannnaatgccacangtgnagntntgcatcccctgaaannctnanaacaaatgnntaangantatgnctgtcttaantattctttcacttanttagttcnactgcanacccccatcctgnnaggggttattcggnagttaaggtactttcataagttntaaacanaatgatatntgntattacgntaacctttctcttgatgacaatganaaananaagccagtttccacagaagactananaannannngttnggggtgntcctnctggnngntatcnnttnttgccanacttttcccnncattttaaaanngtnnaacanttnggatcntttcattntnnctttcggtaaannttttaatcntcntnacnaattggaancanatatttnncccaantnnncctttaaaaatcttttagccaacancttcttctannnaaantngnaanaaccctntnnnatactaatgaaannntgnctattatnctnacnttgtttaaaanaatcntattcttngnganacccnanttattcnggtttcnccccctttnncttnncnanangcntcntnaantgnncacaatancggtctaaanctgngnatncacannttcaccttacccttacntantnantntncttgananantaantaggntcctcttagcctcaaatnaaaataactttnnnaacntntatanctntgcaaacntntttnccanncntnaatatccaatttncncg

SEQ ID NO: 5126 - DNA, 1247 bp, Homo sapiens
  misc_feature 1, 2, 7, 8, 10, 17, 18, 22, 29, 31, 32, 38, 40, 47, 51, 54,57, 60, 67, 69, 74, 77, 78, 83, 86, 89, 95, 98, 107, 115,133, 159, 172, 174, 177, 178, 179, 180, 182, 188, 189, 192,197, 203, 206, 207, 208, 209, 211, 212, 213, 214, 217: n = A,T,C or G
  misc_feature 219, 224, 228, 230, 232, 233, 234, 238, 248, 249, 250, 252,259, 260, 264, 271, 272, 275, 276, 277, 278, 283, 287, 288,290, 291, 292, 296, 298, 300, 301, 302, 304, 308, 310, 311,312, 313, 319, 322, 325, 328, 336, 337, 338, 342, 344: n = A,T,C or G
  misc_feature 349, 350, 353, 355, 356, 357, 358, 359, 360, 361, 366, 370,375, 385, 387, 389, 392, 394, 395, 400, 403, 406, 407, 410,416, 423, 424, 427, 428, 429, 430, 432, 433, 436, 439, 443,447, 450, 453, 455, 456, 458, 460, 461, 464, 467, 468: n = A,T,C or G
  misc_feature 474, 475, 477, 478, 481, 484, 485, 487, 492, 494, 501, 503,513, 517, 521, 522, 531, 533, 536, 539, 541, 545, 546, 548,551, 553, 554, 555, 559, 561, 564, 566, 570, 571, 581, 582,584, 590, 602, 603, 606, 608, 609, 615, 620, 635, 636: n = A,T,C or G
  misc_feature 638, 640, 647, 652, 654, 655, 659, 661, 664, 665, 667, 673,675, 676, 677, 679, 680, 681, 690, 693, 697, 698, 699, 707,708, 710, 713, 714, 715, 726, 731, 733, 736, 740, 741, 743,747, 752, 757, 767, 768, 779, 780, 794, 802, 812, 823: n = A,T,C or G
  misc_feature 827, 833, 839, 843, 849, 850, 852, 854, 855, 856, 857, 860,862, 863, 880, 882, 883, 886, 887, 892, 899, 902, 903, 905,919, 922, 924, 928, 930, 931, 932, 935, 936, 940, 956, 959,960, 964, 970, 971, 972, 979, 981, 983, 987, 990, 993: n = A,T,C or G
nnggatnncncgcgtcnncgcnatgtgcnannaacacnantgtgtgntggngcnctngtnttttacngntgatnacnnagatnttnttnctcccnggngacgattgnaatcctanacagactacttgttgctntttgcaggtacccatcgattcgaatncggcacggaggcnancannnntngggacnnggnttaantggcgncgnnnntnnnnacnanagggnacgnanannnttcntaacaccttnnnangttaatnnactntgcagcnntannnnctccntaanngnnngtancngnnntnaggntnnnngcagtnacnaantangctacagnnnacgntnaaatnnttngnnnnnnnaaaantganggagncaaatagtgntngntgnanncgttnaanatnnggncagatnggtcatnnggnnnntnnttnatntggnaacntanttngnnantnntgngtnnagcatnngnnagnatnntnatatntntaactgntntgaccaaatncatnaacnnaattactgnanganaancngccnntnttntnnntatngntancnaganngtgagggcgnngnagtgangatgtgtagaannagntnngaagtnatgcnacacgtttatatgtnncntntatcagnggaananngatntntanngnttgacngnnntnnngctaaaganaanaggnnnagcgaganngnagnnntctgtacagantcccncnaantgtnngnccgncgaanaatcnatataattcnntatggttatcnntgtaggggcgttcnacacgatnaattatactnacgattcgtangttncttacncaatancgcncgctgnnanannnntcnanntcgcgaaactatagtancnncgnnagggnaaagatncanngngtacgcaattaaanacnangcantnnntgnngganatgtacgtaaccatantgnntacntactannntacatgngntntatnttntgncgatgatatcgtanantatatagtncgantgatntatnatnctctactnataganttgtatntnnacanaagatnaatatctacatntantancanagatangctgcaaatnactggngnacacntcatanataanaccnncaanantgcgannnatcatnatagagtgactntattatannaaaaataaccantncgtganatngannntnaatntacgtggttngatgatcgctacgtanaaccncngnncn

SEQ ID NO: 5127 - DNA, 847 bp, Homo sapiens
  misc_feature 9, 13, 15, 19, 21, 29, 30, 45, 49, 50, 56, 59, 84, 86, 93,96, 99, 104, 115, 119, 121, 125, 128, 130, 136, 140, 147,151, 157, 158, 159, 165, 167, 190, 191, 193, 195, 197, 198,200, 207, 208, 210, 213, 217, 219, 221, 225, 227, 228: n = A,T,C or G
  misc_feature 231, 237, 240, 243, 245, 246, 253, 254, 256, 257, 258, 263,264, 266, 267, 268, 269, 270, 274, 276, 280, 283, 287, 291,294, 295, 296, 297, 307, 324, 327, 329, 332, 335, 336, 340,343, 344, 346, 347, 350, 358, 360, 363, 365, 369, 374: n = A,T,C or G
  misc_feature 376, 378, 379, 382, 383, 395, 401, 405, 406, 410, 413, 417,419, 420, 423, 427, 429, 432, 433, 434, 436, 437, 442, 450,453, 455, 458, 460, 462, 464, 465, 467, 469, 474, 476, 478,479, 480, 484, 486, 496, 497, 508, 516, 520, 524, 527: n = A,T,C or G
  misc_feature 537, 545, 553, 560, 561, 579, 589, 600, 605, 606, 614, 615,616, 620, 637, 640, 642, 644, 646, 648, 650, 653, 657, 666,667, 674, 678, 679, 681, 682, 686, 687, 689, 690, 692, 696,699, 707, 708, 711, 714, 717, 725, 727, 729, 731, 733: n = A,T,C or G
  misc_feature 739, 743, 752, 765, 766, 780, 783, 785, 791, 793, 799, 800,801, 805, 806, 810, 818, 821, 833, 835, 840, 841, 846: n = A,T,C or G
cctgctgtngggnanatanancgtgctcnntttgtacttccccgnatgnnccatcnacncgacgagcctaacgcttgtcaactngngggatcnganttngagantgactttgtgncatncntgantananctgtangttngtgaaanccanactacnnngcctcngnctcatcacctcttacacattccnnanantnncncagtctnnanaangagncntngatnannaanaagagnctntgnannaacaggnntnnnaagcnngnnnnnactnanagcntgngaantgancgnnnncttggtctgngtccggtaagaagacancantngcncanngacnggnnanncgncaggccantnaangnagcntgcgntnannttnnatgaagttgagnatggtnaacnnaatntcnaacngnnctntgtncntgnnngnnacacntgcctganaancntananancnngnantagantncnnnaacncngatcttatanncactttggaanaagcactnatcncctnacngggcatcctntttgagancaggacanctgttgnngggacgccccatgacacnggcccagaanactccgggttntttgnntttcagcnnnaaanggcgaagtgatttcctnttncntncngngnacncatnggctcatgnnccccctnaaanntnnttanngnncntcgntanacaccctnnatngcnaanggcccaangntncnanttcgcnaccntttaccatnaaggatattaccnnaaccgtgccctttngantngccagncnattggnnntttnnttgnaccatttnggnaaaggggcaaantntttanncgtcnc

SEQ ID NO: 5128 - DNA, 761 bp, Homo sapiens
  misc_feature 2, 4, 10, 70, 75, 77, 84, 97, 103, 131, 179, 184, 189, 196,198, 210, 211, 224, 230, 245, 271, 275, 300, 307, 318, 330,337, 338, 348, 356, 363, 371, 378, 409, 411, 412, 440, 446,449, 461, 491, 529, 536, 551, 567, 578, 585, 633, 635: n = A,T,C or G
  misc_feature 639, 641, 642, 653, 657, 660, 679, 680, 684, 685, 698, 699,702, 705, 707, 711, 713, 715, 727, 740, 745, 748, 749, 755,760: n = A,T,C or G
gncntttganttcatatacaagctacttgttctttttgcaggatcccatcgattcgctgcagcgtctggngtttncnttgcagncctcggaaccagnacctcngcgtggcctacagagttatggcgacaanaggccgtgtgcgtgctgaatggcgacggcccagtgcagggcatgatcnatttncagcngaaaganantaatggaccagnnaacgtgtggggangcattnaaggactgactgaangcctgcatggattccatgttcatgantttngagataatacatgaggctgtaccantgcaggncctcactttantcctctatccanaaaacanngtgggccaanggatgaanagaggcntgttgganacttggncaatgtgactgctgacaaaagatggtgtggncnnatgtgtctattgaagattctgtgatctnactctnagnagaccatttgcntcattggcccgtacactgttggtccatganaaaagcacatgacttgggcaaaggtggaaatgaagaangtacatngacaggaaacgctgnaatgatttggcttgtngtgtaattggnatccccnaataaacatcccttggatgaagcttgaggccctttaattcattttttnantccngnnaccttgttaantggnacntggaacacttaaccccttnntttnntaaaaggagaaanngtnttntntttnanangagttttttaanccccttggtcganaaaanttnntttttnatttnt

SEQ ID NO: 5129 - DNA, 805 bp, Homo sapiens
  misc_feature 2, 3, 10, 11, 13, 17, 20, 24, 28, 32, 56, 57, 59, 61, 64,72, 73, 81, 94, 96, 99, 101, 107, 110, 114, 116, 118, 125,129, 144, 146, 147, 162, 183, 191, 193, 194, 197, 198, 223,226, 236, 239, 241, 249, 264, 266, 267, 273, 274, 275: n = A,T,C or G
  misc_feature 279, 282, 283, 284, 294, 295, 297, 300, 310, 318, 324, 328,332, 342, 346, 347, 351, 352, 360, 372, 373, 376, 386, 387,390, 394, 407, 409, 419, 424, 430, 440, 445, 454, 460, 463,464, 466, 467, 468, 469, 475, 477, 487, 490, 502, 507: n = A,T,C or G
  misc_feature 519, 524, 528, 529, 530, 533, 537, 543, 548, 558, 563, 566,569, 578, 580, 594, 601, 608, 616, 630, 633, 637, 638, 642,651, 660, 667, 668, 675, 683, 690, 705, 708, 709, 715, 717,722, 726, 731, 740, 757, 766, 771, 787, 793, 797, 804: n = A,T,C or G
  misc_feature 805: n = A,T,C or G
tnnctaatannanaatnctncttnttgntctntttgcaggatcccatcgattcganntncngangaggagannctgtcggncatgtggtggaancnggntncggacntgncatngncntgtgccntgtnaactacaggcactgncnntttggaacaactcanggcattcatgcaaggctcatncctgtggnannaanngggactaacattattggtgcggctnccnaagcatggtntcntnatggatgnattctgtccctgtgncnntgatannntatnaannnactgaagatnncnatnaagttaaatntaaagagnatggcntatnaacngatcaggtangganntacnntggcaacncgagacactgtnngtncaagagcgcnntgnggcntgctcaataactngngccacaggcnacacnataatntactctatanatgcnctcaatacnccggtnacnntnnnnaggacngntcattattangcnctcctggactgnaccgnacttgtctctgnacagngatnnnccncgtnccttanaaagnagttcctacnaaacntgntangcattatanangtatgcctgcattngaactgnacgtctntgagactntcaataacgtggtncanttgnnattncaagccacntatttgagngataacnntggcgantgatcatncttactnggcccttaatgttcncannttgcantnagctngccntccangaaaacctngttttcccggttggganataaaaacngggancctggaatgcaatggnaaaaanccgnttagaann

SEQ ID NO: 5130 - DNA, 805 bp, Homo sapiens; identical to SEQ ID NO: 5129
  misc_feature 2, 3, 10, 11, 13, 17, 20, 24, 28, 32, 56, 57, 59, 61, 64,72, 73, 81, 94, 96, 99, 101, 107, 110, 114, 116, 118, 125,129, 144, 146, 147, 162, 183, 191, 193, 194, 197, 198, 223,226, 236, 239, 241, 249, 264, 266, 267, 273, 274, 275: n = A,T,C or G
  misc_feature 279, 282, 283, 284, 294, 295, 297, 300, 310, 318, 324, 328,332, 342, 346, 347, 351, 352, 360, 372, 373, 376, 386, 387,390, 394, 407, 409, 419, 424, 430, 440, 445, 454, 460, 463,464, 466, 467, 468, 469, 475, 477, 487, 490, 502, 507: n = A,T,C or G
  misc_feature 519, 524, 528, 529, 530, 533, 537, 543, 548, 558, 563, 566,569, 578, 580, 594, 601, 608, 616, 630, 633, 637, 638, 642,651, 660, 667, 668, 675, 683, 690, 705, 708, 709, 715, 717,722, 726, 731, 740, 757, 766, 771, 787, 793, 797, 804: n = A,T,C or G
  misc_feature 805: n = A,T,C or G

SEQ ID NO: 5131 - DNA, 746 bp, Homo sapiens
  misc_feature 2, 5, 17, 131, 170, 191, 306, 495, 498, 508, 540, 554, 561,580, 586, 662, 703: n = A,T,C or G
gnccnttttgaattcanatacaagctacttgttctttttgcaggatcccatcgattcgctgcagcgtctggggtttccgttgcagtcctcggaaccaggacctcggcgtggcctatcgagttatggcgacnaaggccgtgtgcgtgctgaagggcgacggcccagtgcanggcatcatcaatttcgagcanaaggaaagtaatggaccagtgaaggtgtggggaagcattaaaggactgactgaaggcctgcatggattccatgttcatgagtttggagataatacagcaggctgtaccagtgcangtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcanatnacttgtgcanaggtggaaatgaagaaagttcaaagacagganacgctggaagtcgnttggctngaggtgtaattgggatcgnccaatnaacattcccttggatgtagtctgagccccttactcatctggtatcctgctagctgcagaaatgtatcctgataacnttaacactgcatcttaaaagtgtaattgagtgacttttcanagtgctttaaagtacctgtagagagaactgattatgatcactt

SEQ ID NO: 5132 - DNA, 762 bp, Homo sapiens
  misc_feature 1, 2, 7, 9, 12, 13, 14, 17, 18, 30, 95, 679, 738, 740, 757,761: n = A,T,C or G
nnatatnanggnnnctnnttacttgctctntctgcaggatcccatcgattcgagaccaacccgcctgcaggaggctctgaacctcttcaagagcntctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttccccgagtgattttgcgaaacccccttttcccttcagcttgcttagtgttccaaatttagaaagcttaaggcggcctacagaaaaaggaaaaaaggccacaaaagtnccttttactttcagtaaaaataaattaaacagcagcagcaaccaattaaaatggaattnangaaccaatgaaataatnttgng

SEQ ID NO: 5133 - DNA, 1563 bp, Homo sapiens
  misc_feature 2, 6, 7, 22, 28, 30, 31, 41, 42, 46, 50, 52, 53, 59, 60,61, 69, 70, 75, 81, 84, 91, 100, 101, 109, 127, 129, 131,132, 139, 140, 142, 157, 158, 160, 169, 172, 188, 196, 200,206, 211, 216, 226, 239, 241, 242, 249, 253, 262, 263, 275: n = A,T,C or G
  misc_feature 282, 283, 291, 303, 312, 314, 316, 321, 325, 327, 328, 336,337, 341, 345, 355, 357, 359, 363, 365, 370, 373, 376, 378,380, 382, 388, 391, 396, 398, 399, 412, 416, 418, 420, 421,425, 428, 429, 436, 438, 439, 445, 448, 449, 451, 452: n = A,T,C or G
  misc_feature 463, 464, 465, 467, 469, 473, 475, 482, 484, 486, 492, 494,497, 498, 503, 518, 530, 531, 532, 534, 545, 559, 560, 563,570, 571, 572, 573, 577, 578, 581, 590, 593, 594, 596, 599,603, 605, 607, 611, 613, 617, 625, 626, 629, 630, 631: n = A,T,C or G
  misc_feature 632, 635, 646, 659, 661, 681, 682, 688, 690, 691, 694, 698,701, 703, 706, 708, 715, 716, 717, 718, 723, 725, 732, 733,737, 758, 761, 762, 764, 765, 766, 767, 774, 782, 794, 796,797, 799, 801, 815, 817, 820, 838, 839, 846, 852, 855: n = A,T,C or G
  misc_feature 892, 894, 902, 904, 921, 925, 928, 930, 932, 934, 936, 942,944, 958, 969, 971, 977, 978, 985, 990, 993, 1001, 1003,1006, 1008, 1016, 1020, 1021, 1023, 1025, 1032, 1040, 1043,1048, 1051, 1052, 1053, 1056, 1073, 1074, 1075, 1077: n = A,T,C or G
  misc_feature 1080, 1086, 1092, 1099, 1100, 1101, 1102, 1105, 1110, 1114,1119, 1123, 1136, 1137, 1149, 1154, 1155, 1156, 1162, 1170,1187, 1190, 1195, 1202, 1204, 1205, 1208, 1217, 1218, 1219,1221, 1226, 1236, 1240, 1245, 1247, 1270, 1275, 1280: n = A,T,C or G
gngaannaaaggaacgaccggnaaaaangnnaccgcggcgnncacngacngnnaatacnnngcgacggnncgtgnaaaagnggngaggcgnaagtgggcnnaaataaanaaaacgcggcgagagcancngnngaactanntngcagaagagatggtnnangcacggagnggnccgtttttgaaaaccncctcggtncaangccccncgganaaatngtacgcgtgngtaagaaaggccngnnaccgtgnaaantcgtgccgnntggagcgagcgnagaaaanncaagtgcnaagacgacgaantttttgtgncncnagtgngaanannaggtggcnnacgngggngggggggggntngnagangngaatngtnagngnangntaaaanacncgcgngnnggacacaaaagangganancnnatgnggnnagagaantnnggtaancgnngnnaggagaagcgnnngnanaggngnaggtatngnangagcgnancannggatncgagggaaaagcggngcgagaaacatnnntnacgacaatggngcgagaggaaacgnngcngcggaannnnaaannaantagagaganacnngnagntggnananaaangngggnggaggaannggnnnnganggagatagagncacggggcgtgananacaaacagaaagtgacgtgnnatagangnncgnaacntgnangangnggcatannnngggananagataanntccnagatagagacgacggggcgcntanngnnnnagattgncggacaancgctgatgcgtncnnangntgagagaaagcgangncanctcaggggggggaagggnngtgtagngagcgnacncaaatggagaaagaacggtggaagacaacgacgcggngnacacacgntngagacgtgggcaaacanagcncangntnantngagtgngncgatgtaagtgacntgaaacatacnanctcggnnggagggnataanaanaggaatgngnggnangcgaaganaagnntntncgtaaanaactaganggncgcanaannnggngaggcgaagacgatgannnanganaaaggnggatcnaacggannnncgnatgcnattntggcncacngtaatatatggannagcgaggacatnggcgnnngagaangccggaangacggaagatagaatgnaanattgnggggagngnnagnaatgaacgnnnangacgngcaggtttgngagnggagnangaaggggagggacgacgagggtngtagnggagnnggacgagtgancgcngagtgagatncaaggacgaagananacnnnggnganncgtagntcgcgataacgnnataangagnnanagngganncanataccgaanncnaganncacgtgnnganntgcaaaaaaagaancgggntnggcangacgatgcggnnngagaaggganaaatnacncagggaanntgggnngaacnncaatangngtncnangcggaaaaangngngataaggnaanganggatagcnancgggngacnanngtnncnagngaagccg

SEQ ID NO: 5134 - DNA, 752 bp, Homo sapiens
  misc_feature 6, 42, 51, 76, 97, 108, 116, 121, 147, 149, 150, 155, 169,175, 183, 203, 209, 214, 215, 218, 222, 227, 236, 250, 252,258, 268, 270, 282, 284, 286, 309, 313, 314, 318, 323, 326,338, 344, 351, 359, 367, 375, 386, 387, 401, 402, 405: n = A,T,C or G
  misc_feature 410, 415, 416, 428, 442, 443, 446, 448, 449, 455, 458, 460,462, 481, 502, 513, 519, 520, 533, 534, 543, 575, 576, 583,592, 593, 594, 606, 616, 634, 640, 647, 654, 659, 695, 697,700, 701, 702, 705, 719, 737, 748, 751: n = A,T,C or G
gaagtngctcttgttctttttgcaggatccctcgattcgctnacgtgtcgncggggcggtcgcagacttcagggtnctctaacggagaggccaggcnccgcgtggccngacaactncctgnccgctccttcagcaagtgactgtctntnncactncttacctgctgaangatctngctcagcngctggaacaatgctgctgtnacacantctcnnctntgcnacttnaggatgctncttggtcaccaggnantggganctgtagaccngncgcatgcacttncncnacattcactgctgactggcttanctgnnatangttcnagngaccgggacttntcttanagtcagnagccctcncaactacntcataccntcgcatctgannattttcacagaggnnttntcttngaagnngacttggcaagncttacaagttgatnnatngnnattggnaantncntttcttcaaatgctaaaantcatgtcctcataaatgcaantgattttagancacaanntccccatgtacannttccattanttaaactagaccaatgtgtacgggtcatttgnngtattgnggaacatcnnngttactggaaangactattaanatttcacagatgggcttnatcaanttgctangaattgngtctnctaagtgtagttaacttgcagaatccaacttaactncnagnnnaantttcaaaactgatnctgtgaatggatggggancatcttaactnttng

SEQ ID NO: 5135 - DNA, 881 bp, Homo sapiens
  misc_feature 2, 3, 4, 5, 6, 7, 8, 9, 10, 11, 12, 13, 14, 15, 16, 18, 19,20, 21, 22, 23, 24, 25, 26, 30, 31, 32, 33, 34, 37, 38,39, 40, 42, 43, 44, 45, 46, 47, 49, 50, 51, 52, 55, 56,57, 58, 59, 60, 61, 62, 66, 67, 68, 69, 70, 71, 72, 73,74: n = A,T,C or G
  misc_feature 75, 76, 79, 80, 81, 82, 85, 87, 89, 94, 96, 106, 124, 129,130, 144, 147, 157, 159, 160, 163, 164, 165, 166, 168, 172,173, 174, 177, 178, 183, 185, 187, 188, 190, 198, 202, 203,209, 220, 221, 224, 229, 231, 232, 245, 247, 248, 256: n = A,T,C or G
  misc_feature 258, 267, 276, 279, 283, 288, 297, 302, 303, 304, 310, 311,312, 314, 319, 322, 328, 331, 332, 333, 359, 360, 361, 362,365, 374, 375, 379, 397, 401, 404, 411, 413, 416, 420, 426,430, 435, 438, 448, 454, 458, 468, 476, 477, 478, 479: n = A,T,C or G
  misc_feature 490, 491, 494, 496, 505, 521, 527, 528, 536, 547, 552, 556,558, 561, 562, 563, 564, 570, 574, 576, 578, 579, 585, 592,593, 595, 602, 612, 614, 615, 621, 634, 646, 647, 650, 665,670, 675, 677, 679, 684, 685, 694, 699, 707, 709, 710: n = A,T,C or G
  misc_feature 717, 720, 724, 740, 748, 752, 753, 754, 759, 760, 765, 772,774, 778, 783, 785, 787, 792, 799, 800, 809, 821, 824, 830,832, 848, 849, 856, 863, 865, 866, 869, 880: n = A,T,C or G
annnnnnnnnnnnnnngnnnnnnnnngggnnnnnggnnnngnnnnnnannnnggnnnnnnnngggnnnnnnnnnnnggnnnnggngncngatangnagacccgttnatacaacgacccacggancgganncggcacgagaagcngcnagggccaggngnnaannnnanaggnnnagnnggacncngnnangaaaaganaggnnaggggngggcgacaggnnganacagncnnagaaaaagcaggnannagcaaagnangggaaagcnagcgggcangcncgcnaaccnggggaacgnccccnnnaacacnnncnaaacncgngagccnccnnnaacgaaggaggaggaggagcaaaccnnnnccngggacgganncagnaagagggccagcgcccangganaancacaagnanganagcnggaacnggcncaaanacngcagcaaagncagcanaganacgcaaaggnacaaagannnngagccaggcannagncnagacacagnaagggaacagacaganaggcanncgaggccnggaaggagcgnacaanccgngnggnnnnaaagcnaaangnannaaacangagccanncngagggangacagccagnannaaacanaaaggccgcacgnacacagcagcgnngcnaagcgggaggagccnaaaanaacanangnacggnnggcccggcnacagnggccacgncnncgggggnccnggcncccaaggggagggccnaagggggngggnnngaacnncccgnggggacnanaagnggggncncnccagnccggggnnaacccgggngggaaaccccanccncggagngnaaaaagggcccaaaanngcccagnaggaaangnngcnggggcaaaacng

SEQ ID NO: 5136 - DNA, 786 bp, Homo sapiens
  misc_feature 3, 5, 6, 7, 9, 13, 14, 17, 21, 22, 26, 31, 40, 59, 61, 62,68, 72, 75, 82, 84, 88, 89, 90, 92, 96, 100, 104, 105, 111,117, 140, 147, 159, 213, 242, 266, 284, 315, 319, 321, 327,330, 333, 342, 349, 350, 371, 386, 404, 421, 427, 428: n = A,T,C or G
  misc_feature 430, 434, 451, 453, 458, 472, 483, 505, 516, 528, 533, 544,565, 583, 620, 633, 636, 639, 647, 652, 687, 695, 716, 719,734, 738, 748, 764, 767: n = A,T,C or G
aangnnngngggnntgntttnntggntgggntgttattcntggcgctctggctacttgntnnatttgnatgnatncgggcgntncgannngntgtnctgngttnnatcttntaaatngcttgtccttattatgttgttgnttaacancttaaacgctanctctagaccaggaataattatttgctatatattacagcaaaaaatatgtatgtntaaatggactcattcaagaatatataagngaactcctattacaaagaaattgncaaacagcccagtatatnaatgaatataaaaatttgagaagatattttncatngnaagatntcnaantgaacattnggcatgnnaaaaccaaattttaggatatnactacacactctggnctagtttaaaagactganaatattaagtgtgtggnaatgtnnancaantggaaatggcctgcatntngcatngaaatgtaaaacantacatatactntgcaaaactctgtccaacattntctacccattnaccaagcaactncatcncctagctatanatacccagggaaaataagtanggtatcttcacagaaatnattgtatgaagaaatattcatagttacttattgcacntgtcagttatcangtnaanctgtctcncatcnggaaaaatgggatatcaaaattggtgtggataatnaatacaancaattagggatattacttggngcnaaacaaaaaatgaanacanggggaaaatncacattcaaaccaaantangtggcatattatacccacg

SEQ ID NO: 5137 - DNA, 866 bp, Homo sapiens; identical to SEQ ID NO: 5123
  misc_feature 2, 5, 22, 38, 40, 43, 54, 55, 56, 64, 69, 74, 81, 85, 87,91, 107, 111, 112, 121, 123, 126, 138, 139, 141, 150, 157,158, 171, 173, 180, 187, 188, 203, 206, 215, 237, 263, 271,274, 277, 286, 293, 294, 305, 318, 319, 333, 339, 342: n = A,T,C or G
  misc_feature 345, 350, 357, 374, 377, 382, 386, 392, 394, 407, 414, 417,421, 426, 428, 432, 434, 436, 441, 442, 452, 487, 499, 511,512, 518, 520, 525, 527, 536, 538, 545, 553, 560, 561, 562,564, 567, 569, 573, 575, 582, 601, 611, 632, 635, 638: n = A,T,C or G
  misc_feature 643, 650, 652, 653, 659, 663, 667, 671, 684, 691, 694, 705,710, 716, 718, 720, 723, 726, 734, 745, 758, 770, 782, 786,792, 806, 812, 838, 847: n = A,T,C or G

SEQ ID NO: 5138 - DNA, 787 bp, Homo sapiens
  misc_feature 3, 4, 5, 6, 7, 8, 9, 10, 12, 15, 18, 19, 20, 21, 22, 23,32, 39, 619, 683, 731, 733, 757, 770: n = A,T,C or G
ggnnnnnnnncnggnttnnnnnnttgcttctnagccttngcatttgactcctgcaggatcccatcgattcgaattcggcacgagctttagttcagataaaggaaacatccaaaaatactgagatgagtaaaattttattcaaagtaggttcctgctttgtcttgatctcaatccattctaactcctgatgtcatttaccgtgtgagatcttagtacaatcatgaaaagaatatgagcatttatcaaaactctctgacatctgtatgtttagaaatgaacttacacagcaaaatatgatttccttgcacttatttaatttttctaacttcaatttctacctatgtgtctctgccagtttgacctgattcagacacccagaacttgaataaagaagccctcttctattttcattcttaatgaatataccttttcccatgtccacattgagcctcccttctgtgtactctgctaatgcagccacatgtctagttccccctctctgcaccaccctcacttcttctttcccatcttcttacttctttggtgtgacctctctgtaggacaacatgccatttctgattccccacacacataccctatcattgatacctaccctcanggattagaatctggctagtaatttggaagagcccatcaaggctttagtaaagtattggactggnaagtcaacacccattatctcatcaaaagggatgctgtgttgggggcananggagagagagagagagagaccganagagagacagacngagagagagaaaggaat

SEQ ID NO: 5139 - DNA, 795 bp, Homo sapiens
  misc_feature 3, 6, 7, 8, 9, 11, 12, 20, 30, 33, 40, 43, 330, 582, 619,761, 773, 781: n = A,T,C or G
ggnttnnnntnntgccttanaagccttgcntangatgccnttnggatcccatcgattcgaattcggcacgagggaaccatgagaaccgaagctagaattgctattgaattactttattttctcttcccttattgggtagagatacatcattactggcctcaggggtttacccaaagaaagggtatttttgagcaaataatgtgatttcctggctattttgttgggggcttaagatttttttttttcaaatgcatttttagtcactaaaaattaactgtcgtaccatctagaactatactgtccagtaccatagcctctagccgtatgtangctatttgtattaagattaattgaaattttaaatccagttcctcagtcacactagccactttctaagtgctcagtagctctgtgtgaccagcggctactgtattggatattatagaaggttctttcattcaagatcatcattcttgacagacccataaatatttcctataaagactgtagaagtgtgttctggagggtttgctctccaaaaagaattgtaatatagagtagaattgggatagagtattgaanacactgggtttagacattggatattttaaatgattgnggtgttcaattcatgtgctgcccaactggagttatctagtggatattgaccctcactggcttgaccaaaagcccggaatagaaaggcagggaattcctgaaattctaatcttaaaaatttggcaatggaaaaagcccttttnccctaaaattantcccattnttgtaaattccttg

SEQ ID NO: 5140 - DNA, 740 bp, Homo sapiens
  misc_feature 455, 474, 486, 528, 540, 557, 572, 617: n = A,T,C or G
taagttgctctgttctttttgcaggatccctcgattcgaattcggcacgagactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcanagacgtcaagttggctgangcacaccagcangagtgctgccagaaatttgaacaactttccgaatctgcaaangaagaactgatnaatttcaaacggaaganagtggcagcatttanaaagaatctaattgaaatgtctgaactggaaataaaacatgccangaacaatgtctcccttttgcagactgtattgacttgttcaagaatactgatatgccttcctcagaagaaaagaaatgaatgtgaaagaaagccagcctcactgccttaaatcattacccggaa

SEQ ID NO: 5141 - DNA, 1191 bp, Homo sapiens
  misc_feature 13, 15, 17, 22, 24, 26, 29, 32, 33, 43, 44, 47, 49, 56, 57,60, 66, 67, 68, 72, 87, 90, 93, 101, 105, 106, 112, 118,131, 132, 134, 135, 137, 139, 145, 147, 151, 152, 154, 158,159, 165, 168, 171, 178, 181, 183, 185, 190, 196, 203: n = A,T,C or G
  misc_feature 204, 210, 211, 214, 219, 220, 223, 224, 231, 233, 237, 244,250, 255, 258, 259, 261, 267, 274, 284, 288, 295, 305, 307,315, 317, 318, 322, 337, 344, 350, 363, 366, 369, 373, 377,383, 388, 390, 396, 399, 400, 403, 406, 407, 408, 412: n = A,T,C or G
  misc_feature 414, 418, 421, 426, 431, 434, 445, 446, 461, 462, 471, 475,477, 480, 481, 486, 494, 499, 509, 512, 515, 516, 517, 521,523, 528, 534, 535, 536, 537, 539, 546, 549, 550, 552, 553,554, 558, 561, 565, 567, 573, 574, 575, 580, 586, 587: n = A,T,C or G
  misc_feature 593, 594, 595, 599, 603, 616, 619, 623, 627, 630, 631, 634,636, 637, 646, 662, 666, 671, 674, 677, 678, 680, 681, 689,692, 693, 694, 695, 703, 708, 711, 715, 717, 744, 750, 757,759, 760, 765, 771, 775, 776, 784, 785, 786, 788, 793: n = A,T,C or G
  misc_feature 802, 805, 807, 808, 818, 819, 831, 833, 835, 837, 838, 839,840, 843, 848, 851, 853, 854, 857, 858, 868, 871, 879, 882,883, 888, 889, 891, 894, 895, 899, 912, 916, 919, 924, 927,932, 933, 935, 942, 945, 948, 949, 957, 961, 966, 970: n = A,T,C or G
  misc_feature 977, 981, 986, 1000, 1003, 1006, 1019, 1036, 1037, 1051,1052, 1055, 1057, 1062, 1070, 1074, 1075, 1078, 1080, 1083,1085, 1086, 1107, 1115, 1117, 1118, 1128, 1135, 1140, 1142,1144, 1146, 1148, 1150, 1151, 1162, 1169, 1171, 1173: n = A,T,C or G
cccgcatataaanananacccngngnacnaannacacacccannaananataatanngcnataagnnnacangggggaacaggggantanggncgaatgangacnncaattnacaggnatttaattccaanncnntnanactacngncccnnanatcnnacgagnatncancccaagnagnancngacantcagangagcgtnntacaannacngcaannacnngaccagncnggancgataangggggncaaancannanttccanggatcangcatagtacnaccnctgaatnggtaccattncnactttacncnngacnaacaagtatccctgntggcctnaaaatncaagttgaaaatnaantcngaantctnccagancaaanangacatncannccnatnnnttanantacnaantatcnaatgntanaaatccatggnnaagacataaaaactnncagctatanaaananctnntaaanggctattnggatntaaaaaccanatnatnnnaccntncaacnacctannnntnaagaaancanntnnncaanaantacnanccaatnnncaganggacgnnaaatgnnnacantcangaaattgaaaccnganaagncccnatnnaangnnttaaaaacntcagcggcaaatcccncatnccacnaanggnntnncggaaaanggnnnntaactggntaacnccnatantntaaaacgggaaccatcgccaatgcgtncgctanccaacananntaaancgatcnacannaccacagnnncntattnaagaatctngananncacacttacnnattcaaataggngncntnnnntgnatatntancnnatnngccacatctnatntatcaccncannctcanngntcnnacancatggagagcatntcgnganacaancgngtgannancacatcncancanngcgaaacnccanatatntacntgggtantcancgcgnaactgcgcgcgcgnagnatnagatcacattatntgatactacagctaaanngacacacattacanngtntntacanaaatactntacnntcnanacncnntacacacaaaaattacctcanagggagananntacatatctnaaaacanccccnanantnancnnaaaagactccntacgcgnananagtgcgctctcgnaanng

SEQ ID NO: 5142 - DNA, 753 bp, Homo sapiens
  misc_feature 1, 3, 9, 10, 11, 14, 18, 22, 28, 30, 628, 677, 729: n = A,T,C or G
ntncgtttnnntanaacnttgntctttnantctgcaggatccctcgattcgctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctgccttgaaagaaccgaagtctttcccattcacttctctagaaagctgccaaggacagaggcagaaagaatggatgaaanttctgtcaagcacacttctggtctcttaaaacttagaagtggttctaanagaacagaagtattagagaaacagttcctgtggaatcacatctttgggtggnacccattgctttttttctggttga

SEQ ID NO: 5143 - DNA, 753 bp, Homo sapiens; identical to SEQ ID NO: 5142
  misc_feature 1, 3, 9, 10, 11, 14, 18, 22, 28, 30, 628, 677, 729: n = A,T,C or G

SEQ ID NO: 5144 - DNA, 850 bp, Homo sapiens
  misc_feature 4, 5, 12, 13, 14, 17, 18, 20, 22, 29, 32, 38, 39, 42, 45,47, 49, 66, 69, 70, 75, 76, 80, 103, 119, 127, 154, 157,161, 171, 198, 232, 264, 293, 298, 305, 308, 335, 363, 401,441, 461, 468, 475, 510, 521, 551, 553, 569, 601, 609, 630: n = A,T,C or G
  misc_feature 648, 655, 656, 666, 668, 673, 675, 681, 694, 699, 710, 711,714, 748, 749, 750, 759, 766, 769, 771, 772, 773, 776, 777,778, 780, 787, 788, 790, 793, 794, 797, 800, 801, 803, 810,818, 822, 831, 836, 838, 840, 843: n = A,T,C or G
gctnntgaccannntanngntnggaatcncantcgctnnatngcncntngattcgaattcggcacntgnngtctnnctgntctgtgttggcaagggttagttnccaagtgagcaagatngttccctnctaacaggctccgacgggtgaacagtntgngtgntatccatacncaggcacatgccatcggcttacagcanggtcctcaactggtgcctgctggccctgggggangaggcaaagctgtggctcccagcaaagcagancaaaaagagttcgcccatggatcgaacantgacnagtatcngcnacgccgagagaggaacatcatggctgngaaaaagagccggttgaaaagcaagcangaaagctcaagacacactgcaagagtcaatcagctcanaagaagataatgaacggttggaagcaaaaatcaaattgcntgaccaaggaattaaatgtnctcaaangatttgnttcttgagcatgcacacaatcttgcagacaacgtncagtccattancacttgaaaaatttcgacaagcagatgggngncaatggcacggaccanttgacccttaaccccttttccaagacttttanaagcttgnaggctttggaatggctaaaanggtggtggaccccccggnaacctcnntcattgtcancngggcntnaaaaantttggcccatttntcccnttgaacttcannagnaccccatttggtaggcctatttttcctgggggannnaaatccctncaataanttntnnnttnnncnttaaaanngnttnnccnttnngnattccgnattatccngggnttttaaaanggatnananggntttttct

SEQ ID NO: 5145 - DNA, 790 bp, Homo sapiens
  misc_feature 2, 13, 31, 36, 39, 41, 55, 56, 58, 62, 63, 74, 75, 78, 80,84, 97, 99, 100, 103, 104, 107, 110, 126, 128, 129, 132,133, 135, 137, 140, 143, 145, 148, 150, 157, 159, 175, 181,185, 198, 201, 206, 216, 224, 230, 234, 245, 269, 282: n = A,T,C or G
  misc_feature 288, 317, 322, 328, 336, 340, 350, 373, 382, 385, 386, 389,394, 395, 400, 401, 403, 404, 405, 407, 414, 416, 431, 436,439, 441, 445, 449, 462, 464, 469, 470, 472, 477, 479, 481,482, 485, 489, 491, 498, 524, 527, 528, 531, 534, 543: n = A,T,C or G
  misc_feature 550, 558, 567, 578, 593, 595, 609, 611, 614, 618, 620, 623,636, 642, 653, 654, 655, 672, 675, 678, 683, 721, 742, 763,776, 779, 780, 783: n = A,T,C or G
cnatcatctttgnttctatactcagcttgcntgtanagnangtccgggttaccgnncnccanngtaccctatanngantngtantacaaagagactnanngcnnttnaanggccgcgttactacanannacnnantngtnacncnctngnatcaccnancttaatctccttgtancacatncctncttttgccagctngcntgatngcgaagaggnccctaccnatcgcncttncaaacagatgnggcaaactgaatggcaaatggacncgccctgaacccncgcatnaagcgctgttgctgtgcaggttacccgcncagtnacccantacacttnccancgccctagcnccctttccttcctttctttttcnttacgtacnccnnatntgcgnnggatnntnnnantaagctntnaattttaggcttccnatacngtncntaantagngctttaccgcacntngatcnntnaaaantngnntanggtnangggtcanataccgtgccatacccttgtagaccnttnnttnccnttgaacgtngaagtanatcgttcnttaataatncactcttgganccaaactggaaccananctcgacccaatctncnggntatntnttnggatttataaagngattantgccctttgtnnnaactattggggcttganatntgnccaanattttaacgatgaaattttaaaccgcgaaattttaacncaaaaaattttaccgctttancaatgttatttggaatgcctntaaaccccctttntanntcnctccccc

SEQ ID NO: 5146 - DNA, 775 bp, Homo sapiens
  misc_feature 18, 21, 29, 31, 127, 531, 546, 548, 570, 628, 641, 657, 664,671, 735, 746, 773: n = A,T,C or G
catatatctttgattccnttnaacccttncnaactacttgttctttttgcaggatcccatcgattcgaattcggcacgagccaacgatctgtatcaaccacgtcttcattttccttttcctgtttgncttactctccccccaaaaagagtcagtttcctgttttctcaatttctcagtttaaaattagagccctatggcaggtgccatgtacagctgcaaaggtggcaagaagccctgagaaagctcaagaacaggtcaagggggtgggtaaggaagatgggacgttcaagcagaaacaaaaagaggagctaaaagtgaaagccaccccgccaccagccctcaccagtcacaggtggaattaaagaaatctggcaaaaaataaattttgttatccgtgcttggggcggtgacccttgaccccattcctatttaaacatctggattctctgccataacatcttttgccacctatagctacaataaagtgtcgtcttggagtctgttgtacatttaacaataaactttttgtnaggaaagtaaaaaanantctacagttcaatgcaggatanggatgggtgggccttaattcaggaggtgggaggctcaaaatcaattactctgtttgangagatggaatctnctggaatctcaaaaanggatttncttttangaatcatcaagactcatcccgacttcgtcaagtcttttctcttgttgggagttatggttttggnttttaattttngttttggtttttttttttggggggggnaa

SEQ ID NO: 5147 - DNA, 940 bp, Homo sapiens
  misc_feature 19, 53, 59, 65, 82, 86, 91, 94, 96, 101, 126, 135, 138, 140,144, 155, 156, 159, 161, 167, 171, 178, 181, 182, 188, 194,208, 222, 225, 227, 233, 239, 247, 255, 262, 264, 267, 271,278, 281, 293, 294, 304, 313, 315, 325, 329, 342: n = A,T,C or G
  misc_feature 344, 356, 365, 368, 373, 375, 376, 384, 389, 392, 395, 402,406, 409, 410, 411, 414, 421, 426, 430, 432, 442, 455, 457,460, 468, 474, 476, 487, 494, 500, 502, 505, 507, 510, 522,526, 535, 536, 542, 553, 554, 561, 564, 566, 575, 576: n = A,T,C or G
  misc_feature 584, 585, 589, 597, 599, 600, 602, 606, 607, 611, 614, 617,621, 637, 644, 648, 652, 657, 677, 691, 704, 716, 718, 719,727, 731, 734, 735, 736, 742, 743, 755, 756, 770, 772, 774,776, 778, 779, 783, 787, 794, 795, 805, 808, 812, 822: n = A,T,C or G
  misc_feature 828, 829, 831, 834, 837, 840, 842, 844, 851, 855, 864, 869,877, 881, 893, 902, 907, 909, 912, 914, 916, 918, 923, 938: n = A,T,C or G
gtttcatacaagctaactnggttttttttaaaagccccgtttccccaatcggnatttgnggtgcnactgcggggagggagancccntaccngangnacccnaattgcgggccacgggagggcgtanacacttttnacngngtanatggccggagnnggngnttttanccanattttanttnntgggcnccccgngtgctctggtcagncctttaagtggttnaanangcacgngcctancccctaanttaaaatnccccagnanaanactnttgcgcnatnaacatcactgannggtgtttctnatagtatgntntacacctatnacantttccctcaatantnattacctgtagngcaagtggncanacttnanngcagagtnaactncanggngtttctnaatnggnnnatntcggacngtctngtananttgacaacgnaaatatatgacgncnatnggaaaatnattgtngntatgcaaggcnttgcggngtccancntantnctnatgttgaaaatncganttataactnntatgangctgcttgttnnatttganaancntttcctaanntctttganncgcnaattaaananntngttnntganatnganagcntaacacccgctacaanatctagnttgnactnaatgntgaaaactccgaacctctgngaaattcatgtttnattttgatgaacngggcctccaatntnntattcggntttntannnggacgnnacctgttgatanngcttttttcttttncntntnanngaanaatnaacctanntaactcaaangcnctanttgatctcantaaaanncngantgnaantncncattgantttnaaagcgggntttantttaaaanaacntcccttttgggnctgtgggtngttgncnacncnananggtgnaaaattttttttttncg

SEQ ID NO: 5148 - DNA, 881 bp, Homo sapiens; identical to SEQ ID NO: 5135
  misc_feature 2, 3, 4, 5, 6, 7, 8, 9, 10, 11, 12, 13, 14, 15, 16, 18, 19,20, 21, 22, 23, 24, 25, 26, 30, 31, 32, 33, 34, 37, 38,39, 40, 42, 43, 44, 45, 46, 47, 49, 50, 51, 52, 55, 56,57, 58, 59, 60, 61, 62, 66, 67, 68, 69, 70, 71, 72, 73,74: n = A,T,C or G
  misc_feature 75, 76, 79, 80, 81, 82, 85, 87, 89, 94, 96, 106, 124, 129,130, 144, 147, 157, 159, 160, 163, 164, 165, 166, 168, 172,173, 174, 177, 178, 183, 185, 187, 188, 190, 198, 202, 203,209, 220, 221, 224, 229, 231, 232, 245, 247, 248, 256: n = A,T,C or G
  misc_feature 258, 267, 276, 279, 283, 288, 297, 302, 303, 304, 310, 311,312, 314, 319, 322, 328, 331, 332, 333, 359, 360, 361, 362,365, 374, 375, 379, 397, 401, 404, 411, 413, 416, 420, 426,430, 435, 438, 448, 454, 458, 468, 476, 477, 478, 479: n = A,T,C or G
  misc_feature 490, 491, 494, 496, 505, 521, 527, 528, 536, 547, 552, 556,558, 561, 562, 563, 564, 570, 574, 576, 578, 579, 585, 592,593, 595, 602, 612, 614, 615, 621, 634, 646, 647, 650, 665,670, 675, 677, 679, 684, 685, 694, 699, 707, 709, 710: n = A,T,C or G
  misc_feature 717, 720, 724, 740, 748, 752, 753, 754, 759, 760, 765, 772,774, 778, 783, 785, 787, 792, 799, 800, 809, 821, 824, 830,832, 848, 849, 856, 863, 865, 866, 869, 880: n = A,T,C or G

SEQ ID NO: 5149 - DNA, 891 bp, Homo sapiens
  misc_feature 2, 3, 14, 18, 23, 52, 61, 62, 65, 70, 86, 89, 103, 115, 118,121, 123, 125, 126, 157, 175, 181, 188, 192, 197, 198, 208,212, 215, 219, 224, 225, 234, 262, 264, 278, 319, 338, 348,359, 364, 374, 389, 402, 406, 407, 410, 414, 426: n = A,T,C or G
  misc_feature 432, 433, 439, 443, 445, 450, 454, 456, 458, 476, 477, 478,481, 485, 494, 499, 503, 522, 524, 530, 532, 535, 536, 539,541, 547, 555, 556, 567, 573, 574, 576, 578, 584, 587, 588,593, 600, 603, 613, 625, 627, 635, 637, 646, 649, 651: n = A,T,C or G
  misc_feature 652, 653, 658, 660, 672, 673, 675, 676, 680, 692, 695, 696,701, 706, 708, 717, 718, 722, 725, 729, 745, 747, 752, 756,766, 785, 790, 806, 810, 813, 814, 816, 819, 824, 835, 849,861, 864, 868, 875, 888: n = A,T,C or G
annatccttctgangttngtctngctctttctgcaggatccctcgattcgtnagtgtctgnntgncaggnccctcaaagattcctnggncttttcccatgtgnttgaagaagaantcnatngncnntcattgaatcaaactggaaaacctgctggcntgctgctgacgactctgnggctancaaggtnctanactcnnaaaacatganggtngtnagancctcnncgagacatnccaatatctgctcctcagtggctttgcngnctcagaggcctcanagcctgctgtcatgtggacctggatatgcaggtgatgctgnggactcttcaaaaagcccnaccactctgngattacgaatntacangacagatganacacgaacatgatgnaaagcccaccatnaccnntanagcncttaaaccctgncctagnncattcnatcnanggggnttcntntngctatattggtagttgcnnngcngacnatggtaaanggacnaatnattcgggtgatgggactgnantgtgancnggnnctngnaattanggggccanncttctaggggngtcccnncncntgcctntcnntccanaaatgcntanacgctgcttntacctgggaagngnatggatgngnaaagaaacnccntnnnttggngnctttgccacacnncnngggnaaacttttgagncannaaaanacccncntataaccanntttnccntccnctaaaaacttgttacncncaacntatnggcaataggnaaaaacccctttacagggnaccgnaaaacctttggcaacnccanaanntntgncgttnggggaaaaaantacctttggcccgntttttttacagnttngacncaaaaantttaaagggaaanccc

SEQ ID NO: 5150 - DNA, 770 bp, Homo sapiens
  misc_feature 1, 4, 5, 6, 13, 17, 28, 44, 46, 49, 53, 60, 68, 69, 74, 85,86, 87, 93, 95, 96, 98, 132, 140, 145, 166, 224, 228, 310,313, 324, 335, 356, 464, 477, 551, 585, 591, 626, 629, 633,636, 641, 644, 654, 659, 668, 671, 679, 688, 694, 699: n = A,T,C or G
  misc_feature 709, 712, 717, 743, 750, 756, 767: n = A,T,C or G
ntcnnnctttaancccntatccttctcnaaacctttggaacgcncnctntctncaggaancctcgctnnagatnctcacctcttnnnggtctngnntngtctgcctacattcccacagcagacaaggttganaatccatngctgnaatcttggtattgatgagttncagtgatggaacatgtgcttggccacaggcaggtccagtcactgcaaaagtgaccaanccancaggtcacccttaacttcagaaacaattattggtggtgaactgtacttaaattgcagagaaacctgtaagtaatggaaggtnaanaaaaattacanaatggaaaatnatattttgggcaagcaaacanattcactgagaattccaaaagtatattaaaaaagaagatagctatgagttcagatctatcttattggtctttaatattacaaccaatccttaactttccactataaangaaggattactanattgattactttctgggtagataatctggtaataaatgatagggaaatcaaaaattacttttatttaggagttngaattcttactctcatcagacattttttttctangggacncttactaattaaatgaatttaaagttgttccttanggngtcnttngcccntantatatttatnactgngttaatgantantggaattntgccggaangacagnttcangaagaggaantcncgaancctgataatctatgggttagaaagcntccctgnatatcnaaaattgccanttt

SEQ ID NO: 5151 - DNA, 732 bp, Homo sapiens
  misc_feature 3, 7, 13, 19, 23, 374, 429, 549, 642, 702, 705, 706, 713,723: n = A,T,C or G
ggngggntttttnatatanacangctacttgttctttttgcaggatcccatcgattcgaattcggcacgagggccctcatctccagctaactgtggagaagcccctgggggctccctgattaatggaggcttagctttctggatggcatctagccagaggctggagacaggtgtgcccctggtggtcacaggctgtgccttggtttcctgagccacctttactctgctctatgccaggctgtgctagcaacacccaaaggtggcctgcggggagccatcacctaggactgactcggcagtgtgcagtggtgcatgcactgtctcagccaacccgctccactacccggcagggtacacattcgcacccctacttnacagaggaagaaacctggaaccagagggggcgtgcctgccaagctcacacagcangaactgagccagaaacgcagattgggctggctctgaagccaagcctcttcttacttcacccggctgggctcctcatttttacgggtaacagtgaagcttgggaaggggaacacagaccangaaagctcggtgagtgatggcaagaacgatgcctgcaggcattggaactttttccgttatcacccaggcctgattcactggcctggccggaanatcttctaaggcatggtcgggggaaaagggccaacaaactgtccttctttgagcaccaanccnnacccaancaagcagacnttttttttt

SEQ ID NO: 5152 - DNA, 719 bp, Homo sapiens
  misc_feature 2, 3, 653, 675, 677: n = A,T,C or G
gnnccagctcttgttctttttgcaggatccctcgattcgctgtattcaaacttatgagagtataaaggatctggaggttggggatatgactgacaaggaaaggctgtggccacctgatgaccctttccctttttattaaaccggacacacctgtttcccatttcgctgtagtttagtttttggtttgttgtggttggaactgctttgagaatcctgggatttgtgctgctgctgttattcaaagatcaaaggagtaaaacatagttgctcctaacttttttccagcagcagcaagtggtaataaacatgaaaactggtttgtagcagttttgaaagaatagaatgcattcaaatgtaaggctgcttctggatcattaaagccagtttcatcaaacagttcaacagagagcagcacttaataccctttatacagcccattttttcatagtttcatttgttcttgcccacaagcttgaaatccaggttaaggtatccagcctttatcatataagcattgacattatccaggcctagtcagtagcagtagggtaacgggattgaaaaagatttgatggagaggaaagtatctaatattagtcatgggtttgacctaaattgctagacagtcgtgccattcacaaagtcagaaaatncagcaggaagagacgcttttanangggcagagaattagaggatggtggtagtaatgaaaatgatgc

SEQ ID NO: 5153 - DNA, 760 bp, Homo sapiens
  misc_feature 6, 8, 9, 13, 16, 17, 27, 43, 53, 138, 324, 461, 467, 487,493, 497, 543, 581, 587, 593, 607, 617, 622, 626, 632, 641,682, 698, 706, 708, 710, 715, 718, 725, 736, 743, 744, 754,756, 757, 758, 759, 760: n = A,T,C or G
gggttnannttcnaanngctgggctangcgctttctgcaggancccatcgatncgttcggcacgaggtgacagagagcagttgaaatggttttttagttcctatggaaaagttgaagggttttggtctaaggaccagncacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggtnccctggcgttggtgacatgctgcagcctggaactctgatatccagtgtgactgcaaagctgtcttctcactggtactgccttgtgagtactggttggactgtggggcatgtggccgctgcagatccagtggttattnctaagnctatgacaggacaggctgancttgcntcanaaccttctctgacagacacgggaactaaatgtgaaaaaccaataanctggagactcatgaattcacacgaggaaaagcagaggnttattnatctgncttttcaacatttntttcctctgngaaangaanggtcanaggctttgnaaaagtggtaaaactaatcacatgggaagtgtaagggccancatccaagctaccaantcctaaangngncaaancanacctttngggaaaaaccnaattttnnaagcccgggntnnnnn

SEQ ID NO: 5154 - DNA, 809 bp, Homo sapiens
  misc_feature 3, 4, 8, 11, 12, 28, 573, 671, 679, 693, 709, 737, 770, 773,805: n = A,T,C or G
ttnnaatngtnncttccctttcctaatngcttggcgtttttttccatttaaaagtattttatttttttccagtcaaatgactagttaacaagaaagagtaaacttattaaacatgctctaattataaatcactgcattaaggacaatgaaaataatcaatttcggttatacaatatatacagttgtgctgcaaccaaagtaatcaggtgaatgaactgaatatcatacatctcaaaatagcatcctaagctgcatattatgttatccaccccttaacagatcacacagttactcttagtctgtgtacatgttctgagccatcatcccagatctgatggagaatggcatgcaaaatgccagaatcctgcagctgcagttcatgaaacataaactttaaatataaatagatatctacaatgtttttctttctcttagttgcttttttaatttgcaaggagcaaataactaagaaaggatattagcagggtcgttaatataattctcctctggtaagagtactattagttactgcacaatagcacccaaattggtagactggaaaaatattcctanggtatttatgtcccagtggaacctgaccggattaagttttggggactgggagttctaaatggttggatattgaaatcaacctttaattcccttaatantaagcctnggcaacccaaggtngggtccaaaaagggcntggacctattaaaaaattccaggattgnccagggaagggatttgggttaaaaaaattgganccnttaaggtggccaccttggtggccaaaaaattnccat

SEQ ID NO: 5155 - DNA, 865 bp, Homo sapiens
  misc_feature 6, 7, 17, 31, 35, 43, 45, 48, 63, 65, 67, 73, 74, 75, 77,86, 112, 117, 119, 123, 139, 156, 234, 235, 243, 321, 345,367, 377, 381, 391, 400, 402, 450, 455, 462, 472, 473, 485,490, 492, 495, 497, 502, 505, 512, 516, 524, 525, 533: n = A,T,C or G
  misc_feature 540, 544, 545, 546, 561, 565, 581, 582, 597, 598, 605, 617,620, 621, 623, 630, 633, 634, 636, 645, 646, 650, 655, 662,663, 669, 680, 681, 686, 689, 701, 703, 712, 714, 722, 723,725, 728, 737, 742, 749, 750, 755, 771, 775, 778, 779: n = A,T,C or G
  misc_feature 783, 790, 792, 797, 800, 801, 808, 813, 815, 820, 824, 831,833, 837, 847, 848, 849, 855, 856, 858: n = A,T,C or G
ggaaannttttcctaanacctggacaagaancagnaaaaacgngnctnggaaacttcctcttncncncagcannncnacattgggnctgggcacgaggttagagtaagtaanagatntngccnatttttgcacttaaanccaagaaagagagtcancaaatatttataccattctctcattaagtgacactggttccataaatttaaagacagcgggtcacccatatctatggnnttgcattncatgggttcagttaccacagtcagcctctgtctgaaaatattacaatggaaaattccagaaataaacaattcataagntttaagttgcatgccgatctgagnagcctgaatgaaaatcttacancatccccctncaancaggctaggncatgacatnanccccttgtccagccataatccaacactggttatggctacccaccccantaggnaacatantagccaaacnngggtattcaganccgancnggncntgggnaanccataanatgnctcggagnnccaagggnacccctnaaannntacccttaaaatagnggancccccaaaatggccanngaaatgggccaaaanngggaaanaaaccgggcccnaanncnaacaaantanngntaaacgggnncatnaaagnccccctnnaccagnggcccaaaaannactgnaantaaaaatcccantnaaaggggcnanataaattnnanggnaaaaaaacnagggngggaccnnagggncaggggcccaaaaagngggnctnnacanaaaccancngggangcnntaaaaanctatnancccgngggnaaaaggngngaanccccggaaannncaaaanntncccttgg

SEQ ID NO: 5156 - DNA, 940 bp, Homo sapiens
  misc_feature 4, 12, 19, 55, 56, 57, 58, 59, 63, 69, 87, 91, 92, 94, 97,98, 100, 102, 119, 124, 125, 127, 130, 134, 139, 141, 142,145, 147, 153, 156, 176, 178, 179, 181, 183, 186, 187, 193,195, 198, 202, 205, 209, 210, 218, 224, 231, 240, 241: n = A,T,C or G
  misc_feature 242, 246, 251, 252, 256, 259, 262, 269, 274, 278, 282, 297,298, 315, 316, 317, 322, 324, 325, 326, 330, 347, 352, 357,363, 382, 387, 391, 392, 393, 400, 413, 414, 416, 419, 426,432, 434, 436, 440, 443, 444, 453, 454, 457, 458, 464: n = A,T,C or G
  misc_feature 465, 472, 473, 476, 478, 489, 493, 494, 498, 502, 506, 510,511, 519, 522, 523, 524, 526, 528, 529, 530, 533, 534, 536,543, 544, 545, 547, 551, 553, 554, 559, 561, 562, 563, 564,571, 572, 573, 575, 581, 582, 584, 587, 588, 590, 594: n = A,T,C or G
  misc_feature 596, 597, 598, 602, 603, 604, 612, 614, 618, 620, 621, 622,628, 634, 637, 644, 646, 654, 656, 659, 663, 665, 672, 677,679, 681, 682, 683, 685, 686, 688, 689, 691, 692, 693, 694,695, 696, 697, 699, 701, 706, 708, 709, 714, 716, 718: n = A,T,C or G
  misc_feature 719, 725, 726, 728, 730, 731, 732, 735, 737, 739, 741, 742,743, 744, 746, 748, 749, 751, 755, 757, 759, 760, 761, 763,764, 765, 769, 770, 773, 778, 780, 781, 782, 784, 786, 787,788, 790, 791, 793, 795, 796, 797, 799, 804, 806, 807: n = A,T,C or G
  misc_feature 812, 813, 817, 818, 820, 821, 822, 828, 832, 833, 834, 835,836, 837, 838, 842, 843, 844, 851, 852, 853, 855, 858, 860,862, 865, 868, 870, 871, 872, 874, 880, 881, 883, 884, 886,887, 888, 889, 892, 893, 894, 895, 897, 902, 903, 907: n = A,T,C or G
ttcnctttcccncctcctnggaaacccttcctttcctaatgttcctaattcctcnnnnnctcnctctcnctctttctctgccggtcngggnncngtnncntnttgcctttttctcccgnttttnncnctngccnctacntnnccngntgaggnagnccacctgcggagaccgctgntnncncncannccgctngntgnttcntgnccgnntggctcanctccancgcctgntcccccctnnngtgncgccnngggntcngtngatcccncgatngccnttanggcttatacgaatgnncatgccttccgcacccnnncattnannnccgngcctctgctccctcctnacctnctgcngactgnctgcacctccctgcctctntgccncccnnntcgcccnggctcccaccccnngntgnttgccgntgcttncncntgtntcnnggaacggcnntgnncccttnncccccgnntcncngctcctggccncctnncccnttgnctgnttcnncccccctnctnnntngnnnctnncncccctcnnncntccncnncctcncnnnntcccccnnncnctcccnncnctnncnctcncnnntccnnncccccccncncccncnnncccttncctccnctnctctccncncccctccncnctncccntncctcccnctctncncnnncnncnncnnnnnnncncnccccncnnctccncncnncctccnncncnnnccntncntnnnncncnntncttncncnnntnnntccnnccnccccncnnntncnnncnncntnnncncctcncnnctctnntccnncnnnctctcntccnnnnnnnctcnnnccctctnnncntcncncntcnccncnnncncccctnncnncnnnntcnnnncnccccnncccncncnnntncnncctcncncncnnnnttnntncc

SEQ ID NO: 5157 - DNA, 1051 bp, Homo sapiens
  misc_feature 3, 4, 5, 8, 11, 12, 16, 17, 18, 19, 22, 28, 30, 31, 35, 37,38, 39, 42, 45, 46, 48, 52, 55, 58, 61, 64, 70, 73, 76,77, 78, 91, 92, 108, 268, 301, 313, 343, 344, 347, 354,398, 400, 404, 422, 425, 430, 431, 441, 445, 447, 455, 459: n = A,T,C or G
  misc_feature 463, 469, 470, 472, 478, 479, 493, 494, 496, 497, 498, 500,502, 503, 505, 506, 509, 511, 513, 514, 517, 519, 520, 522,523, 526, 527, 530, 531, 535, 538, 539, 542, 545, 547, 549,550, 551, 552, 554, 557, 561, 566, 568, 573, 574, 575: n = A,T,C or G
  misc_feature 577, 578, 579, 581, 583, 592, 594, 595, 596, 599, 602, 603,604, 605, 606, 614, 615, 619, 620, 621, 623, 626, 627, 628,629, 632, 633, 635, 637, 639, 642, 643, 644, 645, 646, 649,653, 656, 657, 658, 660, 662, 671, 677, 678, 680, 683: n = A,T,C or G
  misc_feature 684, 688, 691, 692, 693, 699, 702, 703, 706, 708, 711, 712,721, 723, 725, 728, 730, 733, 740, 744, 748, 749, 752, 754,762, 763, 766, 772, 778, 779, 781, 796, 804, 808, 809, 811,814, 816, 820, 822, 823, 825, 827, 837, 838, 842, 845: n = A,T,C or G
  misc_feature 853, 855, 856, 865, 871, 876, 877, 880, 884, 887, 889, 890,891, 892, 893, 897, 900, 902, 911, 914, 916, 922, 927, 930,931, 932, 935, 936, 941, 945, 956, 960, 961, 970, 971, 972,973, 982, 983, 984, 990, 992, 994, 1003, 1010, 1012: n = A,T,C or G
  misc_feature 1015, 1018, 1022, 1023, 1032, 1037, 1042, 1047: n = A,T,C or G
cannnccnccnnaacnnnnatntcatcnanncacnannnaanccnncntacnaanatnctncgnacaacnagngannncttcccccccttnnaacccgcccttatgcngaacccacgattcgaattcggcacgagcccatcgtgcgctgccccacggttcggtaccacacgaaggtgcgcgccggccgcggcttcagcctggaggagctcagggtggccggcattcacaagaaggtggcccggaccatcggcatttctgcggatcccnaggaggcggaacaagtccacggagtccctgcangccaacgtgcancggctgaaggagtaccgctccaaaactcannctnatccccnaggaaagccatcggaccccaagaaggggagacagttctcgctgnanaacnggaaacttggacaccaanctnacccnnaccggcaatncccncnccggaaantctnaaancgaaannancaacgnncatacacaaacacnnannnancnngnncanancnnccncnncnnatnnttnnaacntcnncantcntncnnnntnccnctcnacccnanactannntnnnantnctatcacanannnagnccnnnnntcaacaannaccnnnancannnnaanncncnantcnnnnntancatncannntncnctcaacatnacatannantanntccnaannnctaatntanngcncnacnnccatctacncntnttntnaantgcctanaaancacnnccncncaactaanntcnacatanacgcannanatatatcgaacaaancataacgncacnnanaananattncnngngnaactacctannatantanaaacaccnannaccaaccanactcgnccacnngcnctcnctncnnnnngcgntcncncacacgtcngcnanccactntcttnccnnnccnncgctnatcncccgctccatnatannaccacaacnnnntcataacannntcgccnanancgacacctnatctcgncncgnganagannactctaagncacanatatntgttnaccc

SEQ ID NO: 5158 - DNA, 755 bp, Homo sapiens; identical to SEQ ID NO: 544
  misc_feature 9, 11, 13, 14, 22, 23, 340, 460, 465, 600, 608, 623, 665,676, 733, 741, 743, 750, 753, 754, 755: n = A,T,C or G

SEQ ID NO: 5159 - DNA, 811 bp, Homo sapiens; identical to SEQ ID NO: 3884
  misc_feature 2, 3, 4, 9, 11, 12, 13, 25, 41, 44, 69, 88, 99, 102, 171,210, 239, 268, 292, 307, 332, 339, 348, 391, 403, 439, 440,448, 451, 454, 455, 475, 481, 487, 496, 508, 514, 548, 565,567, 575, 593, 599, 648, 671, 672, 706, 712, 713, 717: n = A,T,C or G
  misc_feature 736, 738, 748, 753, 757, 763, 765, 771, 772, 797, 801: n = A,T,C or G

SEQ ID NO: 5160 - DNA, 942 bp, Homo sapiens
  misc_feature 2, 8, 9, 10, 23, 65, 73, 75, 80, 82, 90, 92, 93, 94, 97,110, 115, 116, 120, 121, 123, 126, 132, 142, 145, 146, 147,178, 230, 231, 234, 239, 249, 255, 258, 261, 264, 265, 267,268, 274, 275, 310, 314, 324, 329, 331, 333, 351, 354: n = A,T,C or G
  misc_feature 368, 382, 384, 393, 402, 427, 443, 452, 460, 474, 482, 503,504, 517, 526, 533, 537, 542, 548, 553, 561, 566, 568, 579,582, 585, 595, 614, 626, 657, 658, 661, 664, 676, 690, 697,712, 716, 722, 732, 759, 761, 772, 775, 779, 783, 788: n = A,T,C or G
  misc_feature 792, 798, 799, 805, 812, 814, 828, 838, 839, 844, 847, 848,850, 851, 857, 858, 860, 862, 866, 868, 869, 873, 878, 884,885, 888, 889, 891, 894, 896, 897, 898, 901, 904, 905, 913,918, 921, 930, 934, 936, 938, 940: n = A,T,C or G
gnagcgtnnncctttggaacccnttgctacttgctctttttgcagggatcccatcgattcgaatncggcgcgngnctggncntaggcgtngnnnatnccaaggccatatnacatnngatnntncanaagagncatataatcnagnnngtaaattcacattgtgctgctcacatggatngaacatacaaattgatggttataaacctggatgctcaccatgactccaaagnnctnggtgntaaccatggntatagnggnagntcnnannggactnnatatggataccgaggctctccagaacaagctccangaantgatcactgngctancngnggctatgacagctgtaangcncgaacaggaatacntggaagtccgggtnanaatacactnagccatcancgactgcacatacagcatagtggtncttgtggtccttcttngaatctctngttctagncaccatgacattgngacagatntactacttgaagagatttttnnaagtccccagagntgcttaganaaagtcnactnctgangatccnacctnaagaattnaatgntnaccaaacaccntgntcntaataatggnccatagttttctcgcatgntttatggttctnggacttgtaccatttcacatcgtaatggtgnncanttngagaattaatcncattaattgggggngggaaanaacggccttttttanggcnaaattnaattaggccnaaaaatttttcccagtttaatttgggncnttaaacccttngtntttnaaancttgncctnccattnntgttanagttccntntcaaaatactttanaccctctttnntcaanttnnannattttnngnanttancnncatnccaancaattnnttnncnttncnnnttnacnnttttcccntgganttntcctgcacntcancntncnct

SEQ ID NO: 5161 - DNA, 891 bp, Homo sapiens; identical to SEQ ID NO: 5149
  misc_feature 2, 3, 14, 18, 23, 52, 61, 62, 65, 70, 86, 89, 103, 115, 118,121, 123, 125, 126, 157, 175, 181, 188, 192, 197, 198, 208,212, 215, 219, 224, 225, 234, 262, 264, 278, 319, 338, 348,359, 364, 374, 389, 402, 406, 407, 410, 414, 426: n = A,T,C or G
  misc_feature 432, 433, 439, 443, 445, 450, 454, 456, 458, 476, 477, 478,481, 485, 494, 499, 503, 522, 524, 530, 532, 535, 536, 539,541, 547, 555, 556, 567, 573, 574, 576, 578, 584, 587, 588,593, 600, 603, 613, 625, 627, 635, 637, 646, 649, 651: n = A,T,C or G
  misc_feature 652, 653, 658, 660, 672, 673, 675, 676, 680, 692, 695, 696,701, 706, 708, 717, 718, 722, 725, 729, 745, 747, 752, 756,766, 785, 790, 806, 810, 813, 814, 816, 819, 824, 835, 849,861, 864, 868, 875, 888: n = A,T,C or G

SEQ ID NO: 5162 - DNA, 770 bp, Homo sapiens; identical to SEQ ID NO: 5150
  misc_feature 1, 4, 5, 6, 13, 17, 28, 44, 46, 49, 53, 60, 68, 69, 74, 85,86, 87, 93, 95, 96, 98, 132, 140, 145, 166, 224, 228, 310,313, 324, 335, 356, 464, 477, 551, 585, 591, 626, 629, 633,636, 641, 644, 654, 659, 668, 671, 679, 688, 694, 699: n = A,T,C or G
  misc_feature 709, 712, 717, 743, 750, 756, 767: n = A,T,C or G

SEQ ID NO: 5163 - DNA, 765 bp, Homo sapiens
  misc_feature 10, 13, 34, 41, 43, 45, 46, 49, 54, 56, 57, 61, 69, 70, 90,562, 632, 673, 685, 733, 759: n = A,T,C or G
tgttttaatnctngtcaaatccttggctactcgntcttttngnanncgnattcngnncggntcccatcnnttcgctggggtgggcagttntttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctnctcactgtatccaggttcccttccagaggagccaccagttctcatgggtggcactcagtctctttctctncagctggacttaaactttttttctggaccagttaatttttncaactactaatngaataaaggcagtttctaaaaaaaaaaaaaaaaaactcgaacctttanactatatgagtcgtttacgtagatcngactga

SEQ ID NO: 5164 - DNA, 744 bp, Homo sapiens
  misc_feature 3, 6, 7, 15, 17, 89, 96, 128, 130, 254, 300, 346, 357, 367,411, 427, 445, 449, 512, 539, 548, 566, 580, 604, 631, 718: n = A,T,C or G
gtnccnntttgaatncncatacaagctacttgttctttttgcaggatcccatcgattcgaattcggcacgagcttatctgtacgagatncattccnagacccctagtggatgcctgaaacctcagatngnactgaaccctttatgaactatgttttttcagtctgacaaccaaggcggctactaagtgactaaggggcaggtagtatacagtgtggataagcaggacaaaggggtgattcacatcccagcctgngcaacagagcaagactctgtctcaaaaaaaaaaaaaaaagtctcantaacctatgggataatatactaacaaacagctgtgtaactggaatnccataaagcantggtggacanagcagaaaaatatttgaagaaataaagactaaaattatgtccantttgatgaaaattatnctctgacagatctaagantttnagcaaaccctaatcaagatagtctctctctccctctcacatgcacgcacacgcaccgaagttnagccataatcaaactactaaaaaccantaataaaangaataatcttaaaatgtngccagagaaaaaangacacgttacaaacagaagaacangggttagaaaactgaaactttccttanaaactacatacgcagaagacaacaaatttgcttaaattgtgaaaaatcccctcacactagagagaggctttggtggtagcatggctnagtaggtgcacaagacgtgccctcct

SEQ ID NO: 5165 - DNA, 772 bp, Homo sapiens; identical to SEQ ID NO: 497
  misc_feature 2, 6, 7, 10, 14, 18, 32, 34, 39, 87, 110, 465, 688, 706,720, 771: n = A,T,C or G

SEQ ID NO: 5166 - DNA, 749 bp, Homo sapiens
  misc_feature 2, 3, 8, 12, 14, 15, 25, 29, 36, 92, 201, 220, 271, 283,293, 308, 309, 327, 346, 356, 369, 389, 402, 406, 429, 441,449, 460, 467, 471, 480, 491, 502, 506, 518, 545, 558, 573,583, 585, 591, 602, 608, 612, 614, 627, 635, 669, 682: n = A,T,C or G
  misc_feature 707, 711, 720, 738, 748: n = A,T,C or G
tnnctttnactntnntaatcctttntgangcccttntgcaggatcccatcgattcgcgtctgtaatcccagctgcttgggaggctgaggcangagaatcacttgaaccctggaggtggcggttgcagtgagcacagatcatgccactgcactccagcctgggcaacaaaacgagacttcgtctcaaaaaaaaaaaacatanaatttggatcctttggtcnggttctcccaaattcttttgaggtgtccatggtcaactgcttcagctttgntttggcaacccnctgcccgaantcccatataggctgnncttcaccttgtttccaangctgaggaacagaaagtancctctgtttngaggaggtggaanttaagtatacatttatcctntactgcgacttgntcangaccacattttacaaaatgcctngtttccttcatngcttctgnaaaggaaagtnctattantatngtgttactnagaatatagantactttttttnattntggcttattttnaaaaattctgagtttaattcaaatgtntgccaataccttncaaagtaaggtaatntcatagacantngttgtnatcacatggcnttacanaaantnctggatattcacnttctaaanattccctattaaatgaatgtctttgacttaaatntaccaaaactgcncatattctcgtacatttcgtaaatngtgnacaagctanttgcaaacaataaatacntaactaaaana

SEQ ID NO: 5167 - DNA, 773 bp, Homo sapiens
  misc_feature 1, 4, 5, 13, 17, 19, 20, 23, 34, 38, 105, 141, 383, 671,702, 746, 752, 754, 764: n = A,T,C or G
nttnngtttttantttntnnaancctttgttacntgcnctttctgcaggatcccatcgattcgccagcccctcctctccccgccttctgggaggaggaggtcacncgctgatgggcactggagaggccagaagagactcanaggagcgggctgccttccgcctggggctccctgtgacctctcagtcccctggcccggccagccaccgtccccagcacccaagcatgcaattgcctgtcccccccggccagcctcccccacttgatgtttgtgttttgtttggggggatatttttcataattatttaaaagacaggccgggcgcggtggctcacgtctgtaatcccagcactttgggaggctgaggcgggcggatcacctgangttgggagttcaagaccagcctggccaacatggggaaaccccgtctctactaaaaatacaaaaaattagcccgggtgtggtggcgcgtgcctataatcccagctactcgggaggctgaggcaggagaatcgcttgaacccgggaggtgggggttgcggtgagccaagatcgcaccattgcacttcagcctgggcaacaagagcgaaactctgtctcaaaataaattaaaaaataaaagacagaagcaaggggtgcctaaaatctagacttggggtccacaccgggcancggggttgcaacccaacaacctggtaggctncatttctttccaagcccgaacagaaggtcatgccggccccacangaaaancnggcagggccncggggggct

SEQ ID NO: 5168 - DNA, 916 bp, Homo sapiens
  misc_feature 1, 6, 7, 8, 10, 13, 16, 19, 21, 24, 25, 28, 30, 45, 46, 48,49, 50, 57, 63, 67, 74, 75, 79, 83, 85, 90, 96, 99, 100,101, 110, 112, 117, 118, 121, 127, 148, 149, 158, 170, 187,199, 201, 202, 205, 215, 220, 228, 241, 243, 248, 258: n = A,T,C or G
  misc_feature 270, 274, 277, 278, 279, 281, 283, 284, 304, 312, 323, 324,328, 331, 332, 333, 343, 346, 356, 363, 366, 367, 382, 391,402, 407, 414, 415, 418, 420, 429, 430, 434, 440, 449, 455,457, 458, 479, 481, 482, 485, 488, 505, 506, 513, 517: n = A,T,C or G
  misc_feature 521, 522, 523, 539, 552, 554, 557, 558, 559, 562, 565, 566,574, 576, 587, 593, 598, 599, 600, 614, 615, 616, 629, 631,642, 646, 673, 676, 685, 686, 695, 706, 709, 710, 713, 719,732, 740, 743, 748, 761, 763, 764, 766, 773, 775, 788: n = A,T,C or G
  misc_feature 804, 806, 813, 816, 820, 828, 834, 835, 837, 855, 856, 859,870, 873, 880, 889, 890, 900, 902, 905, 914, 915, 916: n = A,T,C or G
nttccnnngnaanttncgngnatnntgncngaacccctttcgatnncnnngattcgnagtacngacnaggagannctgncggncntgtgntggaanctnnntttggaccncnctttnnccngtgccntgtgaactcagagcacgggcnntttggaccnactcaaggccantcatggcatggctcatncctgaggcacgnannganactacattcncaggngcccttcnaaacaatggaccncnatgcnggcatactgngcctgcgacccnaaanacnnnangnntgtactgaatatcaagatcnacttagantctaagagagnntggnctnnnaactgatcancanggccttccanggggcancanngagacactgcgagtnacagagacngccatgggcgntgctnccttacnnagngncacaggccnnaccntcatgnaaccctaangctgtncnnatgtactccgaatggcctttnanncgnacnggcctctaagtgatgcnncccggtntcanatgnnnccgtacaatatctcangggacatggggantnatnnncanccnnaacctttnanaaaaggcggcnttaccnttacnnnaaaaggatggcttnnngctaatcaaaaancntgtaaaccctnggcnattataaacccaagacccgggacaaanctnggggtaccnngtccaattnaaactggcctnccnntcntggtcncccaaccaaagtnaaacctanttngcagngggttataccggnanncnaattggntncaaccccaacttngggaaaataatttttncnaaatgcntcnatcnaaccctgncttttnnanaaaaacccaggctttttnnctnggggaaccttnaancgggganttggccttnncaaaaccacntnccnctttaggtnnn

SEQ ID NO: 5169 - DNA, 757 bp, Homo sapiens
  misc_feature 2, 5, 6, 9, 95, 632, 684, 726: n = A,T,C or G
cnttnnttnatgacccttgttacttgctctttttgcaggatcccatcgattcgaattcggcacgagggaaccatgagaaccgaagctagaattgntattgaattactttattttctcttcccttattgggtagagatacatcattactggcctcaggggtttacccaaagaaagggtatttttgagcaaataatgtgatttcctggctattttgttgggggcttaagatttttttttttcaaatgcatttttagtcactaaaaattaactgtcgtaccatctagaactatactgtccagtaccatagcctctagccgtatgtagctatttgtattaagattaattgaaattttaaatccagttcctcagtcacactagccactttctaagtgctcagtagctctgtgtgaccagcggctactgtattggatattatagaaggttctttcattcaagatcatcattcttgacagacccataaatatttcctataaagactgtagaagtgtgttctggagggtttgctctccaaaaagaattgtaatatagagtagaattgggatagagtattgaagacactgggtttagacattggatattttaatgattgtgtgtctaattcatggtgctgncaactgagttatctagtgatatgacctcactgtcttgaccaaagccagaatngaaggcaggattcctgaatctatcttaaaattgcaatggaanagccttttccctaaattatccatttgtaatt

SEQ ID NO: 5170 - DNA, 758 bp, Homo sapiens
  misc_feature 1, 3, 4, 5, 10, 22, 455, 541, 569, 616, 682, 683, 689, 695,737, 758: n = A,T,C or G
ntnnnttctnaatccttgttcncgcctttctgcaggatcccatcgattcggagaggagcaggtgcagtgattcatacccactctaaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagcttccagttggagaaaatggaattgnctaagccaaaagaaagtctaattatatacagagataaagctaaacgtaattattatttaaatgaaagctatttttttaaatgaatngaaatttttcatgatgctactaatttgncactaaatctgcaaatggtcaccctgaatttcttctgacattggtgntatttgcttatattccttataattttaaatgaaggcacagtgaaatgaaaattttatactctatgnntctggnaatttntaaatccttaacagccaaattttttgcctttaattcttttanatatatactctcgagaaatcn

SEQ ID NO: 5171 - DNA, 757 bp, Homo sapiens
  misc_feature 1, 5, 7, 10, 11, 15, 21, 668, 700, 742: n = A,T,C or G
ngtanantannaacntggttntcgctctttctgcaggatccctcgattcgaattcggcacgagccaaggagttttccacccgtctctcatggtcacagcgctagtcattcatttttgagaagttgcttcttttacatcagaaaaccagtcaatcatatggagacttcttttgtgatgaaaaagggctttagaagttaaatacatgcatgcacatgaaaacatgcacaaccacagcctcaatcttgtatttagtttggggaaagagaagagaatttcctgtggattattttttcctcaagtgcacctctctggttaacccaaactctgcaagaaagcactgtgactaaaacatacataacgcctgcataaatattccatggtttcagttaaatttcagtttttagcctttacacatgaggtcaaaggagtgacgaaaatacaaagcaaggaaaaaatgaaatatctggtttttgctgaatgcttaatttattttttactgtgccactccaatatttatcaaatccaaatagcatgaatgcttctctgtagtaatactaattttgtgccttttgtctgctttcttaagaccagttgttcacactttgtagatattaacaaatatatttccgattggaatacaaaaaaaaaaaaaaaaaaactcgagcctntagactatagtgagtcgtattaccgtgatccngaccatgataagatccattgatgagtttggacaaccacactngatgcaggaaaaaat

SEQ ID NO: 5172 - DNA, 757 bp, Homo sapiens; identical to SEQ ID NO: 5171
  misc_feature 1, 5, 7, 10, 11, 15, 21, 668, 700, 742: n = A,T,C or G

SEQ ID NO: 5173 - DNA, 746 bp, Homo sapiens
  misc_feature 3, 20, 594, 605, 640, 652, 689, 743: n = A,T,C or G
ttntttacctttgctcttgntcttttgcaggatccctcgattcgaattcggcacgagagaagctcagctcttcttggtcttggctagactgcctagattcccacagcagacaaggttgagaatccattgctggaatcttggtattgatgagttacagtgatggaacatgtgcttggccacaggcaggtccagtcactgcaaaagtgaccaagccagcaggtcacccttaacttcagaaacaattattggtggtgaactgtacttaaattgcagagaaacctgtaagtaatggaaggtaaagaaaaattacagaatggaaaataatattttgggcaagcaaacaaattcactgagaattccaaaagtatattaaaaaagaagatagctatgagttcagatctatcttattggtctttaatattacaaccaatccttaactttccactataaaggaaggattactagattgattactttctgggtagataatctggtaataaatgataggtaaatcaaaaattacttttatttaggagtttgaattcttactctcatcagacattttttttctagggacgcttactaattaaatgnatttaagttgnttctaagggttttttgcctatatatttatgactgngttaatgagtantgaaatgatgcggaaggcagcttcaggaagaggaatncagaacctgaataatctatgggttagaaaagcttcctgaatatcaaaattggcngtt

SEQ ID NO: 5174 - DNA, 967 bp, Homo sapiens
  misc_feature 1, 2, 3, 4, 5, 6, 9, 10, 12, 13, 14, 15, 16, 17, 18, 19,21, 23, 24, 25, 26, 28, 29, 34, 35, 36, 38, 39, 40, 42,45, 46, 49, 51, 52, 72, 73, 80, 82, 85, 86, 87, 88, 96,101, 109, 110, 112, 113, 115, 116, 120, 125, 139, 142, 145,147: n = A,T,C or G
  misc_feature 160, 162, 164, 167, 170, 173, 181, 190, 195, 199, 205, 212,217, 228, 231, 237, 250, 251, 256, 270, 281, 284, 294, 298,301, 303, 304, 314, 318, 337, 342, 343, 350, 354, 357, 358,367, 369, 383, 389, 391, 401, 427, 437, 444, 449, 452: n = A,T,C or G
  misc_feature 466, 467, 469, 474, 484, 486, 492, 494, 497, 500, 506, 508,510, 520, 529, 533, 539, 540, 546, 547, 554, 555, 558, 560,568, 569, 575, 579, 590, 594, 596, 600, 603, 607, 608, 609,611, 619, 620, 636, 637, 639, 640, 642, 655, 664, 682: n = A,T,C or G
  misc_feature 684, 686, 691, 692, 699, 701, 710, 711, 712, 722, 724, 725,731, 737, 739, 745, 762, 766, 773, 774, 777, 778, 785, 786,787, 794, 799, 809, 812, 829, 830, 833, 837, 839, 856, 861,873, 874, 884, 885, 887, 891, 895, 903, 906, 907, 911: n = A,T,C or G
  misc_feature 916, 923, 935, 950, 951, 952, 955, 957: n = A,T,C or G
nnnnnncannannnnnnnnangnnnncnnaccannncnnncnacnnagngnncccgctccaaagccggcaanncgccgcncngcnnnntcaaaccntgcangcggcacnngnngnncccnacgangcgccagcgcgcgnganacngngctgccaagaaangngngcncanagnccggcctngagaacagnacagnggancgtcanaagcagngggangacagacgacngangaaacntagagcccagggnnagcgngacgacggaccagntcccaaaggcnggngcccaaagcngacnagntnnaggaagaaanacgngggacacaaccggagacanccgannaggagcngacnganntggacccananggcaagaagcaccnaaacangncacccaccanacgaccggggaaggcacgaacggtcngagcacgagnaaaacgngaacnaancaacgcgcacacanngngaganagaaacaccncnaacaancnaancgngggaanangnagaccggacncagaagaanggcncaaganncggcanngaacccnnaancngacggaanncagggncggngccaacaaganggcnangacnggncaannnanggccggcnnggaaaaacgaccaagnngnncnccaaaaaagacanggcaaaagnaaacgggcaaagggcaancncnaaggnnaagcccnanaacgcgcannnggagcaaaangnnccaagngaggancnaaaganggggaaaggggcccacnaagngggcggnnaannggcgaannnaaaacanagggngggggccacnggnaaacccaagcgcgaaannccnggcncnaagggccccgaaaacanggggngacaaaaacccnngccaaaaccnnangggngggncccatcgngannacanaaggngaaccgnccaagggggcanaaaggaaaggccatnnnaangnaaaagagccg

SEQ ID NO: 5175 - DNA, 824 bp, Homo sapiens
  misc_feature 6, 10, 16, 29, 68, 71, 80, 81, 82, 88, 92, 96, 108, 116,133, 136, 138, 146, 175, 183, 191, 202, 210, 214, 219, 230,239, 240, 249, 259, 262, 278, 279, 284, 286, 291, 293, 300,303, 307, 314, 327, 332, 336, 349, 350, 362, 366, 370: n = A,T,C or G
  misc_feature 372, 376, 378, 383, 385, 386, 388, 392, 399, 402, 406, 417,433, 440, 449, 453, 458, 460, 465, 476, 495, 505, 506, 507,511, 514, 516, 517, 521, 522, 530, 540, 552, 574, 576, 577,583, 593, 594, 598, 605, 607, 614, 620, 639, 640, 641: n = A,T,C or G
  misc_feature 642, 679, 684, 686, 689, 691, 704, 712, 718, 724, 738, 743,747, 748, 752, 754, 758, 760, 770, 773, 788, 791, 801, 803,809, 821: n = A,T,C or G
gttagngtgnggtatnaacagctcttgtngtttttgcggatccctcgattcgaattcggcacgaggcnacnggtgaagcnnntgttgngtgngctnctcatgaagaanctgtggcnggtatgttcaaagacanggncnatatgcantacagatatatagaactcttcttgaattnaccaacangggccggntaatggggcgnatgtcagncaantgatncaactgcatgngggtgtctnntgcccaggncacttacagnggnctggaaagccagtcanngcaangngtggncncagcgcnggnttcngtgggtnaaccaggcatggnctggntatnacgtaatcttagnnaggaacaatttnagtnactntnttcntnattcncnngngagncctcttncangttngtgagcatttntcaataagaaagaagnctggggnacccatttngcancattnanttcanggaaaaatctngatttaaaaaagttacctntgaactgttnnntaangcncnntttnnttgtagcntgtgataatngatgcgaacttntactatttatcagcatgttctnannataacnttttgggtannatcngtttagnantgattcnttcatnagcctaagaaaacttaagnnnnggcaaaatgccggatcattgtcacaggcacgttcacnaattnanccncnctcggtgacaacntttcttgntttttnggaaanaaattccacagggnctagnctanncatngnttcntnggaaatttanctntaatggtttcggtanaantcccgtttgngnggtttnaattaaaaaaanccg

SEQ ID NO: 5176 - DNA, 830 bp, Homo sapiens
  misc_feature 5, 7, 25, 26, 37, 40, 53, 57, 69, 96, 97, 103, 110, 112,119, 120, 143, 166, 180, 250, 255, 271, 281, 380, 381, 384,392, 399, 423, 424, 452, 485, 495, 504, 525, 535, 537, 538,539, 543, 544, 559, 561, 563, 565, 572, 583, 585, 587: n = A,T,C or G
  misc_feature 592, 601, 602, 611, 619, 626, 631, 637, 638, 648, 651, 653,654, 656, 663, 667, 674, 678, 681, 683, 688, 689, 694, 699,700, 705, 709, 722, 724, 728, 732, 734, 736, 742, 751, 761,762, 763, 771, 772, 775, 782, 791, 801, 805, 812, 820: n = A,T,C or G
  misc_feature 829, 830: n = A,T,C or G
gcttnanccctttccatttccaatnntttggctctcnctnaaaccctttggancccntcgattcgaatncggcacgagggctaacttgccttgttnnactatngatgttngngtcctgnnttcttaacactttaagcagctgntctcacctaaaggctaatagttntaagtaagtatctntttctttttataatttaaaaattaaaaaatttttaattaactgtttttaaattaaaaaaaattattaatnatttntaatagacaggatctngctatgctgnccaggctggtcttgaactcctggtctcaagtgatcctcctgccttggcctcccaaagtgctggtattacaggtgtgagtcactgcacctggccaagttnnatncttcaggntacattncttcagccacttcaatcaaacatnnaattaacatgctataatgaatgactatncttaactaggctaaccaaatgaaggcctttggnaacttacctntagttacanccttcacttctttttttttgngaagggaaantnnngggnncggacaatactcctngnantnaactatngtaaccctttncntngactngaattaacnngggaaattnggggaaantaattgnagaantgaacnngcttgaatcnaanannantcaatanaccntaatagncaantcntnttaannccccnaatcnnttagncctntccaatttggccnanaagntaanancncccccnggccttttngccccaatcnnnaaattcgnnatnaaaaatnaaacccctngcctttaaangggnacctttnacacgaangggggaaann

SEQ ID NO: 5177 - DNA, 772 bp, Homo sapiens
  misc_feature 2, 3, 4, 5, 6, 7, 11, 12, 13, 14, 15, 16, 17, 23, 25, 26,27, 29, 30, 31, 32, 33, 46, 54, 56, 733, 735, 765, 772: n = A,T,C or G
gnnnnnntttnnnnnnntttccnannngnnnnnttcaaattttccnaatcgctngnctttttgcaggatcccatcgattcgcaccgctatcagaaaaatatcctgttcatggtttatactgaatttgcaaactactgatatgatttttcaataaccacttgtatcttccatcatccatgagaggtgggaagaggtacactgtatctctgcaataaaactttggccaggttctacctcctctgagcaaaggatacttttctatgtaggtgtagatggttctcctttactaatctgacatggtgcatctggagacaacatctgatgggatccaaagacaacttgaaacaaaggtggatgtcagctcttggtgtgttttcatttggttctcttttttaaatctcccttttgttatcgctcctgttgtagcgtgtccatcagtgtgtgaagggtgcgccctgttccaatgatactgcattgctgcatccagcctttcgtgggagcacggtaccaagcgtccggaattgattatcccaatcatttttgatatgtaactgaaaaatttggtctcatgcaataaaaatgtactggctgcattttagcaaggtttatttactcttgcaagtaaaaacgatcaaccgtgaagcgtaacaaattctgtatttagttttttttctgttgtggtggtttttgttttggtttttggtttgtaagattctaaataaattaaatcgantnaaaaaaaaaaaaaaaaactcgagcctttanaactatn

SEQ ID NO: 5178 - DNA, 729 bp, Homo sapiens
  misc_feature 2, 4, 5, 13, 16, 484, 530, 605, 613, 645, 671, 714: n = A,T,C or G
gngnntttgaaanccntggctacttgttctttttgcaggatcccatcgattcgaattcggcacgagacttaaacatgtcacctaaatgcacttgatggtgttgaaatgtccaccttcttaaatttttaagatgaacttagttctaaagaagataacaggccaatcctgaaggtactccctgtttgctgcagaatgtcagatattttggatgttgcataagagtcctatttgccccagttaattcaacttttgtctgcctgttttgtggactggctggctctgttagaactctgtccaaaaagtgcatggaatataacttgtaaagcttcccacaattgacaatatatatgcatgtgtttaaaccaaatccagaaagcttaaacaatagagctgcataatagtatttattaaagaatcacaactgtaaacatgagaataacttaaggattctagtttagttttttgtaattgcaaattatatttntgctgctgatatattagaataatttttaaatgtcatcttgaaatanaaatatgtattttaagcactcacgcaaaggtaaatgcacacgttttaaatgtgtgtgttgctaatctttccatangaattgtnaacattgactgacaaattacctataatggatntggttaatgacttatgagcaactggnttggccagacagtatacccaaacttttatataatatcagaagntatcaccttgtgaaa

SEQ ID NO: 5179 - DNA, 750 bp, Homo sapiens
  misc_feature 15, 29, 33, 57, 58, 65, 69, 133, 220, 226, 239, 260, 262,265, 272, 277, 279, 286, 288, 334, 590, 592, 614, 622, 701,703, 712, 715, 718, 722, 725, 729, 730, 732, 739, 742, 743,744, 745: n = A,T,C or G
tcggcctttcaaatnccttttctatttcnaatncttggctactttcactttccgcanngatcccntcgntaaaggcagcccccaagtcccagaaagctgactcccctagcatcgactacgcagagctgctgcngcactttgagaaggtccagacaagcacctggaagtgcggcaccagcggagcgggcgtggggaccacctggaccggagggttgtcctntgacangcctggcacggangagggcccaccgagtggaccntnaancactacnggtcntnaaacacntncgatgaggccatatctactaacttaggcccatggtcagatatgatnatctgcaaacccatcttgaccttgagtatgtgaaggggtactgtactttattcctgatacattttggtttccatgtaggtgttgagctcctggttttctgtgtttggatgatgaagatttggacccttccattcataatccctttctaagtgaaacggagaggctggcttggctgttccttgttattccgaaagccctggtttggggcccatgttcacactggctctcagtctagtcaggtgcaatgttcttgaanangtggggacctaattattaccanagtagcancaagagaggaaacgttgtgaattaaagtattcaattaaaaaggaaacatgatttctacctgaaaaaaaaaatggctgcnancggataatngtntgncccntgntttnnanccggagnccnnnnaccat

SEQ ID NO: 5180 - DNA, 991 bp, Homo sapiens
  misc_feature 5, 14, 18, 26, 33, 37, 40, 41, 47, 53, 56, 60, 70, 76, 78,91, 96, 97, 124, 125, 130, 132, 136, 148, 155, 159, 163,164, 167, 170, 174, 176, 180, 181, 199, 201, 204, 211, 213,215, 216, 218, 220, 225, 229, 230, 231, 233, 234, 241: n = A,T,C or G
  misc_feature 245, 250, 251, 252, 254, 255, 257, 259, 264, 267, 269, 272,273, 276, 285, 286, 287, 289, 296, 300, 301, 306, 308, 312,316, 318, 321, 326, 329, 331, 333, 336, 338, 339, 345, 347,351, 354, 357, 362, 366, 369, 370, 378, 381, 383, 387: n = A,T,C or G
  misc_feature 390, 392, 394, 404, 407, 409, 413, 417, 419, 420, 421, 422,430, 439, 440, 441, 445, 446, 447, 450, 453, 455, 458, 463,466, 468, 471, 476, 479, 497, 500, 514, 516, 519, 522, 523,542, 554, 557, 561, 563, 564, 568, 571, 573, 575, 584: n = A,T,C or G
  misc_feature 594, 602, 605, 612, 662, 715, 771, 800, 818, 827, 849, 872,875, 904, 921, 932, 935, 965, 966: n = A,T,C or G
ggggncattttgcnaaantccccgcngtttttncccngtnnttgccnaaaaanagncccntttgggggcncccccntnttttgccaaaaanatccnnccctaggggcctaacctatgggctgcnntatangngggncagggggagaanccccgcnaaangcgnnaanganggangnaaannaacgggggcacacacgcncnagngggcagngncnncnanggggnagannngnncagggancagnggggnnngnncntnccgancananacnnggnggggagaannncnagagggnaagnncaccncncganaagngnganagggnggnancntgnannacgacnanactnggnggngcaanccgnaanngagacgangananaggngtncnanggcgcaaagnagnantacncgcncnnnngatacagnaaaaaggannnaaannnacngcnanganagagngananacnacaanctntggaggaagagacggaanacngggagaggaagggntnagnaannaaaggcaaggattaacctnacagaaatgaanaancccnanncacnggngncntctgcaagngaaccacttnaagccaangtnaagcagntgcagcttgatagcctgctaccactgagagggactcagaagagtgtactncattgcaatacttaaacagcgccatcttgctgtggaagcctacagaaaactgnggatgaacacaagaaaacgatggaattactgcagagtgatatgaatcagcacttcntgaaggagactcctgggaagcaaccagancattccggcaccttcagncacatcagnacttggcaataaaacccacagngagaattggaaaacagatggggnganagaactggccctctggaaaagacagcttnggacaaggtcaccaacngaccagatccnggnaaaaaatccaaggcataaaggaaagaagannggtccaaatctcaggggatccaacc

SEQ ID NO: 5181 - DNA, 1188 bp, Homo sapiens
  misc_feature 37, 47, 55, 60, 79, 86, 89, 93, 132, 143, 165, 181, 186,199, 201, 210, 220, 251, 253, 255, 256, 259, 260, 263, 267,270, 273, 274, 275, 276, 277, 279, 280, 283, 285, 287, 288,290, 291, 293, 299, 300, 302, 306, 307, 308, 311, 313: n = A,T,C or G
  misc_feature 315, 317, 318, 320, 325, 326, 329, 330, 331, 332, 333, 335,336, 337, 338, 339, 341, 342, 346, 347, 349, 355, 358, 360,361, 365, 371, 373, 374, 375, 378, 380, 381, 382, 384, 386,389, 390, 391, 395, 396, 398, 399, 402, 404, 405, 411: n = A,T,C or G
  misc_feature 412, 414, 415, 419, 420, 421, 423, 426, 430, 431, 434, 436,441, 442, 452, 453, 461, 466, 469, 472, 474, 475, 479, 481,485, 490, 493, 503, 510, 513, 518, 521, 527, 530, 531, 532,534, 539, 545, 547, 548, 564, 568, 577, 578, 584, 586: n = A,T,C or G
  misc_feature 598, 600, 605, 610, 615, 618, 625, 626, 634, 645, 646, 648,649, 663, 673, 675, 676, 679, 681, 688, 690, 693, 695, 696,702, 704, 711, 723, 724, 725, 729, 737, 742, 744, 752, 756,761, 762, 763, 769, 774, 785, 790, 795, 798, 799, 808: n = A,T,C or G
  misc_feature 820, 821, 825, 827, 829, 834, 836, 838, 840, 842, 845, 846,851, 852, 860, 862, 865, 868, 869, 870, 873, 874, 876, 880,887, 888, 895, 896, 907, 910, 912, 916, 919, 923, 925, 935,936, 944, 945, 951, 955, 968, 970, 972, 973, 975, 980: n = A,T,C or G
  misc_feature 984, 986, 989, 995, 997, 1000, 1004, 1006, 1007, 1009, 1011,1017, 1019, 1027, 1034, 1037, 1040, 1050, 1055, 1058, 1060,1063, 1065, 1066, 1067, 1070, 1071, 1076, 1081, 1084, 1088,1090, 1093, 1103, 1104, 1111, 1113, 1114, 1116, 1118: n = A,T,C or G
ccttaaaaaattggggccctttggggcctttacttcngggtagaatncttttttnttggnccaggggaaatccccccanttccgcnaanaaancgggaaaatttgtgccgggggccaaccggaagggaaacnttcttgggggnccacccaaaggccccccagggnaaggtttccaaatttngggtnttccctttttttncnaaagggccnaaggtttccnattttttcccaatttaattcccaaaggcccngntnnatnntgnctangtncgnnnnncnnatntntnnanngngggcgnnanattnnntcntntntnntntgtcnntcnnnnntnnnnntnntaanncnttattnatntnntatncagccncnnntanannnantnctnnnaatnntnnttntnntactcnncnnattnnntngtngtcnnctncntttanntcatcatacnnatatcatntaaanaangcntnnactncntatnatccnttngcatcttcantgttttnttnctcanctncttgcntcnnntntacantaccantnnttaagctctttttacnatgnaatactcannaagagntngaggttggctgnantttanctttntaaantcnttgtccnntgggctcntgaactttttnnannttgttggccctttnacttttactntnnatnanatgggantncgntnnaatctntnttcatanaatttttgtacnnntaancgttgatnttagnanaaactacnaggnacctnnntttcantaggnttttattcctnttttnaaccnttnntttgatatnttcttaactatnngcanancnttacntnancntntcnntttgnntaaaatgngnatnggnnnacnncnatangaccctnnagctccnncattttccttnaananagcncanttcnantattctattnnaatcaatnntatcantcgngcttgctcttttnancnnancatangatntncanggtatntntangccnanntncnaactantntgcactcnactatcncancgntaataagacntatanaangntcntnnnatnnaaccntttgnctnacantnatnttgtacatannttcctcncnnanannnnagnntnannttatnatnttncatatcanncnatanactntaataagtactntataaanttncgnncg

SEQ ID NO: 5182 - DNA, 941 bp, Homo sapiens
  misc_feature 9, 21, 25, 28, 37, 41, 43, 44, 53, 56, 57, 59, 67, 72, 73,78, 83, 88, 95, 100, 101, 106, 107, 115, 127, 133, 138,157, 161, 179, 181, 186, 195, 196, 202, 206, 211, 219, 220,221, 222, 223, 226, 228, 234, 235, 237, 239, 257, 259, 269: n = A,T,C or G
  misc_feature 270, 278, 280, 290, 293, 307, 324, 328, 333, 338, 345, 349,357, 401, 403, 404, 413, 414, 417, 420, 424, 425, 428, 434,439, 443, 444, 447, 452, 496, 504, 511, 518, 532, 540, 547,548, 553, 572, 576, 581, 589, 600, 618, 620, 623, 624: n = A,T,C or G
  misc_feature 648, 658, 670, 674, 682, 690, 693, 698, 701, 707, 710, 712,722, 737, 739, 741, 750, 761, 766, 780, 781, 789, 790, 799,804, 808, 811, 812, 829, 836, 837, 839, 841, 842, 850, 864,877, 879, 896, 901, 921, 923, 934: n = A,T,C or G
ggggttttnaataccttgctncttnttntttatgcangatncnntcgattcgnatnncncgcgaagntggcnnatgcngacanggccngttctgnatgannaatgnncatctatntccctcccaaangggcgncccanggatatgtcttgggatccnattncacccatgacgcctactncntgctncttcctctnntgctcnggtnttgtncacaaatnnnnnggnancatccnngncngtccattggagatgtcgngnataaactgcnntagatgtntnctaacactgntgnaaatgacgagcatncttatgagacgaaggcntccnaagcngtagntgcccangatncgaggtangctatgtggtctcttatctaatctagaaatgaaaacgccctgtntnncagcgaaanntanggnacgnntgnacactngcttnaacnnaancttanatacaacaggggaagggaaattgggggggaaaccattgacaggncttatcanatagggnttaaatnagaggacccaccgnttgtaatnaacatgnngattnatttgggggaatacggatncaanaggtnccaggttncacttggtttntttttaaccttatggccnantanncggttcaatttggattttggggangccccttttncattttgggaanattnggagcccnctaatggncgnggaancantttgtnggntncccccaatcntaatggggacccctntnanaaaacctcnggggggtgganccccntccttaaacccaannacgctttnnttgggtttnccaanaaangcnnaccccccggaaaacttnccctttnngngnnaatttctncaaccccccggggnggaattttccctngngaaattggcaattcccngtttnaagggtgcccaaaaattccngntttttggcccncaatacc

SEQ ID NO: 5183 - DNA, 740 bp, Homo sapiens
  misc_feature 2, 4, 8, 9, 10, 11, 12, 13, 14, 16, 19, 738: n = A,T,C or G
gngngggnnnnnnncnatntatacatacaggctacttgttctttttgcaggatcccatcgattcgaattcggcacgaggctcctggcatgaagaagatcaagttagacactccagaggaaattgcacggtggagggaagaaagaaggaaaaactatccaactctggccaatattgaaaggaagaagaagttaaaacttgaaaaggagaagagaggagcagtattgacaacaacacaatatggcaagatgaaggggatgtccagacattcacaaatggcaaagatcagaagtcctggcaagaatcacaaatggaaaaacgacaattctagacagagagcagtcactggatcaggcagtcacttgtgtgatttgaagctagaaggtccaccggaggcaaatgcagatcctcttggtgttttgataaacagtgattctgagtctgataaggaggagaaaccacacattctgtgatacccaaggaagtgacaccagccctatgctcactaatgagtagctatggcagtctttcagggtcagagagtgagcccagaagaaacttccatcaagacttgaacagacgttttggcagaaaaccaggttcttgatagcagtgctcctaagagtccaagtcaagatgttaaagccaactgttagaaatttttcagaaccaagagtgagaaccgaaagaaaagcttttgaaaaaccaacccttaagaggaaaaaaagattttcccactntc

SEQ ID NO: 5184 - DNA, 890 bp, Homo sapiens
  misc_feature 2, 11, 14, 16, 18, 28, 72, 83, 86, 91, 94, 97, 98, 102, 104,107, 108, 112, 113, 115, 116, 124, 125, 126, 133, 143, 153,155, 159, 184, 190, 195, 200, 203, 208, 213, 216, 222, 234,239, 241, 247, 249, 252, 253, 260, 261, 265, 268: n = A,T,C or G
  misc_feature 271, 277, 281, 286, 290, 292, 293, 294, 298, 314, 315, 320,326, 328, 331, 333, 337, 340, 343, 355, 356, 362, 368, 370,375, 379, 382, 386, 406, 409, 412, 418, 425, 440, 444, 445,447, 460, 472, 474, 476, 483, 484, 487, 494, 496, 503: n = A,T,C or G
  misc_feature 511, 512, 516, 520, 525, 526, 537, 538, 543, 544, 546, 549,551, 552, 554, 564, 568, 570, 578, 589, 592, 594, 602, 608,610, 620, 622, 624, 625, 632, 635, 642, 644, 652, 653, 657,672, 678, 689, 697, 698, 699, 700, 711, 715, 717, 721: n = A,T,C or G
  misc_feature 730, 733, 736, 742, 746, 764, 769, 772, 779, 791, 793, 794,796, 797, 801, 803, 805, 811, 813, 822, 825, 828, 829, 834,842, 853, 858, 859, 864, 867, 870, 875, 877, 889: n = A,T,C or G
angttggaaanccngncntttcaaatanctaggctactcgttctttttgcaggtatcccatcgattcgaatncggcacgaggnccnttggngtnggnnattntncannaatnntnnacggacannncttcgcnattatggtgntcttgggtgntngggnttgttggttaaccctacatcataangcattnaatgnattanatnttgtnattgntgncaaaanggaatagggtcnacaantnctgtgngnatnnaacctgnntcanatngcntttggnaatnttctntacncnnntttnaattccactgtaaatnntgacngattantnccnantggnttntcnttggagaaaatnnattttncactcncngtctncacnttntatnaagcgtattttatgctggcnggnccnccatanatctacncccctttgatgcctntggnnanaaataatgttaantagtgcgcaaantngntattgtnntgnggacaancntaaatgngccattannggcntacnatgcnnttatgccacannaccanncngcnanngnttttgattangggnangcattccntaaacaacccngcncnatgaactngaactngnttgggaattnantnngggaatnaanttggcgntnatgggtgnngggnccgcctttaccccgnccacanaaattccttgngcaatttnnnnctttaaaaggnccananggcnttaatgggnttnggnaacttntaanccttttttttgtttgctntttanggngtggccnagatggcacaancnncnngaantntnggtgcntnaacctctgnttnaannctaantaggggantgccaaatggnttttnnctttngcnccnaatantntttttcttgggng

SEQ ID NO: 5185 - DNA, 776 bp, Homo sapiens
  misc_feature 1, 4, 5, 6, 7, 8, 9, 12, 13, 22, 27, 38, 604, 620, 623, 634,665, 673, 704, 708, 711, 724, 738, 746, 766, 775: n = A,T,C or G
ntgnnnnnnttnncccctttcnaatcncttggctactngttctttttgcaggatcccatcgattcgggagaactgctcactccttttccctccccatacaaactcaaagtcccctgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaaggtgtacttcaccagcaagaagtcaactctagaaattcaaggatgttccttctaattggtttcttaagccatctgtcanggaaatggtaactttnggntttaatttttnggcttaattcccaaggggggtaaagcccagnaaaaattngaaaaatggaattattttcctggattaaatnagcncgnaaaccttttttcnaattcttcaaattnttttaaangggggtcttgcttctttttnaaaagcctnt

SEQ ID NO: 5186 - DNA, 752 bp, Homo sapiens
  misc_feature 1, 6, 7, 8, 25, 36, 44, 310, 528, 550, 592, 607, 614, 619,620, 622, 626, 628, 634, 643, 645, 646, 647, 651, 663, 665,666, 679, 683, 685, 689, 691, 708, 712, 714, 724, 738: n = A,T,C or G
ntggannnctttcccctttctaatncttggctactngttctttntgcaggatcccatcgattcgaattcggcacgagccttccacggttatttcacagatatggagagctggaagcagggagtgagtctctgagtgttggaattgtaagggatcagaagcagggatcagaagcagtggtgaagttcatccaccataaaacacacaggtgactttgccttgaatctgcaggactgaagccaactcttgggcacagacccttagtcccttccttggccactctaagtcagatagtccagagccaggcccttngggatgtgacaccgagataaatcagagaaaagctgtgaagcttggggaacagagggacttttggtgaagtaggtggtctgcagtttctatcttcttgggaaaagcaagctggaaaagtgaacagtggttggtaggccatagtgctcccagctgggtgacataatgaccacacagcacaagtgatgttattagcaactgtgtggtgggagtaggttgtnggcttggacaaaatcaatccgngtgggaaaattgttaggaagttttattacatttaaacttggntaacctaaaatcccntcaaaanaaaannantctngnccaaanttaagggtntnnnaatnaaaaaaactttngnncctttaaaacttntcgngngccntnttaacgttaaatcccgncatngntacgaatccnttggttgaattttngccaaacccacttt

SEQ ID NO: 5187 - DNA, 1069 bp, Homo sapiens
  misc_feature 3, 7, 8, 12, 15, 16, 17, 18, 19, 20, 21, 22, 23, 24, 27,37, 41, 42, 44, 45, 46, 48, 52, 54, 55, 57, 58, 59, 61,62, 63, 66, 67, 69, 70, 72, 74, 78, 82, 83, 85, 87, 90,92, 97, 98, 119, 123, 133, 134, 147, 148, 152, 154, 157,165: n = A,T,C or G
  misc_feature 170, 192, 194, 196, 202, 203, 204, 211, 212, 220, 223, 231,232, 248, 249, 254, 258, 260, 269, 271, 286, 293, 302, 306,308, 310, 318, 320, 335, 347, 356, 357, 359, 361, 371, 375,379, 380, 383, 384, 385, 389, 392, 396, 405, 411, 414: n = A,T,C or G
  misc_feature 415, 417, 419, 426, 430, 431, 433, 434, 436, 442, 457, 473,476, 477, 479, 483, 485, 486, 487, 490, 491, 493, 494, 500,510, 513, 514, 520, 524, 539, 548, 549, 550, 551, 554, 556,562, 568, 570, 579, 580, 584, 589, 591, 592, 602, 609: n = A,T,C or G
  misc_feature 610, 611, 616, 618, 622, 624, 627, 635, 636, 637, 642, 644,649, 650, 653, 654, 655, 657, 659, 671, 681, 688, 693, 697,702, 711, 714, 726, 730, 731, 732, 737, 741, 748, 749, 755,762, 763, 767, 768, 769, 772, 779, 784, 789, 791, 795: n = A,T,C or G
  misc_feature 808, 819, 824, 832, 843, 845, 846, 847, 848, 849, 850, 854,856, 859, 861, 871, 872, 878, 880, 890, 896, 899, 900, 902,923, 929, 930, 966, 968, 975, 987, 996, 1004, 1006, 1008,1011, 1018, 1020, 1021, 1022, 1024, 1029, 1037, 1040: n = A,T,C or G
  misc_feature 1041, 1043, 1044, 1046, 1050, 1051, 1052, 1055, 1059, 1060,1064, 1066, 1067: n = A,T,C or G
gcncaannacangannnnnnnnnnaanaaacaacccnaaannannngnaccnannannnannnganngnngnancagnaggnnangngtnanccgcnnggaaaccctgcgacccacgancggnggaaccggcnnaggccggacaccnnggcngnggncacgcggnacagnaggccacggggagcagaacacngnanacggcnnngaaaccnncccaccancanagagagannggaagtgacagcacanntgganaagncnaagacccanangacgcagaaaacaangggacangaggcgaangcanangnggaaaaananagcggaagaacaganacggagacaagncaccaccgnnangncagaggccancganaccnnggnnngccngancaanagacaaacnccgacncannanangcggccnggannanncngaggangcaaaagagagaaangaagccagggaagganacnngncatncnnnccnncnnacgaanggaaacgagnaanncagcanggcnggacacaacgacacnggaagcaannnncgnanggaacngaaacnanccgaagaannggancgggngnnaatcaaaagnggaaccnnncgaangnccancncancaagggcnnnccaangngccannaannngncnaaaaagcgcccnccaagagggncgacgangacgnaacnagagnccgacgggnagncgaagaccaaancagnnnccaangaangcagaannggagcnaagcccnngaannnganaaaaaangggcncgggncncacnacgaagcccccanaagggggaaanaacgnagaggggnaacagagcccnannnnnngcgngnganangacacaggannacaaangngaaaaggganccacancanngnaaacccgggcaaggggaaacncccaanngcaaagaagaaagaacagagcacgcaaagcagaaangnaacaganaacaagggaacnaaagagcgngacacagnancnaanggcaacnannngnaggcnacccacgncanngnnangccnnnagnacanncgcnanncg

SEQ ID NO: 5188 - DNA, 459 bp, Homo sapiens
  misc_feature 13, 18, 19, 23, 26, 59, 61, 65, 68, 83, 87, 88, 90, 98, 104,107, 110, 113, 118, 119, 121, 125, 129, 138, 143, 156, 162,176, 186, 196, 204, 220, 229, 232, 236, 243, 247, 253, 256,257, 258, 259, 260, 265, 267, 269, 271, 277, 279: n = A,T,C or G
  misc_feature 285, 287, 293, 297, 308, 312, 313, 314, 317, 319, 330, 331,335, 339, 342, 352, 359, 374, 375, 377, 379, 385, 411, 414,419, 422, 431, 441, 446, 455, 458: n = A,T,C or G
ttgatccatatanatacnnctanttntgcaggatccctcgattcgaattcggcacgagncncatnccnaccactactgatgantatnntncaaagagngatacnctntgnctnatggnntnaacnctcnttatccaantgggnaaggaacttggcnccggangacgcagatgtgtncacctcattntcaaggaaanctgtgaancccctgcctccttttncttgcctcngantgtntgtgacnacancggacnctnnnnncatcncnancntgtagngnaacggnantggaanatcngtgcactcgtntatnnnacngngagggaccatnnaccnaagncancttagcaaantggcttngatgctgtggctgannancnactgcnggtgcattcggacacatttgcccatnacnctgangcncatttctgnggggtcaagntcatnctgatcttntgng

SEQ ID NO: 5189 - DNA, 784 bp, Homo sapiens
  misc_feature 3, 4, 20, 48, 49, 51, 55, 60, 61, 66, 69, 81, 82, 93, 96,115, 117, 119, 123, 128, 139, 144, 151, 157, 159, 160, 164,165, 173, 176, 187, 191, 192, 195, 196, 200, 201, 207, 215,220, 223, 229, 230, 231, 236, 240, 241, 246, 255, 257: n = A,T,C or G
  misc_feature 277, 287, 304, 306, 310, 315, 320, 326, 345, 350, 358, 364,366, 367, 371, 375, 376, 378, 381, 384, 386, 389, 396, 399,400, 407, 411, 413, 420, 445, 446, 447, 453, 460, 462, 464,465, 467, 469, 470, 479, 484, 504, 506, 511, 513, 514: n = A,T,C or G
  misc_feature 518, 521, 526, 529, 531, 534, 543, 548, 549, 558, 566, 576,578, 587, 588, 606, 607, 610, 616, 617, 619, 620, 627, 628,632, 634, 638, 651, 654, 660, 661, 662, 663, 674, 680, 685,691, 694, 695, 696, 700, 702, 709, 714, 727, 729, 739: n = A,T,C or G
  misc_feature 746, 750, 762, 776: n = A,T,C or G
ttnnaacctttgcatttganccctttgcaggatccctcgattccaagnngncacnaggtnngctgnacncttggctaaggnnactgattctgngcnccctacccatgttcatggnangnccgngcctnctctggccatntgccncaacgantattcntnncccnnaattgctnatntcttgggatantagnntanntganngatttngcaagacnagaangtntctacnnntctgnccannacgtncgctacttntnaggccttaacaaatcttggncatgcatggnatatatatcttcctaangnaccncatgncaggntccatnccattcattgaatgccaangatanaccagctnctggtncnnaagnagtnntnagncancntancaaaganccnngggcccntggngnttgacancattcatcgtggaggaacaatggannnagtctnactttcncnanncnannttctgattnaaggnttgtgaaagagtattacatnancgtgnanntcanggntgatntancncanaaatggcanctttnncttgcatcnagggtctnggcccctttntncataaaaannggatctgaataggctttnntanttaccnncnncacaccnnatgnantaanctaaccctttgcnaangttagnnnnctttaccacanaggtcnttacncaaaantannnggtnanaaccccngccanttttctagattantncccaacttangccctgncatncacttgatacanggcccccttattanaatgaact

SEQ ID NO: 5190 - DNA, 887 bp, Homo sapiens
  misc_feature 5, 26, 66, 82, 84, 85, 88, 93, 96, 108, 110, 112, 114, 116,119, 125, 148, 149, 151, 154, 164, 166, 167, 168, 170, 180,183, 185, 189, 215, 221, 222, 224, 226, 227, 228, 229, 231,244, 245, 250, 255, 263, 268, 277, 280, 283, 287, 288: n = A,T,C or G
  misc_feature 290, 297, 299, 301, 303, 309, 311, 315, 316, 322, 325, 326,329, 330, 334, 335, 337, 342, 343, 344, 346, 347, 349, 354,355, 369, 376, 378, 381, 382, 386, 392, 394, 400, 401, 402,405, 406, 410, 411, 417, 418, 419, 429, 441, 443, 447: n = A,T,C or G
  misc_feature 459, 470, 471, 478, 479, 481, 488, 489, 490, 505, 510, 514,526, 528, 534, 543, 548, 556, 569, 570, 579, 582, 584, 588,589, 591, 603, 604, 605, 612, 613, 614, 615, 616, 619, 620,630, 632, 635, 636, 637, 638, 649, 651, 654, 655, 657: n = A,T,C or G
  misc_feature 663, 666, 674, 675, 676, 682, 683, 684, 694, 702, 709, 710,711, 716, 723, 728, 731, 738, 741, 742, 744, 749, 764, 765,766, 767, 773, 774, 777, 779, 793, 800, 812, 815, 817, 818,819, 825, 826, 830, 832, 835, 841, 853, 856, 866, 873: n = A,T,C or G
  misc_feature 877, 880, 881, 883: n = A,T,C or G
caaancctttgccccttttcaaatcncttggctactcgttctttttgcaggatcccatcgattcgntgctgcgactcaggcncnntgnatggnaantgacataatgtnancnanangcnctctgntgtatgagttgtgcttggtttgnncnagnaggaaactgngnnntntataactacnccnangccntttggacaacagctgggatccaaccnttgctnntngnnnnantgttcttttcagnncctcntgggntagaccanaacanttccttgtnaanccnaacnngncaaaacntngnancagggntncgtnncccaangtnnttnnttanngnccccnnngnngnaaacnntttcaaccccttgnctttggnanaanncttngggccntnaaaatnnnttnnatannaccttnnntggggattcntttaatttctantnaaangttggtggtccnattttaacctnnaaaatgnntngcaatgnnnacttataacccttanatcgnttgncttaattgaaancnttaacngtctaaacnccttnagctaaanctcccaatatcgnnggtaacccnggngnatgnntnggggccaatggnnntttcaannnnnctnnaagatcctcngnatnnnnagaaggatatntnccnncntgggantanttctctgnnntattcnnncgaaaaaganacctttgncctcttnnnattgnaatattngcctngtnttaaaancgnngncccanttttgggggaatatnnnntttctnngananaaaaatggggcccncctgggntactttatatcnttntnnngaaaannccgncnaanatcctncatatggttggntcntttcatgacngcggggnttanttnntncccg

SEQ ID NO: 5191 - DNA, 463 bp, Homo sapiens
  misc_feature 6, 49, 50, 55, 59, 63, 66, 70, 74, 83, 86, 92, 110, 111,117, 120, 122, 123, 124, 132, 133, 134, 144, 150, 165, 178,182, 188, 203, 217, 241, 247, 254, 255, 257, 266, 277, 278,282, 289, 290, 291, 300, 301, 303, 308, 309, 313, 335: n = A,T,C or G
  misc_feature 338, 339, 340, 346, 347, 350, 357, 363, 366, 372, 379, 385,392, 396, 399, 403, 404, 406, 408, 409, 414, 415, 419, 432,439, 451: n = A,T,C or G
tattcnatctgctacttgttctttttgcaggatcccatcgattcgagannaggangaangacnctntgcntggnacagggctntgnccctantctgaatatgtcattccnncacggngancnnnagcctttnnntctccccatntttggnaattactttcttgangatgctgcctttnaaangcttcncgtacattatccatntttaaaaaaatctntggactggatctactgaagcgccnttgctntattaanntnagggcctcnagcacctaaanntctngaccatnnnaagacattnntncattnnactnctttgtataactaaatactctntannnatttcnnttncaatacngtgganggnaatganaagcatnctaaanttgggtnaatntanttcnntnannatgtnngacnaaagaagaaaatngcttgtnttcaggttcatnggcttgtgctgg

SEQ ID NO: 5192 - DNA, 765 bp, Homo sapiens
  misc_feature 5, 20, 64, 67, 69, 71, 77, 78, 80, 81, 82, 86, 88, 96, 97,108, 109, 112, 118, 119, 123, 134, 139, 145, 147, 149, 151,154, 155, 164, 165, 171, 180, 181, 199, 201, 208, 213, 219,229, 242, 246, 247, 248, 251, 252, 256, 257, 277, 281: n = A,T,C or G
  misc_feature 289, 290, 294, 298, 300, 303, 306, 309, 318, 325, 329, 333,340, 348, 349, 350, 352, 354, 355, 358, 361, 363, 364, 365,372, 378, 391, 402, 419, 423, 429, 430, 435, 443, 463, 479,487, 490, 502, 504, 507, 528, 532, 558, 563, 576, 587: n = A,T,C or G
  misc_feature 590, 598, 604, 612, 613, 617, 622, 626, 635, 636, 637, 643,644, 647, 649, 653, 654, 663, 668, 669, 671, 672, 674, 678,680, 681, 691, 697, 700, 705, 709, 719, 721, 723, 739, 740,744, 750, 761, 762, 765: n = A,T,C or G
tttcnaatgcttggctactngttctttctgcaggatcccatcgattcgaattcggcacgagccngtntntnctaatnntnnnatgntnacctgggnntggtggtgggnngcntgcagnnccanctactcagggngctgnggcatnanantngcnngaacccaannggtggnagttgctgnnatccgaggttgcacactngnactccancctgnccacanatcgagactngtcttataaaaantaannngannatgnnagacctatcagtagggtgancacntgtccttnngctntgcngntcnacnttnatgcgatgngatccantgangttnaaccccnttccactnnntngnnaantcntnnnttacatnctgtgntccccaaaacatntcacgtaacanttattcctaggtgcagnctcnctatcnntaggntcttggtnggccaaattcctgggatcangtgaaggtgggctgtntcagtaanaantgaatggactgnanagngcccattttacaaggaccatncttnctgggggcaagccaataaattatttnccctntttgggggaaaanaattttcgganccntaaattanatttcnggaaaccnncccnaaagncttnattttcccnnnacaaannttngngganncatttttanggggnnannanaggngnnaagggtttcngttggnttngcccntaanttcccaaggncntngaaacccttatggggnnaccncattcnggataatttgnnaan

SEQ ID NO: 5193 - DNA, 891 bp, Homo sapiens
  misc_feature 4, 14, 38, 42, 63, 68, 70, 72, 74, 89, 94, 97, 109, 114,116, 120, 124, 129, 130, 133, 139, 142, 150, 151, 153, 159,160, 162, 166, 167, 182, 184, 185, 197, 199, 210, 212, 217,222, 245, 251, 261, 263, 267, 269, 274, 276, 289, 293: n = A,T,C or G
  misc_feature 299, 301, 318, 334, 336, 338, 340, 342, 349, 354, 358, 359,361, 371, 372, 376, 377, 378, 389, 390, 394, 395, 402, 404,406, 422, 423, 432, 443, 446, 449, 451, 452, 459, 463, 471,479, 486, 489, 506, 517, 519, 520, 521, 522, 524, 528: n = A,T,C or G
  misc_feature 529, 535, 540, 544, 549, 552, 562, 563, 569, 581, 603, 630,643, 666, 670, 673, 680, 683, 685, 692, 693, 720, 724, 731,732, 733, 734, 737, 740, 748, 771, 777, 780, 782, 789, 795,799, 805, 811, 818, 832, 833, 837, 841, 864, 866, 868: n = A,T,C or G
  misc_feature 872, 879, 888: n = A,T,C or G
gtcntctttgaaanccctttgctacttgctctttctgnaggnaggcatcccatcgattcgccnacgcncngngngcaggcgggttgctnatggngcnctcttccgcttncttgntnaatnactntctgnnctngctcgntcngctgctgnnancggaannanctcnntctaaggcggtgatncnnatatccacagantnaggggataacncnagacngaacntgtgatcgaaaggccaacagatngcctanaaccgtaaanangcanantagcngncctatatccatangctngctgcncntgactagcatatcatanatgtcactgtcatgtncntncntngaaaagnccgtnaggnntnttatgatacnnggcnnnttcacttggannccanntcaagcncncngctgttacaatgctgnngctgaatgnatacccgtccnacntgntnnattaggnaacntgggatcncttctatncactgtnacnctcatggggttttgggnaaatgcccaangnnnngnccgnnattccncccgnaagntttgnggnatgttgttgnngaccgnaaaccccttggncgttaccaattgggggggaaanaaccttgttgggccttttaaaccccgnggtaaaaaccttnatacggaaattttaggagtttgnccanatnccccggnggntnaaggccnnacccaattgtttaaattccccccaacnttgncctttgnnnnaanggnccttggtnaaaccggggggaaattccccttngaacancgnantagggtngggcanggcnttttanagggantcccctngaaaagcggctggnnggtnaacntttcgggctttggggttgaacangnantctncaaattngggaaatcntgg

SEQ ID NO: 5194 - DNA, 812 bp, Homo sapiens
  misc_feature 3, 8, 9, 10, 11, 13, 17, 18, 19, 21, 22, 23, 24, 25, 31,36, 37, 40, 41, 47, 48, 49, 52, 54, 56, 57, 61, 64, 442,531, 561, 563, 574, 583, 588, 589, 595, 597, 604, 619, 645,646, 650, 653, 661, 667, 668, 669, 670, 673, 681, 694, 696: n = A,T,C or G
  misc_feature 698, 700, 703, 704, 707, 708, 728, 736, 744, 745, 747, 764,767, 777, 778, 782, 783, 792: n = A,T,C or G
ttnctaannnntncttnnnannnnntggganctttnnctnnctccannnatncnanntgcnttncggtttgggagtcaggcctgggcaggaccctgctgactcgtggcgcgggatctgggagccaggctctccgggcctttctctggcttccttggcttgcctggtgggggaaggggaggaggggaagaaggaaagggaagagtcttccaaggccagaaggagggggacaaccccccaagaccatccctgaagacgagcatccccctcctctccctgttagaaatgttagtgccccgcactgtgccccaagttctaggccccccagaaagctgtcagagccggccgccttctcccctctcccagggatgctctttgtaaatatcggatgggtgtgggagtgaggggtacctcccttccccaaggttccagaggccctaagcnggatgggctcgctgaacctcgaggaactccaggacgaggaggacatgggacttgcgtggacagtcagggttcacttgggctctctctanctccccaattctgcctgcctcctccttccnanctgcactttanccctagaangtggnngacctnanggggaanggacaagggcaaggngggccccatgaaaaaaaagcccctcnnttgnccnacacttgncttgannnnctngcttcttnctggtggccccanangntnggnnttnnccaaccccacctgggatttncttgcccnttgggggnngnacttggcccctttcctnggnttttttgccnncacnngggccttcnttgggaacctttgtcaccct

SEQ ID NO: 5195 - DNA, 938 bp, Homo sapiens
  misc_feature 1, 21, 33, 52, 58, 60, 78, 86, 89, 95, 102, 118, 120, 127,154, 159, 181, 183, 185, 194, 196, 217, 219, 243, 256, 258,266, 291, 293, 303, 304, 315, 316, 322, 327, 334, 346, 351,360, 369, 374, 381, 387, 397, 398, 400, 401, 407, 412: n = A,T,C or G
  misc_feature 413, 420, 421, 428, 432, 433, 437, 438, 439, 450, 454, 456,457, 477, 488, 492, 495, 497, 500, 503, 511, 512, 515, 532,550, 564, 565, 573, 575, 576, 580, 586, 589, 593, 594, 598,601, 609, 618, 622, 628, 632, 633, 641, 646, 652, 653: n = A,T,C or G
  misc_feature 663, 664, 665, 676, 696, 703, 704, 710, 714, 718, 719, 724,727, 731, 739, 746, 753, 761, 762, 768, 770, 775, 778, 781,783, 786, 795, 820, 823, 824, 826, 834, 835, 837, 843, 844,845, 846, 853, 857, 861, 865, 877, 894, 895, 896, 898: n = A,T,C or G
  misc_feature 900, 903, 906, 913, 917, 925, 929, 932, 937: n = A,T,C or G
ntttctaaaatggccctgggncccctttttccnaaaatcccctttgggcctncttttncnaaaaatcgcctttgggcnaactccgnatncttatntggacangggaatcccatccgantntccgganatttcggggccaccggaggggaatttngtggnaccatggggtcgggttacaatnananaggggtaantnaccattgggatggttaaaatnanaaagggccaatcaccattgggacngttacataaaagngnatcgctgnggcaagccaccaaacaattcccatnanggaaattttnnagaacttttannggaatntggcncaaattnttcaagggcccntttanttctcagancaccccggnccttnttggatnaatganggctggcggnngnntggagnaaaanngacccannttaaatngggnnaccnnnatgaaaggttnggcncnngaatgaacccccgtaccctnaaggccgttantccnaantnganacntaaaactnnacnaaaaccattgtctgggnccaactaatggcggaccnttggccaacctaannttttaacngnncatnggaccnaancatnnaaanccnggaacagncggaaaaanaggncgtganactnngataatgncatcnggaacnnctgaccctgnnnttccctatgangggcaaaaaaaaggcctccnaagggtnngacccntttnattnnccccnttncganccaacgcnttcattncccctcncagggggnntcaaananggccntcnccncntgnaaaacgacngtcccctggggccttttccaataanatnncncccctttnntnaccccnnnntaaaaanccgngggngaanaaaagtcccctnaaaaaatattccccccnnncncntgnccnaccactnaatnctcaaatnaaanccntttcnc

SEQ ID NO: 5196 - DNA, 938 bp, Homo sapiens; identical to SEQ ID NO: 5195
  misc_feature 1, 21, 33, 52, 58, 60, 78, 86, 89, 95, 102, 118, 120, 127,154, 159, 181, 183, 185, 194, 196, 217, 219, 243, 256, 258,266, 291, 293, 303, 304, 315, 316, 322, 327, 334, 346, 351,360, 369, 374, 381, 387, 397, 398, 400, 401, 407, 412: n = A,T,C or G
  misc_feature 413, 420, 421, 428, 432, 433, 437, 438, 439, 450, 454, 456,457, 477, 488, 492, 495, 497, 500, 503, 511, 512, 515, 532,550, 564, 565, 573, 575, 576, 580, 586, 589, 593, 594, 598,601, 609, 618, 622, 628, 632, 633, 641, 646, 652, 653: n = A,T,C or G
  misc_feature 663, 664, 665, 676, 696, 703, 704, 710, 714, 718, 719, 724,727, 731, 739, 746, 753, 761, 762, 768, 770, 775, 778, 781,783, 786, 795, 820, 823, 824, 826, 834, 835, 837, 843, 844,845, 846, 853, 857, 861, 865, 877, 894, 895, 896, 898: n = A,T,C or G
  misc_feature 900, 903, 906, 913, 917, 925, 929, 932, 937: n = A,T,C or G

SEQ ID NO: 5197 - DNA, 599 bp, Homo sapiens
  misc_feature 2, 3, 4, 5, 6, 7, 8, 9, 10, 11, 13, 14, 15, 16, 17, 18, 19,20, 21, 22, 23, 24, 25, 26, 27, 28, 29, 30, 31, 33, 34,35, 36, 37, 38, 40, 41, 42, 43, 44, 46, 47, 48, 50, 51,52, 53, 54, 56, 58, 59, 60, 61, 62, 63, 64, 65, 66, 67,68: n = A,T,C or G
  misc_feature 69, 70, 71, 72, 73, 74, 75, 76, 77, 78, 79, 80, 81, 82, 83,84, 85, 86, 87, 88, 90, 91, 92, 94, 96, 105, 111, 115, 116,117, 118, 119, 121, 125, 132, 133, 134, 136, 143, 150, 157,160, 162, 168, 169, 175, 181, 184, 212, 213, 214, 220: n = A,T,C or G
  misc_feature 225, 235, 238, 240, 257, 268, 285, 291, 292, 293, 299, 305,306, 309, 318, 332, 347, 348, 374, 388, 389, 392, 395, 399,400, 401, 448, 450, 472, 485, 515, 519, 526, 540, 549, 564,576: n = A,T,C or G
gnnnnnnnnnngnnnnnnnnnnnnnnnnnnnannnnnnannnnnannnannnnngngnnnnnnnnnnnnnnnnnnnnnnnnnnnnnnnannncnangtggaaaancccgtncccnnnnncngggnaccatcnnngncgggaanccgaagnggaaggngantncggggnnccggangaaaancangggtgttggggggggggggccgtatcannngaccanggggngaagcacttnggnanagggagcaaagacacantatgtaaaccnaggaggaggagaagaangcaaannngcatgngaaatnnagnttgaagaancgctttttttgctnttcagcaatggtatnnatgaacaacaaaaatatagaaaaagngagaaaaaggcaannatnaantatnnnctgaggaacaacaacaaagacaaaaaaatggggggggattgatttantntcccctgacaagaaaaagaatnggatctttagggnctaatgcaacctggcagactcactgagggngaanggaatgngctgaaaaaattcnagcctgacntggcaagctcccaangggacaccaccncaatggagaagaaagcaggaaag

SEQ ID NO: 5198 - DNA, 812 bp, Homo sapiens; identical to SEQ ID NO: 5194
  misc_feature 3, 8, 9, 10, 11, 13, 17, 18, 19, 21, 22, 23, 24, 25, 31,36, 37, 40, 41, 47, 48, 49, 52, 54, 56, 57, 61, 64, 442,531, 561, 563, 574, 583, 588, 589, 595, 597, 604, 619, 645,646, 650, 653, 661, 667, 668, 669, 670, 673, 681, 694, 696: n = A,T,C or G
  misc_feature 698, 700, 703, 704, 707, 708, 728, 736, 744, 745, 747, 764,767, 777, 778, 782, 783, 792: n = A,T,C or G

SEQ ID NO: 5199 - DNA, 819 bp, Homo sapiens
  misc_feature 5, 13, 43, 106, 153, 171, 173, 178, 180, 182, 187, 190, 192,196, 201, 214, 218, 225, 226, 238, 252, 254, 256, 260, 262,263, 270, 273, 276, 278, 279, 287, 301, 303, 330, 346, 363,371, 374, 393, 444, 453, 466, 467, 489, 497, 516: n = A,T,C or G
  misc_feature 537, 541, 543, 546, 547, 549, 558, 559, 567, 574, 580, 596,602, 613, 614, 617, 623, 630, 635, 640, 644, 650, 656, 663,666, 673, 675, 680, 690, 691, 698, 700, 703, 705, 708, 711,714, 718, 730, 733, 738, 740, 743, 745, 746, 754, 755: n = A,T,C or G
  misc_feature 758, 759, 771, 779, 786, 789, 799, 801, 808, 816: n = A,T,C or G
gcttnaatgcttntctaatgcttggctatgcggatccctcgantcgaattcggcacgaggacctatcttgatctggatagtaaagtgaggactttaaaaaagtttnttaaattactgggagaaatcatggagcacagattcaagacttttcancatttaaaaaggtggttngnctttncnangcaanttntncttngccancttactatttcancggncctatgnngaaaaaatcaanttttgccccatgantnanttangnncgttacnccntcncnnggagctcnaggacctgcctgtnangaccagggctgggccttgccaacccanggcaatgttggggccngaggctgctgtgtctgnccaagctnctntcagagtccaattccccangcctacagcgctgtcagcttgcaccctggcattctcacagagctggcttgnccaccccantggggggctatannctcagagaccacttcatcctcntggaatcnacctcttttctaatacccntctttggaaaaaagagcttgncccntnctnnangcaacactnngaagcttntgggccntggtgntgtaataatggtcttnccattnccgttgaaacnncantgcccntggttgntgttntcgtncagntgtcgntgaggnaaccttnggnattgcancntttanggccccaagnntccaaangnatntncantgnaancctnccctataccccncanccccnanttnanntaaaattnnccnnaaaaaccctttnaaatatanaaaaacncanaaacttttgngncctttanaacttttngcg

SEQ ID NO: 5200 - DNA, 913 bp, Homo sapiens
  misc_feature 4, 8, 9, 10, 11, 12, 14, 15, 19, 21, 23, 25, 30, 32, 34,37, 38, 40, 41, 42, 49, 50, 53, 55, 57, 58, 59, 60, 61,64, 65, 66, 67, 68, 69, 70, 71, 72, 74, 75, 76, 77, 84,86, 89, 104, 108, 109, 118, 119, 121, 124, 135, 138, 142,145: n = A,T,C or G
  misc_feature 146, 147, 151, 152, 160, 163, 167, 177, 187, 193, 194, 198,203, 208, 211, 216, 219, 222, 224, 226, 228, 231, 232, 237,240, 254, 262, 269, 273, 274, 286, 289, 291, 293, 298, 308,320, 323, 325, 335, 342, 345, 348, 353, 356, 360, 362: n = A,T,C or G
  misc_feature 367, 372, 377, 387, 391, 395, 401, 409, 414, 420, 426, 431,436, 437, 442, 445, 446, 447, 450, 471, 474, 476, 488, 489,493, 500, 513, 514, 515, 521, 524, 526, 531, 532, 535, 542,543, 565, 567, 568, 571, 572, 584, 588, 599, 607, 627: n = A,T,C or G
  misc_feature 629, 635, 638, 639, 640, 644, 651, 657, 659, 663, 674, 680,687, 691, 700, 702, 708, 709, 710, 711, 716, 718, 724, 725,726, 728, 735, 739, 746, 757, 760, 762, 773, 779, 788, 799,800, 810, 811, 812, 813, 818, 822, 836, 838, 839, 840: n = A,T,C or G
  misc_feature 861, 864, 867, 876, 881, 883, 886, 889, 896, 901, 902: n = A,T,C or G
cccngcgnnnnncnncacngncngnccgcngnancgnncnnngcgcggnngcngncnnnnnccnnnnnnnnngnnnnagtgcancnatnagctcccggcggacncagnnccagacccnngnggncgagggcgcgngcnaggnacnnnttgnntttcggtntgncccncgagccgagngccggggcanggcggnnagcnccggnccagnggntgtgngcncangngngngcnngcggncgngggcgccctggtcngcgcgggnctacccncggnnggagggagattncgngngngcggncgaggcacantggggccggagnagnanggtgcgcgcncaggggnaanacnggctngtncgcngnggccnggccntctgngccaaggagncccncccnccgagnggggcggnatccnggcccnagccgnttacnagccnnaatcnacnnnggncccagaggcccccggtccccnacntnggcccgaccggnngggncccccgnggggggaatttcnnngaggcnaanancggtnnggnaacccgnncgccccgtcaagagaaccggcncnnacnnccaacagggccnaagnggggcctagtnaaacaaanccccacgcccacccggcggnangggccncgnnngggngttaccntatccngnccgnaagcccggaancggaanggggccntggncaaaaagcnangggttnnnnccccntntggccnnnangggcccnccgngaaactnggggggggggnggngnccccaagtatncggggnaagccctgnagggggggganngtaacccttnnnncctcntaangaaacggggggggncnnncccccccccaagggggggggnggnttnaagggcgancccancnacnctntgctcgnggaannaccccgcgcgg

SEQ ID NO: 5201 - DNA, 745 bp, Homo sapiens
  misc_feature 17, 23, 270, 291, 337, 360, 400, 405, 462, 476, 502, 517,525, 536, 537, 543, 546, 569, 616, 618, 633, 634, 657, 660,669, 671, 672, 674, 691, 694, 698, 706, 721, 726, 733, 743,744: n = A,T,C or G
tttctaaatgcttggcnactcgntctttctgcaggatccctcgattcgaattcggcacgaggataggccacattccagtaagaactcaatttgtctcccaaatttgcagaaacaaaacgtgatttaaaagctgagctttttatcagaagcttttttgatgttttaagtgttatgtgacttgttgaactttttaaaaagtgctacttttaaaatcccagatactctgaattttagaaaacaaactaattctgattgtgtcgtgcccaagtnccctttttttttaatgaatanggaccaatgccacattgctttttatatttctttcttttttaatgtngccaaaaccaaaagtagctttgntttcctttgtattttgctactttgcagtatttgtgtgtgnggttntttttccttaatttgaaagggacagcactgtgtatgtttataaactaaatgaagatnagatattattttgntaaacattcatctgagaacaatcaangcagtagcccatggngctggctnctttgcagcannaaaccntgnacattttgatgactgtacaacanggaagaactttgaaaaaatcacggtgggattcatattacccaccggntnttcatttcatgggannctttcttgatcaaaaaaaagctnacntccgtaatntnntnatttatcctttctgttntcntaanaaaatatngggttgtttttggtncccanaaatggnaatttttgcnnt

SEQ ID NO: 5202 - DNA, 893 bp, Homo sapiens
  misc_feature 1, 2, 3, 4, 7, 10, 12, 13, 15, 16, 19, 21, 22, 25, 26, 28,29, 31, 32, 33, 35, 36, 38, 40, 41, 42, 45, 46, 47, 49,50, 51, 52, 53, 55, 57, 59, 60, 61, 65, 68, 72, 73, 74,76, 77, 78, 81, 83, 87, 88, 90, 91, 92, 93, 98, 103, 104,105: n = A,T,C or G
  misc_feature 106, 107, 108, 109, 110, 111, 115, 116, 117, 120, 122, 125,129, 136, 142, 149, 153, 162, 164, 179, 188, 193, 199, 202,203, 209, 210, 213, 220, 221, 225, 227, 237, 241, 244, 250,252, 270, 277, 280, 283, 289, 297, 303, 308, 336, 338: n = A,T,C or G
  misc_feature 347, 349, 350, 352, 353, 355, 358, 361, 362, 368, 389, 416,418, 420, 428, 439, 462, 467, 469, 472, 479, 480, 488, 502,518, 520, 523, 530, 536, 539, 549, 550, 551, 561, 569, 587,592, 601, 613, 632, 641, 642, 652, 667, 674, 692, 693: n = A,T,C or G
  misc_feature 695, 706, 720, 723, 736, 758, 759, 763, 767, 770, 801, 804,806, 808, 810, 816, 826, 827, 833, 837, 841, 843, 848, 853,859, 860, 861, 863, 866, 867, 871, 878, 886, 893: n = A,T,C or G
nnnnaanaananngnncananncannanngnnncnncncnnncannncnnnnngntnannnacgnaanacannnannnagnantccnncnnnnccgcncgcgnnnnnnnnncagnnngcngnagncacnctctttnaaatcncttggcngagntccatgcangnataccacgcagcggnaggacaccnggcgntggggntcnngtagtnnggncacaggnngggncntatggcaganaagnacncagcancnacccagagcgtaatgggnggccganacnggntggggngcacgatnactgtnccaanaaagacggagaactggcagcaactgcangnggcggtggntnncnncnacnacnnattgcnagtcatagcggctatgtgcanattgactggaagagagttgaaaaagangnanataaagcnaaaagacagantaagaaacgagcgaacaaagcancaccngnaancaacacnntaattgangaagcaacagaatngatcaagcagaacatngnganatccagngggatntgnggggaggctnnnagctcggacntgcatctnaaggacaatgaatattcncccanaaacggatncaaactatgaanaacagaagtgggcagccantaaggcagnntctcaaaagncatactcgccaggantctctanggcaaggagaaacaaccnngntggacaattantcaattccaaactntanccattatgccaanctggaagcttggcaaaactagnnatcngctnganaaaccaacctatatggggcatgcggaacccngangnantnccccgngcaaaaacgnnggctancaancgantnagcanaaaanatggcnnncngtnnaagnaaacctngccctaanaaaaccn

SEQ ID NO: 5203 - DNA, 1837 bp, Homo sapiens
  misc_feature 12, 21, 22, 24, 25, 33, 55, 56, 67, 72, 75, 77, 79, 81, 86,87, 90, 93, 96, 98, 99, 100, 104, 106, 112, 114, 115, 123,126, 127, 136, 138, 142, 147, 151, 156, 160, 163, 173, 174,178, 179, 185, 186, 189, 190, 191, 193, 194, 198, 203: n = A,T,C or G
  misc_feature 205, 207, 209, 212, 216, 217, 218, 223, 225, 232, 235, 237,239, 243, 245, 247, 250, 256, 259, 261, 262, 263, 264, 266,274, 279, 286, 288, 290, 291, 301, 303, 304, 307, 309, 310,311, 314, 316, 320, 321, 328, 329, 332, 341, 342, 349: n = A,T,C or G
  misc_feature 352, 353, 354, 360, 362, 365, 371, 372, 373, 374, 377, 378,382, 391, 392, 399, 412, 420, 433, 435, 437, 441, 442, 446,449, 451, 453, 459, 464, 465, 475, 480, 481, 486, 488, 490,491, 492, 497, 499, 500, 502, 506, 508, 509, 512, 518: n = A,T,C or G
  misc_feature 520, 522, 523, 524, 525, 529, 533, 541, 543, 544, 548, 550,551, 555, 556, 560, 568, 570, 571, 572, 582, 583, 589, 592,599, 602, 610, 611, 614, 615, 616, 621, 622, 628, 630, 631,636, 641, 644, 646, 651, 656, 657, 659, 660, 663, 664: n = A,T,C or G
  misc_feature 667, 673, 675, 676, 677, 684, 685, 686, 687, 691, 692, 694,703, 712, 713, 732, 735, 737, 741, 748, 751, 752, 756, 757,760, 761, 762, 764, 773, 776, 777, 778, 779, 783, 784, 785,786, 795, 796, 798, 807, 808, 810, 815, 823, 826, 831: n = A,T,C or G
  misc_feature 833, 836, 842, 851, 854, 858, 873, 875, 876, 878, 879, 884,887, 888, 893, 896, 897, 907, 909, 911, 913, 914, 919, 923,924, 936, 941, 949, 951, 953, 954, 961, 965, 967, 975, 987,993, 997, 1003, 1005, 1006, 1008, 1016, 1019, 1022: n = A,T,C or G
cgggtttggggnttttttccnngnntggggggnaaaaaccccccctttttttttnngggggggacanaaagngancntncnctcgnngcncgngcngnnngcgngntgcctnanncgtgggcncgnntgtgtgggngntggncgtantgtncgctncggngcngcacagatgnngcgnngggggnngtnnngnngagncagtnangncngcnagcnnnagtgntnttttttngcnangncggncnanggngagagntgncnnnngngggggggnatggnagcaggngngnngcgggggggngnnggngnnncgngngcgnnaggaggnnggnggggctggnncgggcgnggnnncgcgcncngtnggcccnnnngtnncggngtgggggcnnaggtggncgggggcaggggngttactgntttggcgcgaggngngnccanngcanggnancngagtgngaganngggcggcggnaaggnngtggnancnnngtctngnngncggngnnttnagacgntncnnnnggangagngtgagcgngnnggcngnngagnntgcncacgcagngnnngggagcgagnngctggngangtatgancgnggggcggnntgnnnggcannataggntnnagtgngacangcncnggtcngaggnntnngtnnatngctcgntnnnatggtgnnnngcannangtcgagggncgcgcgctnnaggaagtgtgggggtgtcnctntntgtngggttanggnngagnnctnnntnagagctcgnggnnnngccnnnnagagtcgcnncncgaggtggnncngacgngccacgangtncacgngngtntggtgnaagcatgtnggncgtnacgcatcgtacgcgntnngnngttgncgnnacgcnctnnggggctcgancntnanngcgangganngggggaagggcngcggnccacggtntncnngactggngtgngngaggtctngtgcggtggggntagtgngacntgcagncnntnctcagganagnggngggactggtagctnacagctnngntattnggacggcgngcgannggtgnnantgtgtgncgngngnanggnggncgananantcntcgcggntcntgagacggagctngngagcggnggannggngngagngnngaganntcgtgagcnaggagagggagcaggcgntgnnagcngngagngggtgtgcnnnangtacagtgtgnaggncagagnncgcgantnnggagtnccgcncgtntcggnngctntgacgtgtntntcggtntngggggtngcgtcngtgnnnncngngtntnnnnagggcgngnacgtgnntntgtggggngcatagtatnggcgctnnancnctgtcgcngcgagaggtnagtgngtntgcnncgcagngtggngnagtganggcgggtgtngtgannnggggtgtnncggtnagnggcgngggacgtgntgnganntgcgngnnnaagcacggagcgngngnntcgcgcggcgagacnggagattnngangnngaggcncgngcncncggaggtangcggtcntngaggagcnngnggtatggtngcgcangcgntnttgngcgcntngtgactgggagtncgctntngcgntagagtacananggaatgtnatctntcnggnacgggatgganacgngtggnganagctgcngnctcgagggacanatggcgcgcggtcggnagnagtgngngnagcgcggacgngggtctgagacgcgnnggtggggnnnttnganangtanngncntgngngnggagnnngnntgatgcngggagcggngtatatnatggngnt

SEQ ID NO: 5204 - DNA, 842 bp, Homo sapiens
  misc_feature 3, 6, 10, 13, 34, 38, 40, 59, 60, 67, 85, 89, 91, 94, 95,99, 102, 108, 109, 117, 119, 121, 124, 126, 128, 131, 133,134, 141, 155, 156, 157, 158, 161, 165, 169, 176, 182, 185,191, 196, 199, 223, 229, 231, 232, 237, 241, 242, 252: n = A,T,C or G
  misc_feature 253, 266, 283, 291, 295, 301, 314, 315, 316, 317, 318, 320,321, 323, 326, 329, 330, 331, 332, 333, 336, 339, 341, 346,350, 352, 356, 359, 360, 361, 362, 366, 370, 378, 384, 387,396, 397, 398, 410, 414, 423, 428, 432, 434, 435, 437: n = A,T,C or G
  misc_feature 448, 451, 465, 478, 482, 490, 495, 514, 518, 520, 527, 531,541, 547, 550, 551, 554, 557, 559, 562, 566, 574, 578, 584,600, 604, 605, 606, 607, 622, 627, 640, 649, 652, 660, 669,670, 672, 674, 679, 688, 691, 693, 695, 703, 711, 713: n = A,T,C or G
  misc_feature 721, 724, 730, 737, 741, 746, 747, 748, 749, 752, 758, 761,776, 782, 792, 796, 803, 805, 812, 815, 826, 828, 836, 841,842: n = A,T,C or G
gtnacncccngcntttctaatgcttggcgatcgnactntntgcaggtatcccatcgatnngaatacngcacgaggcgagtcaaantgtntntgnnagcnganctcctnncgggaccngngngcngngntgncnntgatgcnagggtggtcatgtnnnncancaangccntttttgntggccnccnctttgntgaanganggatgtggaagaatgagcttgatncttgtnanntgccnaatnngatggccaanngattgtatagacnctcccatatggtgacanacccagtntcancttaantgaatgtactcannnnncnngnccntcnnnnntcnagncnccttncttngnactntannnntctntatntttatgantacccntantgtggtgcnnncttgaggggganacanatcctatgntcatncccngnnanctacttttggnccnccagatccccatgnttttttccatgcnctgncaacttgnatctnttaaatacatagggggtgnacgngngtataantacnaactcttctngggtgntgnnganaantntgnccangcctgatntcantctcangtgtttagttaaaacnattnnnnatacacctttttttnacccntttattggggtcnaaaaaaaanttncgtcccgntttggaaanntngnttggnccctttttnttngnancaatcccngaaccttngntaaataantanccctcntttgaanatantggannnngcncccttnccntcgtttttggtcgcngggaanaaaaaaaggnctcntttttcntngggattnttnttgggggctcntnggcctttnttttnn

SEQ ID NO: 5205 - DNA, 766 bp, Homo sapiens
  misc_feature 3, 6, 7, 8, 9, 11, 12, 13, 14, 15, 16, 21, 22, 23, 32, 33,34, 35, 36, 37, 39, 40, 41, 42, 45, 47, 53, 626, 656, 723,727, 766: n = A,T,C or G
ggnttnnnncnnnnnnttttnnnagagccggnnnnnngnnnnttnanaatagncaggctacttgttctttttgcaggatcccatcgattcgaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcaattttagtgcagccctnaacgcaccaatagagaagactgacttcggnatcttcaggatgtaactgggaataaaggatgtttctgttggacatgtactgaaaattaacacatgtngtanccttaaaattttagactttctcgacatgaggctggtacn

SEQ ID NO: 5206 - DNA, 746 bp, Homo sapiens
  misc_feature 7, 43, 44, 56, 68, 78, 81, 83, 85, 95, 96, 104, 108, 114,123, 129, 144, 168, 175, 196, 200, 216, 232, 243, 246, 256,259, 273, 289, 299, 311, 322, 345, 350, 374, 387, 389, 390,395, 423, 427, 428, 431, 436, 438, 442, 444, 450, 451: n = A,T,C or G
  misc_feature 458, 467, 469, 485, 488, 497, 501, 505, 510, 528, 531, 535,536, 545, 549, 551, 555, 564, 567, 569, 574, 577, 582, 584,588, 599, 603, 606, 620, 622, 628, 630, 655, 657, 679, 680,687, 690, 700, 701, 708, 717, 725, 726: n = A,T,C or G
tttgaancctttgaaacccttttgcatttgaaacctttgcaannccgctttttgcnggaccccatcgnttcgaattcngcncnanggcaactttnnggaattcntacngttgangactgccanatgaanacctactttcaactnctttttcccccctctagaagaatnaaatcgnatcttttacttacctctggcnaaanaaagaaaaatgaaaanagttcatttattcatnctgattctatntancaaaactgantgncaaaagtgccttcngtccacacacacaaantctgcatgtnttggttggtggntctgtcccctnaagaacaagctacacatcatggntacantataaattctcgatctaccttaangatgaggactccntnnagaancatttgctattgattaatacactgcttnggcnngcnagttnancatncntgcagnntgtctanagaccacanangggccttttgtttaangangaatgatgnttanactnttttnaaaacctataaaatgggnccntttnnactttgttnacantnaaangcataagtnggncnctggncantaccnantatnaaaatgtctancttnggnaagcctcatgaaangngggagngntagaccgtaatactggcccaaaggngngagactttaacttctgtgcacnncctgggncanaccacctgcnnctgcctntatgggttnacgagctnntagacagaagaacagtttgc

SEQ ID NO: 5207 - DNA, 900 bp, Homo sapiens
  misc_feature 16, 71, 85, 113, 115, 116, 120, 315, 342, 385, 390, 399,428, 437, 443, 476, 477, 480, 494, 496, 498, 508, 519, 526,533, 541, 558, 564, 571, 597, 600, 611, 614, 619, 621, 627,640, 644, 646, 655, 658, 672, 678, 684, 692, 702, 703: n = A,T,C or G
  misc_feature 704, 705, 710, 718, 719, 727, 729, 738, 752, 769, 781, 782,791, 794, 795, 798, 799, 806, 817, 820, 824, 825, 834, 835,843, 847, 850, 857, 859, 867, 877, 888, 889, 890, 897, 899: n = A,T,C or G
tcttactttctttttngaaacccttttacgcaaggatcccatccgatttcgaattccggcacgagcagagnagccctttcccagnaaagcctggacacccgtgtctttatttngnnagcncgtgctagttgcttttaactggccgacaggtggctggtatttagcccctgaattataaggaaagataggacagaataacaagcaaaaggggtccgatggtctcaccactcaacgctaggcgaaggtctcaccgttcggcgataggcgatagtctcaccgctcggcaattgtctcaccacttggtgataagtgaangtcccttcgtggtcaccaaaatgtgtncagaattggtgggttcttggtctcactgacttcaacaatgaanccacngacactcgnagtgagtgttacagttcttaaaggcagcntgttccggnagtttngttccttcctgattgttccatatgttgtttcannaanttccttcctttctngntngggttccctnggtcttcgccntgggctncaagganatggaaancctgcaaaaccctttcnccggtnaaactgntttaccagcctctttaaaatttaggnccnccatttttggngangtttngntttccntttcccttccccnattngnggccttccnctngggccttctccttnggcccnttccanggtaattnaaaaaccttnnnncaganccttttcnncacttgcnancttgttttnacaaaccttaattnaaaaggccccttggtcngaaccccccaannaagtggaanccnnttnncccaaanaatttaatttngcnaaannaaccaatanntaacccanaccnttntcaccancntgttttcnaaaggggtancccctaatccnnnatttgcncnt

SEQ ID NO: 5208 - DNA, 1565 bp, Homo sapiens
  misc_feature 5, 8, 9, 12, 13, 14, 17, 18, 22, 23, 24, 25, 26, 28, 29,36, 37, 44, 51, 61, 62, 75, 78, 87, 105, 106, 107, 115,128, 132, 145, 147, 165, 170, 171, 178, 181, 199, 201, 204,205, 209, 212, 214, 225, 231, 240, 250, 255, 259, 277, 279: n = A,T,C or G
  misc_feature 280, 281, 298, 307, 312, 316, 319, 320, 322, 325, 326, 330,335, 339, 343, 347, 348, 351, 352, 353, 355, 361, 364, 366,367, 369, 370, 382, 384, 385, 389, 394, 396, 399, 403, 405,411, 412, 418, 421, 430, 432, 433, 434, 436, 441, 442: n = A,T,C or G
  misc_feature 444, 446, 447, 449, 451, 452, 453, 457, 460, 462, 466, 476,479, 480, 490, 492, 494, 496, 499, 500, 505, 506, 507, 509,511, 515, 518, 519, 521, 522, 524, 526, 530, 531, 533, 534,539, 541, 546, 551, 552, 555, 558, 559, 561, 562, 566: n = A,T,C or G
  misc_feature 573, 576, 580, 582, 587, 590, 591, 597, 598, 602, 603, 604,605, 609, 613, 617, 621, 625, 632, 635, 641, 644, 648, 649,651, 653, 658, 659, 661, 665, 669, 671, 674, 679, 685, 687,690, 700, 701, 708, 709, 711, 718, 719, 738, 739, 746: n = A,T,C or G
  misc_feature 747, 749, 751, 752, 756, 759, 760, 762, 771, 773, 775, 776,788, 791, 796, 797, 799, 802, 806, 810, 812, 814, 815, 819,822, 823, 828, 831, 832, 834, 835, 838, 839, 851, 856, 865,867, 868, 869, 871, 881, 883, 888, 900, 901, 905, 909: n = A,T,C or G
  misc_feature 928, 933, 934, 947, 948, 949, 953, 954, 955, 956, 958, 968,972, 973, 979, 981, 982, 983, 987, 990, 994, 997, 998, 999,1003, 1009, 1013, 1016, 1018, 1019, 1026, 1035, 1036, 1042,1046, 1049, 1050, 1054, 1056, 1058, 1065, 1071, 1072: n = A,T,C or G
ttttnggnntannnganncgannnnnannctcaacnnggggggnaaaaacncccccacggnnagggccagggggnaanccccaaacngggaaaacccgggaaaannnacggggcnaacggtagggggngggngggggccccgggncnctggggggggggcagaancaaanncaagcanacngggttttttttttttttnanaanngggnccncnacaggggcggnggaaangccacacgngggggggggnggggnagtntgtggtctgaaaaaaggncnnngggggggggggctactnaaaagccangagcnacanganncnagnnaacncgganacangggnacanngcnnnanaggaanccncnncnngagaaggccggnanngccncgagngnagncgcncnacgagnnccaccngcnccaaaacancnnncnaccannangnngncnnnaaanaanangaangcgcaaacanacnnacgcaacgcnanananaannaaagnnngncngaancgnncnncncnaacnncnnacacnancgggnaagannganggnngnncacnaacaacnagngcangngaganaanncagcanngagnnnnagcngacncagnaccncacnacaaagncanaggggnccnacanncnanaaaannanacgnaagncncanacacncaagancnatngaaaaacacnnccccaannancaacaannaggatacccacaagcagannacaccanncnanngccnacnnanacgcccagnangnnacaatagacacnacnagcgnnancanaganaacncncnngctnagnncgaanaannannagnncaagacggacgngaaancgacacaangnnntncacacaaaancncaagnagactagagganncgancacngatacagacaacacacagnacgcnnggcacgagacaannnaagnnnngnaagacgcganacanngacagnannncgcncancgangannnacgngacacnacanagngnnacacatngaagcgacnncagacngagngcnnaagnanangaagcgnacgaannngcananananagacanaacagaggagngagngnaccagcanacacaagnnaaanagagcannnacanaaccnacacgtnnacacccggggcanagngagntnnacncnngaggncacgcgacanagagnaggnacacacacngacaananancgacacagacgngaccnnagacangagagngcacgacaaanacncgnncngcagngacncnccagnacancgcgaacacgacgnngacnngagaaanagaanancaagacanangncnaananacaacaganaagngnagacncanacananagantngngacanatccgacagagacacganaccncaanacngacgcgngannagnnanngagaagnnnnccngcgccgacnnnananngnnacaantcgnaacgangagagcgccggangagangagcacacacaacancacntnnnacnacagcgangaagaganacgngagncnagagacagaat

SEQ ID NO: 5209 - DNA, 1052 bp, Homo sapiens
  misc_feature 2, 17, 18, 24, 25, 29, 31, 32, 43, 45, 46, 47, 49, 55, 73,76, 77, 80, 81, 85, 87, 88, 90, 91, 94, 98, 99, 103, 104,117, 118, 121, 123, 126, 129, 132, 138, 139, 143, 144, 147,149, 160, 162, 166, 168, 172, 178, 180, 182, 183, 185: n = A,T,C or G
  misc_feature 189, 190, 191, 198, 200, 202, 206, 207, 208, 211, 212, 213,220, 221, 233, 234, 235, 236, 241, 249, 251, 257, 258, 260,262, 264, 266, 272, 275, 279, 281, 283, 284, 287, 294, 297,298, 299, 300, 303, 307, 310, 311, 312, 313, 314, 323: n = A,T,C or G
  misc_feature 324, 327, 328, 329, 332, 334, 339, 341, 342, 343, 345, 346,347, 348, 349, 353, 356, 359, 361, 362, 363, 365, 368, 369,372, 373, 377, 378, 379, 383, 385, 386, 389, 395, 397, 402,406, 407, 411, 412, 422, 425, 427, 434, 436, 441, 443: n = A,T,C or G
  misc_feature 444, 446, 447, 448, 449, 450, 460, 461, 464, 468, 471, 474,475, 484, 489, 493, 494, 496, 500, 511, 512, 513, 522, 529,548, 551, 552, 556, 558, 564, 579, 582, 584, 585, 587, 589,591, 592, 594, 595, 599, 601, 603, 604, 606, 616, 618: n = A,T,C or G
  misc_feature 620, 621, 628, 629, 630, 635, 637, 645, 646, 648, 662, 679,681, 687, 692, 694, 695, 697, 698, 702, 703, 705, 712, 720,723, 725, 727, 733, 738, 739, 740, 743, 744, 745, 748, 750,754, 758, 759, 760, 761, 765, 768, 785, 787, 788, 790: n = A,T,C or G
  misc_feature 793, 798, 799, 800, 806, 808, 809, 811, 812, 816, 818, 819,820, 822, 825, 828, 829, 832, 833, 834, 837, 843, 844, 845,846, 847, 852, 855, 856, 857, 861, 873, 875, 877, 880, 881,882, 885, 886, 887, 890, 891, 893, 895, 898, 901, 902: n = A,T,C or G
tncgtgttgtcccttgnnaatccnnaaantnncttgccatcgnannntngcgacncggaggcaccgacttcangcnnggnnaacncnngnngangacnntganngtttttgacagcnnacngnganctngancacgtnngggnngcngnagaaatgcacncncgcncncagnacgctnangnngntacnnnacttgangnanaagnnnaannnaccgccnnaacagaaaacgnnnnggtcngacgccantncaggcnngnanananactganganagananannccngggacgntcnnnncangaanagnnnnnggacatgannacnnnagnanaggcngnnnannnnnacanaancgngnnnanacnnatnngcannnagcnanngcncacctntnacacnaagnnagannaaccgcgcgngantngacccanancaatnanncnnnnngcttcactcnnagngcanacntgnntaagacggnagcancccnncnatcncgacaggccgnnncagagaggnatctctnacgacacctagcgcatacntanncacnanacaggnccgagcagaagatcnctnannancnanntnnatcncncnnanaacatgccgntntnnacccctnnngtcantntgacacannanagtacgataaatgntccagaccgatagagcnanctctcncacgntnngnnggcnngngtagacnccaaagcnacngnancgcatntacgnnnagnnngcntnactncaannnngctnacnccgtacgacagcaccantnnantgngtcgnnnacaacngnngnntggnannntnggnaanngannnccntatgtnnnnncgccntcnnngaantcgaaagctggncntngcnnncgnnnggnncnanccnaannannacnnngtnancngngncgaannnatannagnattnancnttcncgnctanctncacgntnngntgcnacaccagnggnntnncnnnngatnaancnantgangagtccgccgnannnnncnnannnnnagcncnnnancccnnnncc

SEQ ID NO: 5210 - DNA, 714 bp, Homo sapiens
  misc_feature 2, 11, 12: n = A,T,C or G
gntctctattnnaatcgcttggctactcgttctttctgcaggatcccatcgattcgaattcggcacgagagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacataaggccattgcctggaagccccagagctttcctctgtttgtatggcccgttcatgtcccaggcattgcaacacaaactcaagatttcaccacaacatgacaagcattttcctactgatattag

SEQ ID NO: 5211 - DNA, 685 bp, Homo sapiens
  misc_feature 11, 12, 21, 48, 51, 52, 56, 61, 69, 70, 71, 72, 74, 84, 92,94, 95, 99, 102, 104, 108, 126, 127, 133, 135, 139, 143,145, 152, 153, 161, 163, 166, 168, 169, 186, 189, 192, 193,198, 199, 212, 232, 247, 261, 265, 268, 269, 278, 280: n = A,T,C or G
  misc_feature 283, 293, 297, 298, 300, 302, 303, 306, 308, 309, 315, 322,331, 336, 337, 338, 342, 345, 346, 349, 352, 354, 360, 363,368, 373, 386, 387, 405, 407, 418, 431, 435, 436, 439, 448,450, 453, 457, 462, 473, 474, 478, 514, 519, 520, 524: n = A,T,C or G
  misc_feature 529, 531, 535, 538, 541, 543, 549, 553, 558, 565, 567, 573,577, 579, 581, 582, 586, 589, 590, 601, 603, 605, 606, 608,619, 628, 629, 634, 637, 641, 642, 644, 656, 657, 658, 660,663, 667, 672, 673, 674, 677, 678, 680, 681, 684: n = A,T,C or G
gcctcacgctnntgtactttngttgctgtgttgctgtgctgtgtgccnctnngatntgacnactacacnnnncnaaggtgcccngcctcctncnngatngtngnaagnatacttgacatatggagnngcattngnctcngccnangtgaaanngattggantnatncnnatgcggggttggaaaanacntgnnggggnnatatactgtgacngtccgccacataaatcggtngccatatgaactatngaaggctggttaangacntannctggctacnanatngctgatgtanatgnncnanntgngnnacatanatctggntgtcaacgnatatnnnaatntcnnggnacngngaactnatnctggngtgcncacagagctctcnngatttacttatcactatnanatatggggtantgcggaactctangcanntantgcttcacntnatnttgnaaaancatatggcatnntcantttgcttgtaaagcacttcattcttaactgctcctnaggannggtnttccncncaanggnatntnaaaaancagntttgnttccttngntggcgnaccnantnnttgnganntcttccccagngnannanaaggttacttnaggttccanncctcnttntaanncnttataatgaatnnncnctnaaanaaaannnaanntnnctnt

SEQ ID NO: 5212 - DNA, 720 bp, Homo sapiens
  misc_feature 10, 17, 18, 98, 546, 566, 624, 648, 650, 716: n = A,T,C or G
tccttttcanttcactnncttttgttctttttgcaggatcccatcgattcggtgggaactggctcaggctggattactcttgctgctgtcttgctgtnctgtatgccactgggatctgaacactaaacattgctaagaaacccacccaccaccaggatatttggaagtaacttcacatatggaaaagttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcnacaccatatcatggggagcnagaagaaaaggtgttccttcccatggatatttgtatgctgcatggtgtttcacaagangactttttaccggaggaaccaagntnaaaatgtgagagatgtaattatatgacattgccagtcaaagcccacttgccctaaagcatgctagncctt

SEQ ID NO: 5213 - DNA, 808 bp, Homo sapiens
  misc_feature 4, 7, 64, 65, 90, 100, 187, 189, 209, 280, 306, 320, 327,349, 359, 461, 501, 517, 583, 624, 642, 649, 653, 677, 686,695, 697, 711, 716, 718, 726, 728, 741, 743, 744, 756, 758,770, 784, 790, 797, 808: n = A,T,C or G
ttanttncatcagctcttgttctttttgcaggatccctcgattcgaattcggcacgaggttttnnttttttttttttttttttttttttnggggtacggnagcacttttatttttccttacacaatgacgtgttgctggggcctaatgttctcacataacagtagaaaaccaaaatttgttgtcatntnttcaaagaatcgagaattgngtacaaaaaaaaccttacataaattaagaatgaatacatttacaggcgtaaatgcaaaccgcttccaactnaaagcaagtaacagcccacggtgttntggccaaagacatnagctaanaaaggaaactgggtcctacggnttggactttncaaccctgacagacccgcaagacaaaacaactggttcttgccagcctctaaagaaatcccagaacactcagccctgacacgttaataccctgcacagatcanaggctggtggcccacagactcaccaagccacagacttgtntttcacaagcacgttnttaccttagccacgaagtgccaagccacacgttctaaagggtgaactcaaagatatgtacagggtnttaaacaaatccaaggggaacagttaacttcaatacaaggncaaaatcagcacaaggtntacaatncagngctgatttaaatacaagctttaanggcaatttntttttgaangntttttccatttcgngaggntngccatgangngggtgcattttgncnnggggcaaatttntnttttcaattaanccatgccagaaaangctccncatttgntgggtccgttn

SEQ ID NO: 5214 - DNA, 726 bp, Homo sapiens
  misc_feature 3, 146, 166, 227, 314, 316, 447, 543, 552, 564, 573, 580,624, 639, 670, 690, 691, 694, 695, 697, 699, 700, 702, 703,704, 706, 708, 715, 716, 725: n = A,T,C or G
ggnttttaagatcagctacttgttctttttgcaggatcccatcgattcgccagtccatgggcaattggcagatcaagcgccagaatggagatgatcccttgctgacttaccggttcccaccaaagttcaccctgaaggctgggcangtggtgacgatctgggctgnaggagctggggccacccacagcccccctaccgacctggtgtggaaggcacagaacacctgnggctgcgggaacagcctgcgtacggctctcatcaactccactggggaagaagtggccatgcgcaagctggtgcgctcagtgactgtngntgaggacgacgaggatgaggatggagatgacctgctccatcaccaccacggctcccactgcagcagctcgggggaccccgctgagtacaacctgcgctcgcgcaccgtgctgtgcgggacctgcgggcagnctgccgacaaggcatctgccagcggctcaggagcccaaggtgggcggacccatctcctctggctcttctgccttcagtgtcacggtcacttcgcanctaccgcantgtggggggcanatgggggtngcagctncgggacaatctggttacccgtcctactctggcaactccagcccngaacccaacccccanaactgcagcatcatgttaatctgggacctgncaggcaggggtgggggtganncannananntnnnangnaaatttnncttttaaant

SEQ ID NO: 5215 - DNA, 767 bp, Homo sapiens
  misc_feature 14, 15, 30, 33, 37, 38, 44, 45, 52, 54, 55, 58, 59, 62, 75,78, 83, 123, 181, 242, 248, 294, 305, 310, 316, 320, 329,330, 338, 343, 344, 360, 364, 377, 383, 384, 404, 425, 436,437, 441, 450, 452, 470, 476, 482, 490, 499, 503, 507: n = A,T,C or G
  misc_feature 514, 516, 527, 544, 557, 560, 563, 574, 582, 587, 593, 601,611, 618, 621, 625, 646, 649, 658, 659, 661, 671, 675, 688,689, 691, 692, 696, 699, 703, 704, 709, 722, 734, 737, 741,757, 764, 766: n = A,T,C or G
tgggggttttatanncagctcttggctttngcngttnnagaganngctactngnnctnnagncgagctctacatncanaactnatcaatgctgatgtggctaaatacctagccttttacatgnctgccccttccaggctcacatcattttatttcttttttctttgtctggtggttttttntttttgaggcaggagaattgcttgaacccaagaggcggaggttgtggtgagccgagattgnaccttngtactccagcctgggcaacgagcaaaaaactctgtctcaaaaaaanaaacttgcacntgatnaaaaanggtnttcatgacnnagcatgcncattnnctggcggacatttccngaancagaccctgttantccttnnacttacctgctggatttttnaagcgctaaatttataacttntttgaaacaannactngtgtaattntnccatttgggggcaaactntattcntgtgancattattnaatcttggntgtnaatntattgananccccttaatanttgcaatgggtcaaganaagctgccacggngtnatnatcctctttanattgggcntccantattantgatgcantcatgacttntggtttnacntgtntgggatggggccaataaatgnatncttcaagcnngncaaaaaaaancccnggattttgattcnnanngggnacntggnngtttnctgacttttaccntaaattaccttngtntggntcttcatttaaaaaanaaacgcntnt

SEQ ID NO: 5216 - DNA, 830 bp, Homo sapiens; identical to SEQ ID NO: 5176
  misc_feature 5, 7, 25, 26, 37, 40, 53, 57, 69, 96, 97, 103, 110, 112,119, 120, 143, 166, 180, 250, 255, 271, 281, 380, 381, 384,392, 399, 423, 424, 452, 485, 495, 504, 525, 535, 537, 538,539, 543, 544, 559, 561, 563, 565, 572, 583, 585, 587: n = A,T,C or G
  misc_feature 592, 601, 602, 611, 619, 626, 631, 637, 638, 648, 651, 653,654, 656, 663, 667, 674, 678, 681, 683, 688, 689, 694, 699,700, 705, 709, 722, 724, 728, 732, 734, 736, 742, 751, 761,762, 763, 771, 772, 775, 782, 791, 801, 805, 812, 820: n = A,T,C or G
  misc_feature 829, 830: n = A,T,C or G

SEQ ID NO: 5217 - DNA, 733 bp, Homo sapiens
  misc_feature 3, 4, 12, 13, 15, 358, 464, 706, 707, 727, 731: n = A,T,C or G
gtnntttcaaanntnaggctcttgttctttttgcaggatcccatcgattcgaattcggcacgaggtctcgagtttttttttttttttttttttggaggagataaaccaattttatgtctatcatgttatacaaaaatctagaaataatagatttgtacagaaaaaaatgataataaatgagaacacaaaacatataatttaaatttggtattttttcccccatgatattaggatgataatcatttcaaagcacatgtctagcttcagagtaggatttgttcactggccaaagcctgccatgaaactatggctttcagcatctgtctgctctactggctcttgacaaaactcttgaggncttcaagaaaagtaatgtactcctggtgctccagggctgtgctgagctccaccagctcatctgcaaaagtgttgtccacccctcggtcggcaaggaaatccattangtggtcatataaggcccagtccaaggaatctgtgttgagtgtataattagtatccttccattcagactcgccagtggactgaaagctaacttccctgatagagaagatgtcctctcagcctcgcttcttgtccacctcatcctctggataatgaccgtccacacaagggcccttttgccatcatcattctttataacttcacccccgaaatttgggaagttgatgtcagttcaggctcctgnncttcaaccttctggccttgncgangg

SEQ ID NO: 5218 - DNA, 779 bp, Homo sapiens
  misc_feature 14, 23, 28, 107, 164, 204, 240, 241, 249, 258, 302, 319,353, 365, 366, 373, 378, 382, 384, 386, 390, 402, 420, 433,454, 457, 485, 507, 535, 543, 544, 560, 567, 579, 581, 584,587, 601, 603, 609, 631, 642, 644, 652, 656, 662, 664: n = A,T,C or G
  misc_feature 666, 672, 679, 684, 685, 686, 689, 690, 695, 703, 704, 705,711, 712, 716, 717, 721, 725, 726, 730, 731, 735, 737, 740,743, 745, 752, 763, 765, 773: n = A,T,C or G
tcacagttttttcntccccgaancgttngaaaattcctgcaggatcccatcgattcggtggaactggctcaggctggattactcttgctgctgtcttgctgttctgnatgccactgggatctgaacactaaacattgctaagaaacccacccaccaccaggatntttggaagtaactgcacatatggaaaagtaaaagactcantctctgagaaaacaataggactgatgcgaatgcagnnatggaaanaaactgtgnaagatatatactgtgacaatccaccacatcagcctgaggccatngcactatggaaggctgntaaaagacataatctgactaaaacgatggctttntgaaaatcgtcnnattaaanggaanaaananantctnggatgacaaaancatatcgtaattatcaanggaactggaaaanttatgctgaaaacacacaganctntcttctttacttaacactagaaatatanggtataaaggatcttcatgcanatcatgctgcaagccatattgcaaaagnacaaggcnntgtcacttgcttgganagcaacnccatattcatgngnagncanaattaaaggggctncnttcctnatggaatattccgtatgctccnattggggcttncncaatgaangacntttttntncnggatgnaacccanctatnnnaanntggtntacaacannntatatnntttnnaacntttnncccnnccananccnacncnttggccnctctaaaaagnantgcttctngtcccg

SEQ ID NO: 5219 - DNA, 1165 bp, Homo sapiens
  misc_feature 2, 3, 7, 13, 14, 15, 21, 25, 29, 33, 34, 37, 39, 41, 42,44, 46, 47, 56, 59, 64, 66, 68, 69, 70, 72, 74, 76, 83,84, 85, 90, 91, 93, 94, 97, 99, 101, 103, 107, 108, 109,113, 122, 123, 128, 136, 140, 146, 148, 149, 156, 159, 162,164: n = A,T,C or G
  misc_feature 169, 174, 177, 179, 180, 182, 185, 186, 187, 190, 198, 200,201, 213, 214, 216, 218, 224, 226, 227, 229, 232, 233, 240,243, 245, 249, 251, 254, 257, 258, 264, 272, 278, 288, 299,307, 318, 324, 327, 329, 333, 335, 336, 343, 349, 352: n = A,T,C or G
  misc_feature 354, 359, 362, 373, 378, 380, 384, 388, 392, 394, 395, 396,406, 414, 420, 429, 431, 433, 434, 442, 443, 445, 446, 448,449, 451, 456, 459, 469, 470, 472, 483, 486, 487, 490, 493,494, 495, 496, 499, 501, 514, 515, 517, 519, 521, 522: n = A,T,C or G
  misc_feature 534, 546, 547, 548, 551, 555, 558, 562, 564, 569, 574, 578,586, 588, 598, 600, 603, 608, 609, 624, 633, 636, 640, 647,649, 660, 662, 671, 674, 677, 681, 682, 696, 697, 700, 702,708, 710, 712, 735, 741, 743, 757, 761, 764, 765, 790: n = A,T,C or G
  misc_feature 791, 794, 796, 797, 800, 803, 804, 805, 806, 807, 813, 820,821, 828, 829, 831, 832, 845, 847, 849, 851, 862, 864, 868,876, 880, 888, 889, 904, 909, 913, 919, 927, 931, 936, 946,950, 960, 972, 974, 978, 983, 998, 999, 1001, 1009: n = A,T,C or G
  misc_feature 1011, 1012, 1019, 1021, 1026, 1028, 1029, 1032, 1042, 1043,1050, 1063, 1065, 1066, 1067, 1068, 1071, 1074, 1078, 1081,1085, 1089, 1092, 1095, 1100, 1103, 1104, 1108, 1116, 1127,1128, 1138, 1142, 1145, 1148, 1156, 1159, 1160, 1164: n = A,T,C or G
annaaancacacnnnccacancaanaaanacanncanananncnannaaacacaanacnaaccncncnnncncncnacaaacnnncacanncnncancncncncaannngcgngcttcaacnnatggnaagccctnggcnacacgnannaacagcncgnaancnacgcnacgcnccnanncngannnaanacacccanannacacgagagagnnancnaacacnannanacnnacccgcnccnanaaancnggnccnngacgangccgacgnacacanccacaaaacncgacaaccccnaacaaaangcaaaacgcgnaaaganccnangacnannaaaaagncgccanganancaacnagnacacacggacnaaccngnaccngcanacancnnnccacaaaccncgagagcnaccccnacgcagcancncnnccgcaaanngnnanncnacacnccnagccccagannangaacccagcanccnnaancannnngcncnacgaacaacaacnnananannaacccccagacncacacaaccagnnnccnacgnganacgncnacccncaccncacnggaacaananaaccaggccncnaanagcgnnaacaacccaaaaagnacccccccncanacancaacagnanacacacacccncncgggacaancanacncacnnaggaaaaccccaannggngncaaatnanancccccacaacacagcaccaaaangccaancnccaaaacaaggcgnaacnacnncagccgcgacgacacaaacaccacnnaancnnaancannnnncagggncaaacanngcaaaanngnnggcgacacactanancngngacaccccaananaatnagccccanggancgacacannaacagcgagccgaanccggnaaanaaacgnaaaaaccnggcncaccnaccaggcacnaccncaacaccacngcaaaaaaccancncccnaatcnaaacaccccaagaanngncacacacngnncacaaangnacccncnnaanaagggccaanngccccangaaccccccacancnnnnccncangaanaanaggncccnacncanggccnacnncaangacacacnaccccaagaanncaccacagcnaganaancancaccccancanngaanc

SEQ ID NO: 5220 - DNA, 725 bp, Homo sapiens
  misc_feature 4, 12, 15, 310, 333, 341, 430, 471, 545, 557, 585, 594, 603,627, 632, 633, 645, 648, 654, 658, 666, 669, 673, 679, 692,693, 694, 703, 712, 713, 723, 724: n = A,T,C or G
tttnacactttngcnacttgttctttttgcaggatcccatcgattcgaattcggcacgaggttttttttttttttttttcacgcttaattcactttatttttcttgtataaaaaccctatgttgtagccacagctggagcctgagtccgctgcacggagactctggtgtgggtcttgacgaggtggtcagtgaactcctgatagggagacttggtgaatacagtctccttccagaggtcgggggtcaggtagctgtaggtcttagaaatggcatcaaaggtggccttggcgaagttgcccagggtggcantgcagccccgggctgaggtgtancagtcatngataccagccatcatgagcagcttcttaggcacaggtgcggagacgatgccagtgcccctgggtgcagggatgaggcgtaccagcacanagccgcagcggcctgtcaccttgcaagggacagtgtggggnttgccgatcttgttcccccagtagcctctgcgcacggggacgatggagagcttggccaggatgatggccccacngatggcggtggncacctcctgggagccacttaacacccanaccgacttnggccaaaanggccttaaaccggtaaaaaggccnctttnnttgccgtttttnccnataggnttcntgcccccntgnacangctttnacaaaaaatctgnnntttatttanaaggtgggnnaacccccccnng

SEQ ID NO: 5221 - DNA, 725 bp, Homo sapiens; identical to SEQ ID NO: 5220
  misc_feature 4, 12, 15, 310, 333, 341, 430, 471, 545, 557, 585, 594, 603,627, 632, 633, 645, 648, 654, 658, 666, 669, 673, 679, 692,693, 694, 703, 712, 713, 723, 724: n = A,T,C or G

SEQ ID NO: 5222 - DNA, 1050 bp, Homo sapiens
  misc_feature 1, 2, 4, 5, 6, 10, 11, 12, 13, 14, 15, 17, 18, 19, 23, 24,30, 33, 35, 38, 39, 40, 42, 44, 52, 53, 63, 65, 67, 70,72, 73, 74, 78, 82, 84, 86, 87, 90, 92, 98, 101, 102, 103,104, 105, 106, 111, 112, 115, 117, 121, 125, 126, 128, 130: n = A,T,C or G
  misc_feature 135, 137, 138, 139, 140, 145, 147, 149, 152, 153, 154, 156,161, 167, 170, 176, 179, 194, 197, 202, 205, 212, 217, 218,223, 231, 234, 235, 239, 241, 242, 250, 251, 253, 255, 258,260, 262, 265, 267, 269, 273, 274, 275, 279, 280, 283: n = A,T,C or G
  misc_feature 286, 293, 297, 303, 306, 308, 312, 314, 320, 323, 325, 333,338, 344, 346, 349, 350, 352, 355, 357, 364, 365, 367, 368,371, 373, 374, 378, 379, 384, 386, 387, 391, 398, 401, 402,403, 408, 413, 415, 416, 421, 422, 424, 427, 430, 434: n = A,T,C or G
  misc_feature 438, 440, 449, 451, 470, 471, 475, 476, 486, 493, 502, 504,507, 508, 511, 515, 518, 521, 524, 525, 527, 531, 536, 537,539, 541, 543, 544, 545, 548, 549, 550, 555, 557, 573, 579,588, 589, 598, 606, 608, 611, 612, 614, 619, 622, 627: n = A,T,C or G
  misc_feature 632, 640, 641, 643, 645, 646, 652, 653, 656, 660, 662, 666,674, 675, 678, 680, 687, 691, 701, 702, 703, 707, 708, 710,711, 714, 715, 726, 727, 732, 734, 745, 755, 757, 761, 763,764, 765, 773, 777, 778, 787, 788, 789, 791, 803, 808: n = A,T,C or G
  misc_feature 815, 817, 821, 822, 825, 829, 830, 837, 843, 855, 870, 879,881, 885, 886, 894, 905, 908, 912, 914, 917, 918, 926, 929,930, 931, 932, 934, 935, 956, 959, 963, 969, 970, 971, 973,975, 978, 980, 989, 992, 994, 995, 1000, 1001, 1002: n = A,T,C or G
nngnnncccnnnnnnannnacgnngcgccnacncncgnnngnangcgccccnncgcacccganangnacncnnncagnggcntncnncanangacggnggnnnnnncacannacncncggnacgnngncnccgangnnnngccgncncngcnnncnccggngccccnttngaaacnctngggaaatccgacacnccnctcgngancagccanacccnnaccgnccggggangcnnaaancnncacggcanngngncgngnanacnancncggnnncgcnnggnccngacacgnacgncgcccnccngncccngncggcgncangngaaagggngccgnggcccngncgnncnacncncgccagnnannccngnncgcnngcacngnncccngccgccnccnnncgtcnccacncnncgcgnnanccngcncggncagntncgcagagcnangcccgcgaagaaaaccgcnngcgnngcgccccacnggcgacnacgccagcncnccnngcntagnggncanacnnanccgngcggnngngncnnncannngacanangcgcaccacggcggcnaggccnaggacgaannggcgacccngcgagccnangannanccggnatngccanaaccncaacggcnncngnnacgcgnnacngggncnaatncaatcgcnnganangacacancagnagcgcctgcnnncgcnnanncgnnacactcacacnncaccngnggccctcaagngagccgccantngcgngnnncaaagcangcannggaccatannngnaacaggcacaanggcantcgcacnanggcnncgngganncaccccnatagcnacgggggagcangaaccaaggggcggncccgtcccnanggcnnaagtcggncaggctgcacnggncggncncannaagacggnacnnnngnncaccgggagggacccaccgcnccncacngggggnnncnanggncnccacagggnacngnncgccnnncccnnagncccncangggnacccgnaanggnaaggcntgggggccccg

SEQ ID NO: 5223 - DNA, 731 bp, Homo sapiens
  misc_feature 2, 8, 11, 104, 110, 124, 514, 527, 553, 566, 579, 595, 598,599, 607, 609, 628, 645, 648, 652, 653, 660, 664, 669, 670,672, 685, 688, 689, 696, 699, 706, 709, 711, 718, 720, 726,727: n = A,T,C or G
tntcaatnctnggctctcgttcttttgcaggatccctcgattcgaattcggcacgaggtattcagcttggctggagcagaggcaggagtggggaactggggacnggtganactagaggttggcngaaaccagccatagtagtttttgcctcatttggacaacaaggagccatccaagagagagcggtgaagctgatggtgacacagccatggcgcattgaaatacccccagtggctgtgttgtagggtatattgggttggggagggacaaggtcaggaggcatagactcgacatcatctgatgtgattcaggacagaatggcgagcctgaagtgaagtgtctgtaggataagttggaaaggaaggaaccaatatgagatattaaagaagtgaaagctataggtcccagtgccttaataaaggtaaggagtaagagaagattcgagattgactcccagactctccagtctgctggacatgggagatggaatagaagttgatctcggtgtggtcanaggagagcagttnctgtgttgagcatggatagcctgcgntccccaagagaangagttccagctgncttgtaataagccaangcnnattatggngnagatccacccttgggagcnacttccttagggggccnacncttnntagcccnttanttaannanttcccccccctanatnnttccttnggntttaaanctngnaaacttntntttacnntttc

SEQ ID NO: 5224 - DNA, 731 bp, Homo sapiens; identical to SEQ ID NO: 5223
  misc_feature 2, 8, 11, 104, 110, 124, 514, 527, 553, 566, 579, 595, 598,599, 607, 609, 628, 645, 648, 652, 653, 660, 664, 669, 670,672, 685, 688, 689, 696, 699, 706, 709, 711, 718, 720, 726,727: n = A,T,C or G

SEQ ID NO: 5225 - DNA, 890 bp, Homo sapiens
  misc_feature 2, 8, 10, 11, 12, 13, 16, 24, 25, 26, 28, 29, 30, 31, 32,33, 35, 37, 39, 44, 45, 47, 48, 49, 50, 51, 55, 73, 75,76, 84, 90, 101, 108, 110, 122, 130, 150, 173, 194, 204,246, 248, 327, 435, 493, 576, 579, 581, 588, 598, 632, 635: n = A,T,C or G
  misc_feature 643, 649, 678, 686, 695, 703, 705, 713, 724, 731, 739, 751,754, 755, 766, 768, 775, 776, 779, 788, 794, 797, 807, 810,814, 817, 822, 824, 828, 852, 853, 855, 859, 861, 870, 876,877, 878, 887: n = A,T,C or G
cnttcttnannnnatnttcgaagnnncnnnnnncntntnagttnncnnnnntccngttctaatgcttggctancnnggcgctcnaacgcnctttcaaaccnagctctngntcttttgcaggncccatcgntcgaatcggcacgaggctgnttcctcaagaaaatgaagagggnaggatggctcagggaaagttnatcagagggnaaatgtcactctgtaaagagtaaaaaatttaggatgatgatncngatctgggaaaaaaaggcatagtgaagaccacttaaaaacaaacaataaaacctatgaaggtgcatgctatttccccanagctaaaaagataagtgaaattgtgttttgaactcttaagtggaggtgaagcacaatttattagccaccaaccacataagtgattatgaagtaactgagaaacaggtnacattttttcccacatggacaaaactttctctttctagaatattaagtatctatgatnagaaatgaagtagcatctcaagcagtttataaatctaccagaatattagaatcacctgggacctttgaacgtactcatgcccnatngnctacctntattcatttntttttttcgtaagatattggggacttcaacttcnggncttaaaangatccntcccacctccggccctcctaaaagttgtnagggattntcaaggccntgagcccncntgtgggcnctgcccttctnatggtcntgcttttngacccaatttanatnnaatcatcttgngnggttggnnccnctgggcctntaaagnatnttttaaaaanttntccnaanggggncnactnaatttcttatcctatcgatttgtnnancccncnggcctaatnccttgnnnatctctttncct

SEQ ID NO: 5226 - DNA, 789 bp, Homo sapiens
  misc_feature 8, 11, 20, 24, 597, 621, 627, 645, 675, 688, 695, 718, 731,733, 748, 765, 783, 784, 787: n = A,T,C or G
gggggtanganccctttganaccnattgctacttgttctttttgcaggatcccatcgattcgaattcggcacgaggaaggatccagcattcggaggcaaacatgaagctccatcctctccaatttcggggcaaccatgtggagatgatcaaaatgcttcaccttcaaaactctcaaagggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggccaaaagttgaactgccactgtataaccagccatcagataccaaggtgtccatgagaacatcaagacaaaccaggtgatgaggaaaaaactcattttattttttaaaagaaggaaatcatgccagaaaacaaagggaaccaaaaaaatctggccaccgttattgatcagctcatgggangcattgggaagaaaaaaagtgggncagaanttgaaaaataatccttcnggagggaaaagcttaaaggaaagccaaaancaagggggaattncttttgnaaaagccagtttttccagaaaanttcggaaaaaccnanggaggaaccagccanggaaaaagatttttcancccgaaatttggggccannaangg

SEQ ID NO: 5227 - DNA, 1266 bp, Homo sapiens
  misc_feature 2, 4, 8, 10, 22, 43, 45, 50, 55, 60, 67, 68, 70, 75, 77,78, 79, 106, 107, 108, 122, 126, 133, 135, 141, 146, 160,165, 175, 181, 184, 185, 186, 193, 196, 199, 201, 203, 204,205, 206, 207, 209, 221, 225, 226, 230, 235, 249, 251, 257: n = A,T,C or G
  misc_feature 258, 263, 265, 272, 274, 281, 291, 292, 295, 301, 306, 309,318, 320, 321, 324, 325, 326, 336, 337, 342, 346, 348, 350,356, 358, 366, 368, 382, 383, 391, 392, 393, 397, 400, 407,408, 415, 416, 418, 419, 420, 424, 428, 430, 435, 437: n = A,T,C or G
  misc_feature 439, 444, 451, 460, 462, 465, 468, 479, 488, 489, 495, 501,503, 509, 510, 511, 515, 516, 517, 518, 522, 532, 534, 537,540, 544, 548, 558, 562, 564, 566, 567, 569, 575, 576, 577,583, 584, 586, 587, 590, 592, 593, 604, 609, 618, 631: n = A,T,C or G
  misc_feature 635, 636, 651, 654, 655, 656, 668, 672, 674, 675, 676, 681,683, 684, 690, 692, 700, 702, 704, 710, 711, 715, 718, 721,722, 723, 727, 729, 732, 733, 734, 737, 740, 745, 746, 749,757, 759, 761, 764, 765, 775, 780, 791, 798, 807, 812: n = A,T,C or G
  misc_feature 817, 828, 832, 840, 843, 845, 846, 847, 850, 851, 853, 855,856, 857, 858, 862, 863, 865, 869, 870, 876, 877, 878, 885,886, 892, 893, 895, 903, 904, 905, 908, 911, 913, 916, 920,921, 922, 931, 932, 933, 934, 937, 942, 944, 946, 947: n = A,T,C or G
  misc_feature 948, 954, 959, 961, 963, 973, 975, 977, 983, 985, 986, 987,993, 996, 997, 998, 1000, 1001, 1003, 1006, 1011, 1015,1018, 1024, 1028, 1030, 1031, 1041, 1043, 1044, 1047, 1052,1054, 1059, 1073, 1075, 1077, 1079, 1081, 1089, 1092, 1097: n = A,T,C or G
angntttncncccctttttttntgaaaaacccccccttttcgnanaactnccccngtctncctgatnntngcgangnnntacgcccatatgggatttctgtaattnnnggcctaccggcagnagangattatngntatagnaaaantttgtggtattgtntctcntgtcatccgnctggcncannnatctgtnganaancncnnnnntnttgggttacatnccanntctnagttnaacgctgtaaatcntngagatnncgtgngnacgacancngcctctntcatggctcnnatnacttcnaccanaanatagtatangnngcnnntttgagcagnnccccnatcntncnacgacnantcgctaanangcttctacgattcnntttttgtnnnactngtncctttannatccttnncnnntaangccnanttgtngnanactancgcactntgcaaaatngntanttnttctaactttnataaaatgnnagtgcnaatacngntttcannnttannnnatanaaaaaggaantngantcntgtntctncccctttcangtanangnncncctagnnngattcnntnngtnanntattcttatancgcgnggtagaaangcctactttgtgngtannatttctcttctattnatnnngttcctctgttntacntnnntgaancnntttagnangaaggacngnanaaacannaccnacngcnnnaggntnttnnngcntanaatanngantacttctnangnccnnttcactttcnatagnaaccctccgtntgtgagncctttctanttctnatacnaatactctttngatncgccacanttntnnntanntntnnnntttnntnagtnnatgttnnnccagcannttctcnntncctttctnnnacnaantntgnaaannngctttcttnnnnacntagtngnannnatcaanccctntncnctgtgcgtcntnanatattncnnntcttantcnnncnncntanatcgnggcntanataccnactnanntataatatgngnnctngtcgntnatttncaggcattctctgngntncntntcttatcnccntcgtntcgtgtncnngctagnnntantantancgtnanncatntcagtatacnntctntcntgtgngngcatacnctannaatntactgntnctcacnngcntgacntacgntangantngaanggagtgcccgnnnntgcnaatntatctcncgcacctntaccnactntncn

SEQ ID NO: 5228 - DNA, 785 bp, Homo sapiens
  misc_feature 7, 8, 9, 10, 11, 12, 13, 14, 15, 16, 31, 32, 33, 35, 36,37, 38, 41, 42, 43, 49, 91, 92, 94, 100, 104, 107, 109,111, 130, 141, 148, 163, 165, 168, 174, 177, 179, 184, 185,187, 197, 203, 219, 221, 232, 242, 256, 269, 270, 271, 287: n = A,T,C or G
  misc_feature 300, 305, 307, 310, 317, 321, 327, 344, 345, 350, 354, 373,378, 379, 386, 387, 389, 390, 400, 407, 409, 417, 421, 422,424, 432, 437, 439, 443, 444, 446, 450, 472, 480, 490, 497,504, 507, 513, 514, 518, 521, 526, 537, 540, 543, 565: n = A,T,C or G
  misc_feature 566, 568, 580, 583, 590, 604, 607, 608, 609, 610, 616, 623,642, 647, 653, 655, 663, 667, 675, 690, 691, 706, 711, 715,716, 721, 723, 726, 743, 749, 754, 757, 765, 768, 774, 776,779, 781, 783: n = A,T,C or G
aggggtnnnnnnnnnnttttgaaaggcggtnnnannnnttnnnaatatnagctacttgttctttttgcaggatcccatcgattcgaattcnncncgagcngggncgnangnagccatggtgcccagccgnaatggcatggncttgaanccccacttccacagngnctngcagcngcncntggcnncntggctcaacnagtcgntcctggaagaatccgnanacgtatgggcnggacaagtcnaggcgcaccgcatngattgacacgccnnntgtcgggatcccatgngggtcattttgcncatgncncanggttcgntgcnacacanaggtgctcagccgagcnnggatntagnctggaggagcttagggtgnccggnnttcacannanngtggtccggnccattgncntttgtgtngatnngnagaggcanatcangnccanngnttcnctgcatgccaacgtgcagcggntgaaagantccgattcanactgatnctcttcnccncgaagnnttcngtncctanaacggagacanttntgnttaaagaactgatacttgtcanncngctggaccggancgnttatgcncttcctggaacgtnttnnnnaagganaaaactntaattaatactttgggaanagaanaatttnanagccttcnatangtttcganttggtccgtgccaannggcccggtttttttnacctnactnnccaanangancccaagggaagcccttncaacanggatngtnaaaagaanaanattaancnccntncntg

SEQ ID NO: 5229 - DNA, 967 bp, Homo sapiens; identical to SEQ ID NO: 5174
  misc_feature 1, 2, 3, 4, 5, 6, 9, 10, 12, 13, 14, 15, 16, 17, 18, 19,21, 23, 24, 25, 26, 28, 29, 34, 35, 36, 38, 39, 40, 42,45, 46, 49, 51, 52, 72, 73, 80, 82, 85, 86, 87, 88, 96,101, 109, 110, 112, 113, 115, 116, 120, 125, 139, 142, 145,147: n = A,T,C or G
  misc_feature 160, 162, 164, 167, 170, 173, 181, 190, 195, 199, 205, 212,217, 228, 231, 237, 250, 251, 256, 270, 281, 284, 294, 298,301, 303, 304, 314, 318, 337, 342, 343, 350, 354, 357, 358,367, 369, 383, 389, 391, 401, 427, 437, 444, 449, 452: n = A,T,C or G
  misc_feature 466, 467, 469, 474, 484, 486, 492, 494, 497, 500, 506, 508,510, 520, 529, 533, 539, 540, 546, 547, 554, 555, 558, 560,568, 569, 575, 579, 590, 594, 596, 600, 603, 607, 608, 609,611, 619, 620, 636, 637, 639, 640, 642, 655, 664, 682: n = A,T,C or G
  misc_feature 684, 686, 691, 692, 699, 701, 710, 711, 712, 722, 724, 725,731, 737, 739, 745, 762, 766, 773, 774, 777, 778, 785, 786,787, 794, 799, 809, 812, 829, 830, 833, 837, 839, 856, 861,873, 874, 884, 885, 887, 891, 895, 903, 906, 907, 911: n = A,T,C or G
  misc_feature 916, 923, 935, 950, 951, 952, 955, 957: n = A,T,C or G

SEQ ID NO: 5230 - DNA, 1118 bp, Homo sapiens
  misc_feature 2, 9, 13, 21, 36, 37, 155, 160, 173, 233, 248, 251, 256,291, 296, 304, 337, 338, 347, 348, 349, 352, 353, 359, 361,369, 371, 376, 378, 388, 389, 407, 409, 412, 415, 416, 417,425, 436, 444, 446, 452, 455, 461, 463, 467, 474, 475: n = A,T,C or G
  misc_feature 480, 481, 483, 490, 494, 502, 504, 507, 510, 512, 519, 523,525, 527, 529, 532, 535, 537, 538, 541, 542, 543, 547, 548,550, 551, 558, 570, 572, 573, 577, 578, 588, 590, 598, 601,603, 605, 608, 613, 621, 625, 626, 629, 634, 636, 641: n = A,T,C or G
  misc_feature 643, 644, 645, 650, 653, 658, 660, 661, 662, 663, 665, 667,672, 673, 679, 680, 682, 684, 690, 692, 697, 699, 701, 702,707, 709, 712, 713, 714, 721, 723, 727, 729, 730, 733, 739,740, 741, 753, 756, 760, 766, 769, 771, 773, 780, 783: n = A,T,C or G
  misc_feature 788, 793, 808, 809, 814, 815, 816, 818, 822, 826, 831, 835,843, 844, 847, 851, 853, 859, 861, 862, 868, 872, 879, 880,884, 895, 901, 902, 908, 909, 910, 913, 914, 918, 926, 929,931, 933, 936, 937, 941, 947, 955, 963, 967, 970, 975: n = A,T,C or G
  misc_feature 979, 983, 986, 992, 994, 998, 1004, 1013, 1015, 1021, 1022,1029, 1034, 1037, 1038, 1040, 1041, 1045, 1055, 1063, 1066,1073, 1080, 1082, 1083, 1094, 1096, 1097, 1098, 1115: n = A,T,C or G
tnggctttnaatnccttttcnattccaatgcttggnnactttcaacacgatcccatcgattccgaattccgggcacgaagcaggagctgtgatctgcccccaggtattctgacccccaaactggctctcaacccatgtttacatggatggaaaanggaanagggtgactggtngtatcaagctcttaaagggccttacttttgggtggaaaatggggaccctaaaaatttganttggcttacttgganttnccttnctggtcaattactggaaaaatttgggcaccttcanttaantttaaatnctttttggaaactttttaccattaaaccttggnncctttaaannntanntatttngnccaattgnangaaantnttatctcttnnattattcattaaaaatantnttnccnnnagtctccnatctcttttgntaataagngncccggnatnctcaantntacnatatgtnnaagtnntnagtcttnacanccagattntnttnttnanttataanttgntnanancgnttnanntannntatnngnnaacttcntactggtccaangnntgtnngaatgttcananttaactantgnantnttngaaantacaactnggtnntancaaancntcggnannngtggncanttatncnnnngnanaatgnnaaatgnngnantcgcangnttccnangnntctananccnnnaatctcnangcgnanncanttcatnnncggttacctccnatnagtnacctcncgnangntatatgnagncatgntcttntgttagcaattgaanncatcnnncnatcnagantccanatantaatcttnncgntaancncgcttnanngacgcnttgntatcccnntcgngatgttatatntacatnnatacannntgnntganaaaatacngtncngntcnngganaatctnagctggtnctcacagnatcntancgtgnaatnaccntanattgtncncccncgcggngtgtcccanantcgccnntagagcntcatntcnngnnattngacggtaatnctgatatnttntctcacncagattncnnctaataaaagngnnntatttgtagaaatgacnccg

SEQ ID NO: 5231 - DNA, 486 bp, Homo sapiens
  misc_feature 14, 113, 121, 125, 139, 140, 141, 162, 166, 167, 171, 173,181, 185, 186, 188, 196, 203, 207, 209, 214, 218, 219, 223,242, 248, 258, 262, 263, 269, 270, 282, 296, 298, 306, 323,326, 327, 328, 333, 342, 348, 350, 359, 367, 369, 374: n = A,T,C or G
  misc_feature 378, 388, 390, 393, 396, 399, 403, 408, 412, 417, 422, 423,424, 427, 435, 438, 448, 450, 451, 453, 456, 463, 467, 471,473, 474, 476, 483, 484, 486: n = A,T,C or G
cgccttttaagctncttgttctttttgcaggatcccatcgattcgaattcggcacgagactctggcacagccagagtcattgttctttcaagcagtcattcatatcagcgggntgccattnctgntttggagcactagnnnaaaatagctgcactatccggngcgnntatncnaagctgcncgcnngnggcttgcnttcttgngggngnttttnttgnnaatntcaaaagtttctaatcctnatgccnctttttgggnaaanncaagannaagtcaatcctncccttggggatccngngttccccnttcaatcacgatttgtnggnnntcacncgatttatntttacnangacacaggnttattgancngttangttnttaacatctngnaanctnaantgtngctgnatgnaatgngcctnnncanttcccatnacntttgcccctncnngnggngccctancgtngtgngnntnaatgccnnan

SEQ ID NO: 5232 - DNA, 842 bp, Homo sapiens
  misc_feature 3, 9, 16, 25, 34, 38, 39, 50, 57, 61, 68, 69, 79, 80, 87,90, 92, 99, 102, 107, 110, 111, 121, 123, 128, 137, 138,143, 147, 150, 151, 152, 153, 155, 161, 164, 165, 172, 201,208, 211, 216, 217, 219, 226, 227, 235, 254, 256, 276, 279: n = A,T,C or G
  misc_feature 288, 291, 292, 293, 297, 298, 302, 303, 304, 312, 315, 318,326, 329, 330, 333, 334, 336, 345, 348, 353, 356, 361, 375,377, 378, 381, 384, 389, 393, 394, 396, 400, 404, 407, 409,410, 418, 424, 425, 426, 431, 432, 444, 457, 466, 472: n = A,T,C or G
  misc_feature 478, 481, 531, 539, 543, 544, 548, 559, 561, 562, 564, 567,573, 575, 600, 601, 605, 606, 608, 615, 617, 644, 651, 673,687, 702, 706, 717, 722, 723, 726, 728, 729, 749, 751, 767,772, 773, 777, 778, 780, 793, 795, 797, 803, 807, 808: n = A,T,C or G
  misc_feature 812, 832, 841: n = A,T,C or G
tcncctttngaaatcnccttggatnttgctttcnaatnnctggctcttgntctttgngcangaatccnncacgaggganngctgtcnganantctgttntanacggnaannccctgaattnancatcnacagtgctnntcttngaancannnntnctaaantcnntcatganatggaggtgattaagatggcccttgctcntggatgncanacttnngncagaatnnacctactntgaccataggatacttttntntgtaggtgtaaatggttctnctntactaatcngannnggannatannnatacaacnttntangggatccntanncanntnggaacagcngtngatgnccnctttnggagggtattcatntnncantcntgatnaaanntncctnattnttntnnctactgangcaacnnntgcannaagtgtatgaanggtgccccctgtnccaatgatnctgcantgctgnatncagccttttctgggagcaccggtccaagcgttccggaattgattatcccnatcatttntganntgtnactggaaaatntnngnctnatgcantnaaaaatgtacttggcttgctttttnncaanngnttatttncntctttgggaagtaataaaaccgattcnacccgtngaaaccgttaaccaaaatttcntggtattttaaggnctttttttcctgttntganggtcggagtcnttggnnccnanntatttttttggggtttttgngnaagaatttcctaaaantaaanntttnntnctacccatttttnananataaantganntaanaaaaatttcctgcccttttnaaaactttnt

SEQ ID NO: 5233 - DNA, 628 bp, Homo sapiens
  misc_feature 1, 2, 3, 4, 5, 8, 9, 10, 11, 12, 15, 17, 18, 19, 20, 22,23, 25, 28, 29, 33, 34, 36, 38, 42, 43, 44, 45, 47, 48,51, 55, 56, 60, 61, 62, 64, 65, 69, 70, 71, 72, 73, 74,77, 82, 83, 86, 87, 88, 89, 90, 91, 92, 96, 98, 100, 103,105: n = A,T,C or G
  misc_feature 106, 107, 108, 109, 110, 111, 112, 113, 114, 115, 118, 120,121, 123, 126, 127, 128, 129, 130, 131, 132, 133, 135, 136,137, 138, 139, 140, 141, 142, 144, 154, 160, 176, 179, 195,196, 197, 204, 213, 214, 222, 227, 231, 248, 256, 268: n = A,T,C or G
  misc_feature 271, 279, 308, 315, 341, 345, 355, 360, 373, 387, 397, 404,432, 436, 456, 470, 491, 498, 615: n = A,T,C or G
nnnnntannnnntcntnnnnanntntanngatnntntnttcnnnncnnatnttannattnnnannctcnnnnnntantatannagnnnnnnntatntnangantnnnnnnnnnnnatnannanatnnnnnnnncnnnnnnnntntttcattttngaaacncccttaccgtgccgcnttngccagtatcccatcgnnncgcaacnacccctacnnaaaaactntaaanaaantggctagcaacgggttntttcatcncggtgtctcttnatntaagtttnctaagttaagaaaagctggtgacatattnatacgtntttgtgcaaaaataaatgaatggcantagnacctaaaaanatctntattatgtacttntgtgtgaaaaagtntgtataatanttccctnaaatatgcattattttacttgtgagttntttnctgaattaatctgaaatgtncaagccctggattngctacagagtgagaagttatngctattngtttcttatttgtaatgcttggaaatgctgcacaaatcacgaagctcttaccatgggttgaacaaaaaaaggggaaatggggaggggaaaagggtgggatagcccagcatgcttgtntggtatattccag

SEQ ID NO: 5234 - DNA, 676 bp, Homo sapiens
  misc_feature 3, 140, 570, 572, 577, 578, 579, 634, 637, 670: n = A,T,C or G
atncttggctcttggtcttttgcaggatccctcgattcgaattcggcacgaggagttttttttttttttttttttttttcatttttataaaaatgtgttttattgttttaaaacaagtctataaaagtagaaatcacatncaaaaatacagattactctgacatgttggcaaaatagcttatggctggacttgagtttggaagttctgtatgtttgagggcatccgatgtcagagtccaaccggatcctaaccccagctcttgtcactaatagtaaagtttcaggtattatatcatagcaccgactgagtgataggtgttggaggtagttgagctggaaaaattcctgaaagcagtcattctttagcatgacactatcacttaagtctagatggacaagattggggcatcttctaactaaagtagagagatctgatttctggagattctttctgtagcccgctaagattcagctggggtgatggtctctgacacatgcgcaacagcacctgtcatgcttttcaagtggaatcaaacaccaggagaggtcactatccagctggacagttgntnccaannntgcaggcaatcaggaatccgacccccaaaggtaatcccctaattgagttttgcanagnttgcatggacccaaaccgagcttcagcttaatntgactg

SEQ ID NO: 5235 - DNA, 946 bp, Homo sapiens
  misc_feature 20, 21, 58, 66, 68, 69, 70, 71, 72, 76, 92, 97, 102, 110,113, 119, 124, 133, 135, 137, 141, 151, 163, 166, 178, 181,184, 191, 195, 199, 201, 214, 216, 244, 255, 257, 262, 273,293, 299, 301, 305, 306, 307, 308, 309, 311, 317, 318: n = A,T,C or G
  misc_feature 320, 322, 323, 324, 327, 328, 331, 332, 336, 338, 340, 341,348, 350, 351, 352, 353, 354, 362, 364, 370, 395, 406, 412,431, 441, 447, 455, 456, 479, 488, 503, 506, 508, 513, 517,521, 530, 536, 539, 541, 545, 549, 552, 556, 561, 562: n = A,T,C or G
  misc_feature 569, 571, 573, 591, 593, 599, 602, 603, 616, 618, 623, 624,633, 634, 642, 652, 664, 669, 670, 691, 694, 707, 709, 721,726, 737, 747, 749, 760, 776, 780, 783, 796, 801, 804, 810,811, 818, 831, 836, 844, 849, 850, 852, 855, 856, 859: n = A,T,C or G
  misc_feature 860, 861, 863, 865, 870, 871, 873, 878, 880, 885, 894, 895,899, 901, 902, 905, 906, 907, 910, 923, 925, 934, 936, 939,943, 946: n = A,T,C or G
ttctaatgcttggctctcgnncttctgcaggatccctcgttcgaattcggcacgaggntgtcacangnnnnntgtntccacaggcaccactngctangtctnacctgtgntgnctgttncaacncggggctangnangctngtattccacntggataactaanccntggtcataccgnccntgnacgtggnaccngctncnaggagatgcaacnanacattctaagatgcttatgatccttacntgtatctttcntnttggngattcttttanattggatgttgcaatggagntgaatnancttnnnnncngctctnntnannnccnnttnnatangnannaactttncnnnnnactaaatngnccactnatactaatgtgcttagatgcatatnttaccctcttnaagtgntaaaaccctttagaatccnaaggaccagngtcaancgcaacanncttctaggacctatgcgaagctntgacttganccttgggggatcccntgngngttanctcngatnatgtttcgnggaccngcntngacncatntanagtnttgcnncattggnangnccctgttaaatccccaantnggaaanccnnttaggggttttanangcttnnggaaccccnnccccgggntctttgttgncccccgatatgnggggnnaaaaccggtttcaaaaaaagntcnaactttggggttnantttaaaattttnggggncccttttggangtaaccctgngnaaggtgcatanatattgggccgggaantttnttnggtggggggccanccttnggngggctnncatttanaaatggcttaaanaaaantttaaccnccaannantcnnatnnncnanaaacnncnttccngnacaanactcccttnnaaancnnccnnntcnaatggtcaaaaantnttcaaggancnggnttanaan

SEQ ID NO: 5236 - DNA, 721 bp, Homo sapiens
  misc_feature 7, 8, 488, 523, 541, 546, 563, 605, 607, 642, 645, 649, 651,656, 658, 660, 681, 682, 696, 699, 700, 713: n = A,T,C or G
caaatcnntggctcttgttctttttgcaggatcccatcgattcgaattcggcacgaggttggcttggtgtggatgcaggttgctctcaaggaggatctggatgccctcaaggaaaaatttcgaacaatggaatctaatcagaaaagctcattccaagaaatccccaaacttaatgaagaactactcagcaagcaaaaacaacttgagaagattgaatctggagagatgggtttgaacaaagtctggataaacatcacagaaatgaataagcagatttctctgttgacttctgcagtgaaccacctcaaagccaatgttaagtcagctgcagacttgattagcctgcctaccactgtagagggacttcagaagagtgtagcttccattggcaatactttaaacagcgtccatcttgctgtggaagcactacagaaaactgtggatgaacacaagaaaacgatggaattctgcagagtgatatgaatcancacttctttgaaggagacttctgggaagcaacccngatcatttccgcaccttnagccncatttagaactttgacnattaaaacccccagtgggaaatttgaaccagatgggtgatananctgccacttttgaaaagacaagtctttgggtcaantcnccancngaccngntnccgtaaaaatccaaagctttnnggaaagaagaattnttnnaaattcttagggnttccaacc

SEQ ID NO: 5237 - DNA, 1102 bp, Homo sapiens
  misc_feature 8, 10, 11, 12, 19, 21, 22, 25, 26, 28, 35, 37, 46, 47, 48,49, 50, 58, 66, 69, 75, 76, 79, 81, 82, 83, 85, 86, 88,89, 95, 109, 110, 115, 122, 150, 165, 167, 171, 172, 177,178, 197, 199, 202, 204, 205, 209, 218, 230, 231, 234, 241: n = A,T,C or G
  misc_feature 246, 254, 256, 259, 263, 267, 275, 276, 277, 283, 285, 291,294, 302, 303, 313, 327, 329, 331, 336, 338, 340, 346, 347,356, 357, 359, 361, 362, 366, 372, 373, 376, 377, 378, 379,380, 381, 395, 401, 421, 422, 425, 427, 428, 431, 439: n = A,T,C or G
  misc_feature 442, 448, 452, 459, 465, 476, 482, 484, 493, 497, 500, 503,511, 512, 517, 524, 528, 530, 531, 532, 536, 544, 546, 548,549, 552, 555, 563, 564, 565, 570, 571, 582, 584, 585, 586,588, 589, 593, 594, 598, 599, 607, 614, 624, 627, 634: n = A,T,C or G
  misc_feature 637, 639, 641, 642, 649, 652, 653, 657, 658, 659, 660, 662,668, 674, 678, 682, 683, 689, 700, 704, 706, 708, 721, 723,726, 731, 733, 741, 742, 745, 746, 757, 764, 766, 773, 775,777, 784, 786, 790, 791, 796, 801, 805, 806, 818, 822: n = A,T,C or G
  misc_feature 823, 826, 827, 829, 830, 844, 845, 857, 859, 860, 864, 865,866, 873, 874, 876, 877, 880, 882, 889, 892, 893, 903, 905,910, 917, 920, 921, 923, 928, 929, 934, 938, 944, 945, 954,960, 963, 969, 977, 978, 980, 981, 983, 984, 990, 997: n = A,T,C or G
  misc_feature 1000, 1003, 1011, 1014, 1019, 1022, 1029, 1033, 1036, 1051,1054, 1055, 1064, 1067, 1070, 1074, 1084, 1085, 1089, 1098,1100: n = A,T,C or G
gggggggngnnnggggggngnnggnncnggggggncnggagggggnnnnngggcaggnggagggtnaanccggtnnggncnnngnncnncctagngaacccttggaaanncccgnagcaggnccaacgaagcgaaggcggcacgagaagnggaccaacgggccancnggcnnggttnntggggccaagacgggggancnccncnnggcnggggggggnaaggaggggcgnnccnggggggnagggnaaaaaaancnccngagngggnaaagggannngggggnangggggncgngggaaccnnagaggaaganaaggggggcgggcnananggggngnanaggggnnagggggggnncngnncgcncggganngannnnnngaggagacgcccgngggggnaggggaaagcagaagggggnngcngnncanggggggancangggggngacncccggangggccnggagggggcgnaaaacngnggggccccngggnggnccngggggagnngagancggaagngganannncagnaaggaggngngnncgnggngggggggnnnaaagnncagggagcccngnnngnnaggnngccnngggggccnggggganagggccgacnagnggggggncangngnnggggggnggnngcgnnnngngcaggnggcgangcangggnngacggngggaggcacgngggngnanggggggcgaggcngnggnggagngncgcgaggnngannggggggggggngaagggngncgggggnancnggggggngngggnnagggnggggngcgnnggggcggcggcnaggnnggnngnnggggaggggaggannggggcgggaggngnnccgnnnggcgganngnngangngcggganggnngcgcaggcgngnggggncgcgggnggnngngggannggggngagngggcgnnggggcggancggggngcnggagangaggaggnngnngnngggggnggcgggnggngcngagagggnggncacanaancgcgggngggnggngcgggccgggggganagnngggggaggnagnggnggangcgcgagggnngggngggaggggngncg

SEQ ID NO: 5238 - DNA, 762 bp, Homo sapiens
  misc_feature 2, 6, 8, 12, 15, 16, 17, 21, 36, 47, 53, 59, 60, 61, 72,74, 76, 87, 93, 100, 126, 129, 130, 134, 141, 142, 145,147, 151, 153, 154, 156, 157, 161, 163, 167, 169, 170, 175,176, 177, 180, 181, 183, 184, 187, 192, 193, 194, 196, 200: n = A,T,C or G
  misc_feature 202, 205, 206, 240, 254, 259, 260, 264, 274, 281, 282, 284,294, 295, 298, 303, 304, 305, 316, 318, 321, 328, 336, 376,381, 386, 387, 389, 392, 396, 399, 404, 418, 428, 430, 434,443, 454, 460, 462, 477, 484, 489, 506, 520, 521, 535: n = A,T,C or G
  misc_feature 541, 542, 555, 562, 566, 569, 575, 579, 581, 582, 593, 597,599, 600, 603, 604, 613, 614, 626, 641, 662, 663, 668, 669,670, 672, 674, 681, 684, 706, 720, 722, 726, 732, 734, 762: n = A,T,C or G
cnacangngacnggnnntggnactcgctctttcccnggcatccctgnagacanagatgnnnaaggggaagangntngaaaaccaggntaaaantttttangagaaaggcagaggatgctcaagggnaannaganggaaatnnagntnaccncnntnncggnantggncnntatgnnnaanncnncgnataannngntctntntgnngaagacagatcccagccttggatggcttgatagncgatggatggaaancgatnngggncattttaaanaggcctnnangttacattcnnagnatatnnntaagagatagngnatncaaactntgatgaangtggtgatgcaggactgaagcatggtccactacaatgaanctttnttccnntnggncaanggnatggntgatgatcccatcncagaggatgntnctgnaccagaggngcctcccattntcgctncnaactgccctaactancccatantgagntaacatgtcccttcatnttgttacgtctatnnagacaaatgctttntctttnncttgcttgacccnatcttgncttnccnttcagntaantnnagaacacattnttancnntcnntggccatannggttctaacttnaaaccattttacctnttaaattttgtgattatagtnngtggnnntncntaagggnaanaagattgcctttcaacttttgngaggggaatttcgngnttgngtaaantnattttgtccaaatcttttgaatttttan

SEQ ID NO: 5239 - DNA, 578 bp, Homo sapiens
  misc_feature 3, 6, 11, 12, 14, 15, 19, 21, 22, 24, 25, 32, 33, 37, 38,40, 43, 45, 46, 47, 50, 51, 52, 59, 60, 65, 67, 68, 69,70, 71, 72, 74, 75, 76, 77, 78, 79, 81, 82, 83, 84, 85,86, 87, 88, 89, 90, 91, 92, 93, 94, 106, 113, 114, 115,117: n = A,T,C or G
  misc_feature 118, 121, 123, 136, 139, 146, 159, 160, 162, 166, 167, 180,201, 202, 203, 206, 210, 213, 221, 234, 239, 247, 262, 263,270, 272, 277, 280, 283, 286, 289, 291, 294, 299, 301, 302,320, 321, 324, 326, 327, 332, 340, 341, 350, 362, 368: n = A,T,C or G
  misc_feature 369, 373, 382, 383, 384, 389, 391, 394, 395, 396, 399, 401,407, 408, 409, 419, 421, 422, 434, 436, 441, 451, 454, 456,463, 464, 465, 470, 472, 485, 488, 492, 494, 503, 508, 510,516, 523, 526, 535, 540, 542, 543, 547, 557, 558, 564: n = A,T,C or G
  misc_feature 565, 572, 574, 578: n = A,T,C or G
gcncgncgaannannacgngnnanngcccggnngaannangcncnnngannnccgaaannaagangnnnnnnannnnnncnnnnnnnnnnnnnnaaaccttgaaanccgccgnnngnnggncnctcggtatcgcanaanacacaanggggaggaagggnngncaanncgggttggggtgnaaggggaaaaggacacgaacnnnggntaanggnagcaaganttacacgggcganggganccgagccngtcccctttggagannatccccnanaaaanatnganagnggncnggnggggngnnacaggacacgaccgcggnnaancnnggaantggccttnngccggcaantccagaactaangggggnncaangcagggagnnnacaangncgnnngangnggcagnnnagccagagananntgacagaagagncngggcngtgcgggcanccngnagaaaannngccananccaggaggcccgnacntggngnaacccacgnaaccncnggaggncagaggnganaggaacacnggggngnnggancaggagggcnngagggnnacaaggnanagcn

SEQ ID NO: 5240 - DNA, 898 bp, Homo sapiens
  misc_feature 2, 3, 31, 33, 36, 49, 54, 67, 70, 71, 75, 76, 86, 87, 90,91, 93, 94, 95, 99, 104, 110, 111, 113, 118, 121, 125, 129,132, 135, 140, 143, 144, 145, 150, 162, 170, 173, 179, 180,185, 192, 193, 207, 209, 218, 219, 220, 226, 229, 247: n = A,T,C or G
  misc_feature 250, 297, 303, 306, 309, 313, 327, 333, 334, 369, 372, 373,376, 390, 393, 401, 421, 428, 467, 493, 494, 507, 523, 535,546, 549, 553, 561, 562, 570, 578, 581, 588, 593, 594, 601,605, 612, 615, 619, 622, 624, 625, 629, 637, 642, 656: n = A,T,C or G
  misc_feature 660, 668, 677, 679, 682, 684, 685, 686, 716, 721, 725, 727,729, 739, 741, 757, 758, 763, 766, 774, 788, 789, 792, 793,804, 805, 808, 811, 813, 816, 817, 823, 830, 832, 839, 852,853, 857, 874, 879, 887, 888, 889, 897: n = A,T,C or G
tnncctttctaatgccttggatagttgcttncnatngctggctacttgntcttntgtaggatcccgngcnngatnnttatgactgnnccnntnnnggcngatcntttgcnngnttacnctngtanaccngtngcngcggncgnnngaagncgtcctgggaancagataanacngctgcnnggctnggagtgnncacccggtacacantntttatttannnggccanctnccactgatgaacatatantcngagtgactgctgaaatagcctttttggattgaacgcccacgacagtncattangtntcncttntatcatgctttctntactgnnatgagcttcactgaacggcgtgaaaaacttggaanatnnatnggacatgctgtaanatnggacatanatttttatacggaaaacttnaagtgcncacagttgaaagccataatggcatcccatagagaggctnttttgaactttgggatgctttattgnnccaaagaaagatncagatttacctgaaancttgtgggtttnggacacctttntgntttntaagcctnntgaacaantttttaanacntttgacnttttnnaaaaacnttgncttaccnagnggtnacnanngaanaatggccnttcangggaaatttctccngggntttccccnggaaaaaananttncnnnccagggttttttggaggggattccaaagtnttttntaanancnggggggtttncnaaaaaaaatgggggcnncaatnggnttttaganggggaacaaaaccnntcnnaagcccttttnntcnaantntcnncctttngtaaaangncttccanattatttcttttnnctangggttttctttttttgnaaaanaaaaatannncttttttnt

SEQ ID NO: 5241 - DNA, 769 bp, Homo sapiens
  misc_feature 18, 32, 42, 50, 52, 53, 56, 127, 180, 201, 205, 208, 214,218, 224, 228, 236, 237, 239, 255, 279, 310, 336, 374, 376,391, 436, 476, 483, 491, 492, 493, 528, 539, 543, 554, 566,577, 582, 588, 592, 622, 626, 632, 633, 659, 665, 668: n = A,T,C or G
  misc_feature 669, 672, 677, 697, 699, 706, 710, 722, 725, 727, 735, 739,742, 743, 753, 759, 760, 761, 766, 768, 769: n = A,T,C or G
gcttacccctttctattncttggatgctcttncattgtgcangatcccancnntcnaattcggcacgagcagagctgtgatctgcccccatgtattctgacccccaaactggctctcaaccatgttnacatgatgaaaagaagaggtgactgttgtatcagctctaaaggcctcactttnggtgaaatgggacctaaattngatngcntacttnattncttgcngtcnatactganntnggcactttataatttnaatactattgaactttcaccatanccctgtcctataaagttgacttgcaaatgangaaactctatctcttcaatattatgnactatatccaagagtcacaactagtgagaaaaggacangntctaactaccaatgngaggctgtgtcttcacaccaattcaacagagtatcttgtaaatgntgagaggagaggtactttaagtcatgggtgtctatcatangtgcttnacaaaacnnnttgacaactgattgggccttgaggtatgaatgganttagccaggcnattnaattcgaaatncgaagcttcaangacagatttantaacnctttgngagnagttgaaatgcagcaagatgttacgacaanttgntactgnnccatgggaattttaccaaagttgtgnaattgnagnnaantgctnatggaaaccttgaaaggatntngctttgnggcncacgcttgaacnaangncttcggantgcntannaaaaagcccnaatgcnnntccancnn

SEQ ID NO: 5242 - DNA, 1466 bp, Homo sapiens
  misc_feature 2, 3, 5, 11, 13, 14, 17, 18, 20, 21, 22, 24, 27, 35, 38,41, 49, 67, 75, 82, 85, 87, 90, 95, 107, 111, 115, 129,130, 134, 137, 138, 141, 144, 153, 161, 163, 175, 181, 182,183, 189, 192, 201, 204, 207, 209, 211, 215, 216, 219, 220: n = A,T,C or G
  misc_feature 222, 230, 233, 237, 244, 245, 248, 251, 255, 264, 270, 282,289, 291, 294, 296, 297, 301, 304, 309, 320, 321, 322, 325,326, 327, 344, 345, 355, 357, 362, 368, 373, 380, 383, 384,385, 390, 392, 393, 396, 400, 402, 404, 407, 409, 410: n = A,T,C or G
  misc_feature 415, 420, 424, 427, 430, 433, 435, 440, 447, 449, 451, 460,461, 464, 472, 475, 478, 482, 485, 493, 496, 500, 516, 521,534, 536, 552, 554, 567, 574, 581, 582, 583, 589, 592, 603,608, 617, 620, 624, 626, 641, 643, 649, 650, 656, 661: n = A,T,C or G
  misc_feature 669, 670, 673, 677, 691, 694, 695, 706, 710, 713, 731, 734,735, 738, 740, 747, 749, 761, 766, 767, 777, 788, 795, 796,812, 816, 819, 831, 839, 849, 860, 870, 876, 882, 883, 884,889, 891, 909, 911, 913, 917, 924, 933, 940, 944, 949: n = A,T,C or G
  misc_feature 952, 958, 961, 967, 989, 1018, 1020, 1025, 1028, 1040, 1043,1052, 1054, 1055, 1061, 1064, 1066, 1068, 1069, 1072, 1081,1091, 1095, 1101, 1124, 1145, 1149, 1154, 1155, 1156, 1157,1159, 1160, 1162, 1163, 1165, 1168, 1173, 1174, 1176: n = A,T,C or G
  misc_feature 1177, 1180, 1186, 1191, 1194, 1204, 1209, 1210, 1214, 1219,1228, 1230, 1235, 1236, 1245, 1254, 1260, 1261, 1266, 1272,1277, 1281, 1284, 1285, 1293, 1296, 1299, 1300, 1302, 1305,1308, 1312, 1313, 1317, 1319, 1328, 1330, 1339, 1346: n = A,T,C or G
cnncntcaatnanntanntnnnancanttacactncanccnctataatnaatacatatcgggggatnttatctcncctccantancnttntactnctccccattatntctnttcnccatacatattctnntaanctnnatntanatcttcaantataatancnacccaatctatnactacnnntacttnaantctccactnttncgncntnccannccnntnatattatnccnattnaatcttnnccnccnttanacctcttcntttacnttaaactcatanctcattntnaanannatcntcnttctnatctcaaatcnnntcnnnaacttcatttctatttnnatacttttcncnataancttcanttatnaatcaanatnnnctttntnntanctcntntnatntnncattntcctnccantantanctntnttaanacattcncntntctatcacnnctnaacctatntanttntacnttntatctctnctntctntcctactcactatacnctcancatatactctacnanatatacattatcttcntnccatctcacattnatctatntctcacnnnaatatnttncacctccactntctantctatttanctntcantncttctccctctcttntntcttanntccttnccatntctctcannctnctcntcatatgatcactntgnngttctatatcntatncanactcacatcgatttactnacnntananaccctantnctatatactatntaatnntcatcatatntccaatattcntaaaccnncaattactcccactantatnttntcctactttaanaatgactnggtaatcatnacttaatactnttttctcatnaccatnttaccnnntactntnactctctttatcatcatntncnttanatttcantcatacttngtaattntttntttcncantatatnaanttatcnaattttaccgtctacacatacntcattatcatctatctctcactatacttncntactnatntcttatctatcnatnctatatctntnnacatcnctncncnnatntcacctccnttccttcacnatanaacttntatcttacatctctatatatacncctactcatttatcaactctntcanaacannnntnntnntntantctannannccntatttnatacntanacatagactntcacnnaatntctcnttatcactntntatannatacacttnttctatacntacttnnttctncatatntatcnctanatnnttatccantanttnntntcnccnattnnaaananttacagcancnaaataaatntttattnntctaccttnttnatcttgtnccttccttnanaatttaattnnctnnctnctcttnaaactncacccntatcaccctntcnttcccatnntnnatcattacaatcattnnactaactanc

SEQ ID NO: 5243 - DNA, 741 bp, Homo sapiens
  misc_feature 2, 15, 415, 496, 503, 607, 643, 674, 676, 678, 680, 682,683, 687, 688, 697, 702, 711, 712, 713, 714, 717, 718, 721,723, 724, 729, 732, 733, 735: n = A,T,C or G
gnttaatgcctttcnattgcttggctctcgatctttctgcaggatcccatcgattcggtcctacccaaacctgtggccgccacttttgaattctcagattgccctgaattttgccacttttaaataatgtgctgaataagctcagcaactaaaaaccattacccaagaacgtttcttgtgagtgagctgatttattctgattcattatattccttttggtagattttataccccttggggaaataatacaacaaaaacatctcttaaaaatgctgggatggggccatatctactagcagaggccagatggtcagatatgatttctgcaaacccatcttgaccttgagtatgtgaaggggtactgtactttattcctgatacattttggtttccatgtaggtgttgagctcctggntttctgtgtttggatgatgaagatttggacccttccattcataatccctttctaagtgaagggagaggctggcttggctgntccttgntattccgaaagccctggtttggggcccatgttcacactggctctcagtctagtcaggtgcaatgttcttgagaggtggggacctaattattaccagagtagcancaagagaggaaacgttgtgaattaagtattcaattnaaaaaggaacatgatttctacctgaaaaaangnanangnncctnncttgattancttcntaatccttnnnnatnnaancnntcctnaannantttaat

SEQ ID NO: 5244 - DNA, 768 bp, Homo sapiens
  misc_feature 2, 3, 4, 8, 12, 23, 131, 616, 627, 644, 649, 657, 682, 702,722, 756, 759, 766: n = A,T,C or G
tnnnttcngttnactcgtttganttcctatacaagctacttgttctttttgcaggatcccatcgattcgaattcggcacgaggcctgattgaggaagagaacatgctggcaccatctctgaagcagttttncctacgagtggagatttgccatcctacattccagtgagggttgctgaaaaaatcctatttgttggagaatctgccagatgtttgagaatcaaaatgtgaacctgactagaaaaggatccattttgaaaaaccaggaagacacttttgctgcagagctgcacccgtctcaaacagcagccactcttcaacttggtggactttgaacaggtggtgggatcgcattcgcagcactgtggctgagcatctctggaagttgatggtagaaagaatccgatttactgggtcagctgaagatcattaaagacttttaccttctgggacgtggagaactgttcaggccttcattgacacaactcacacatgttgaaaacaccacccactgcagtaactgagcatgatgtgaatgtggcctttcaacagtcagcacacaaggtattgctagatgatgacaaccttctcctctgttgcactttgacaatcgagtntcaccggaaanggagcacaaagatgctnctcangcaagaanaagggccttctcgggaaacttcttnccccgggaaagcccctgcantcttggctgggcagccctangtcttttcttacaaaagtacaagtgggccccccnccntttttanct

SEQ ID NO: 5245 - DNA, 463 bp, Homo sapiens
  misc_feature 7, 8, 25, 79, 80, 86, 87, 92, 94, 96, 101, 122, 140, 154,155, 162, 169, 171, 174, 175, 177, 182, 183, 189, 191, 192,194, 196, 198, 201, 202, 203, 204, 205, 207, 215, 216, 218,221, 222, 223, 224, 225, 227, 228, 231, 235, 240, 245: n = A,T,C or G
  misc_feature 253, 256, 259, 263, 274, 285, 292, 304, 306, 318, 324, 339,341, 345, 349, 365, 370, 373, 378, 379, 380, 381, 389, 393,394, 397, 398, 399, 405, 406, 408, 410, 413, 417, 424, 425,430, 437, 439, 440, 445, 453, 457: n = A,T,C or G
tttcatnntttacaagctacttgtnccaagatcccatcgattcgaattcggcacgaggctagaagttcaacgggagacnnattatnnccatngnanacttncggaacctcgggttctgagtngtgctctcctcaactgcncgggtgagccttannccctggnttgtgcnanaannanacctnngtttantnngntncnccnnnnncntcttaaanncntannnnntnnagngctntaaancccangtgagctnatnaancaanaattggagcgnattgcatcccngactagngcggatgaactntntacagatgaccnatcatncttccttgagccaangngganaacnctgccgctatagaccntggcnatnactcnnnnttgacatnagannatnnnctaacnntncnaanattnctaggcnntccgnttctcangnnttatntttaacanctgnttcatg

SEQ ID NO: 5246 - DNA, 773 bp, Homo sapiens
  misc_feature 22, 24, 26, 37, 45, 49, 52, 65, 66, 68, 72, 77, 96, 100,102, 112, 115, 118, 120, 121, 122, 138, 147, 160, 183, 185,189, 218, 225, 229, 233, 234, 240, 244, 253, 254, 255, 262,268, 271, 272, 282, 286, 291, 296, 303, 313, 321, 332: n = A,T,C or G
  misc_feature 337, 338, 341, 345, 346, 352, 353, 355, 379, 382, 386, 392,402, 408, 412, 416, 419, 420, 428, 434, 439, 442, 443, 444,447, 457, 458, 459, 469, 471, 476, 477, 480, 490, 505, 514,516, 527, 535, 537, 541, 548, 553, 555, 564, 565, 590: n = A,T,C or G
  misc_feature 594, 615, 616, 623, 632, 633, 635, 642, 648, 649, 656, 661,666, 668, 696, 697, 699, 701, 705, 724, 743, 748, 749, 754,755, 758, 760: n = A,T,C or G
aaacatcttgaacccgtttgantncntatacaaactnctggatgnttgngcnggatcccatcganncnaatncggcncgagggcatagtcagaccntgtntnaaaaataatnatnatnannnaacccagtgtggggtnattcctttngattactattatnttgttctcagaacaattgatttnantttnatagactttctagcccttatataataatnctgagtnctcngccnncataanaaanctggaaaannnctgatcnagaaanaannggtactactntgangaatntttangactatnatactgagtncaatatgnaacacaattcngcgtnnctncctnngatganncntaaaatatttgaaaatttgattgnatnaaanagcatnttggataccnggaganactnatgntcnngacattangacatnctgtntgnnngangctcccgtcnnnaggaagccantnttccnnaanactaccttgntaatataaccgggancgggctttngnacctgccattntattgatnanattnaatgttnatatncnggaaaaaannggctcatgccgtgaaatgtggggtncatnacaagggaaaagttttctggnngcggatnacttctggnnanaactcangttctnncggactnggatntaatncnctccctttgctaggtttcctcccagganncngnttcnaaaggcgaatcaaatgccngccaacatttcaaattttnaagannggggnnccncnaaaaaaaaaaaat

SEQ ID NO: 5247 - DNA, 777 bp, Homo sapiens
  misc_feature 4, 6, 19, 20, 22, 30, 99, 100, 198, 277, 302, 307, 414, 452,467, 560, 629, 634, 644, 651, 654, 670, 691, 725, 735, 743,744, 763, 764, 767, 769: n = A,T,C or G
ttcnantcttttctaaatnncnggtcttgntctttctgcaggatcccatgcgattcgtgctattgtaataataacaataaagagaaattagaagtgggnntcagggtagaaaaaaatgcaaaggccttggtccctaggagaccaacactccagctgagctggccttagccccagccccttctaatttctctttattgntattattattattttctctgctattgtaatatttttttgttaattaaatgttttggtcaaaaaaaaaaaaaaaaaaaanaaaaaaaaaaaactcgagcctctanaactntagtgagtcgtattaccgtagatccagacatgataagatacattgatgagtttggacaaaccacaactagaatgcagtgaaaaaaatgctttatttgtgaaatttgngatgctattgctttatttgtaaccattataagctgcantaaacaagttaacancaacaattgcattcattttatgtttcaggttcagggggaggtgtgggaggttttttaattcccggcccgcggcgccaatgcattgggcccggncccaccttttgttccctttagtgaggggttaaattccccccttggcgtaatcatggtcattagctgttncctgngggaaattgnttttccngtnacaattccacacaacntaccaacccgggagcataaangtgttaaaaccctggggggcctaatgaagtggancttacttccnattaattnncgttgcgcctcctggcccnnttncnagtcggga

SEQ ID NO: 5248 - DNA, 863 bp, Homo sapiens
  misc_feature 3, 4, 10, 12, 17, 21, 34, 36, 38, 45, 52, 57, 59, 70, 73,74, 78, 79, 106, 108, 110, 111, 113, 115, 119, 122, 126,138, 142, 144, 145, 146, 157, 176, 182, 185, 191, 195, 197,200, 203, 205, 206, 211, 213, 214, 223, 225, 227, 233, 240: n = A,T,C or G
  misc_feature 250, 253, 255, 265, 268, 269, 270, 272, 287, 296, 297, 302,303, 304, 307, 312, 320, 325, 331, 338, 345, 353, 354, 361,367, 370, 372, 377, 379, 380, 381, 382, 385, 394, 403, 406,413, 420, 422, 426, 430, 435, 436, 438, 443, 448, 450: n = A,T,C or G
  misc_feature 456, 459, 475, 477, 480, 481, 482, 486, 489, 495, 498, 504,522, 535, 546, 566, 568, 570, 577, 583, 587, 589, 590, 592,593, 596, 597, 600, 601, 603, 605, 619, 622, 623, 636, 638,642, 643, 651, 652, 659, 664, 665, 669, 673, 682, 698: n = A,T,C or G
  misc_feature 703, 711, 715, 717, 719, 721, 723, 727, 729, 730, 731, 740,744, 745, 750, 752, 758, 761, 770, 781, 798, 800, 803, 804,806, 807, 808, 824, 825, 835, 838, 841, 842, 858, 861: n = A,T,C or G
ccnnactttncnattangtgnagccctcgcccanananattggcntgggctnaacgnanattatcttctnacnnatanntgtgtgcctattttttcataattcttnancnnangncttnttntaantgttccgctagnccanannntgcgctaacanatcagggcgccactgttgncggatnacnactgcnattngngcnctntnncattncnnaattgcgcntntnaaatcngatcggntcacatgaanatnanaacgtatatnatnnncnaacttgagatcttcnttcacgggnnctctnnnacngcttnatgactcntggtnacagcnccacggntcatcangcccccanngaaatgngactantcncntggancnnnntgnaacacctgnccttcacangtnactgatnaaggctnanctgntcangacanncnttaanccttncngcttcngtnctggaaccagaaggantnttnnnaaanggntcgatnacnccctantagtcttacctactgcanccatcactggaancatgctaatanggtcatgtggtcagtgtaancntnatcaatngaaacncccncnnannttnnccnntnanctcaacctaaatantcnnctttttaaataantncacnncaatggtnnaaactancctannaatnggcngttcccctngaatgcctccttctcnaagcntgcacacnttcntntngnancccnannntttaccctntcgnnatccncntgggcnttncctttattnatccacctatnggcttccccaaagaacntnctnngnnncaatcatccttgggannacttcctccnttnggnnaataacggcgcaaaanttnct

SEQ ID NO: 5249 - DNA, 424 bp, Homo sapiens
  misc_feature 3, 12, 13, 14, 29, 33, 38, 320, 353: n = A,T,C or G
ccntcgaattcnnncgaggagaaaagctntcangttanctgtttggcttataagggaaacctgcagtcctttctgaaaggggagctgtgaatatgactgctttgtagaaagatgtcttaggattctgggtgaaaatttttaattcccctcatgtaggaatgtcacagagtgtacctttttgacttagtattttcctagtaaaatacacctttcttaagaaaatggctacaaagtcagatgcatgtaaatgctttcagcaagggtttattgatcatctgctttaggctgggctctatgttaggtgcctgtggattccattntagtacctgtgttctcatagaattgaatcctgntcccccatatgacttttgatgatattcacactgttaattccaataaagacagagtagacaaacagaaactg

SEQ ID NO: 5250 - DNA, 739 bp, Homo sapiens
  misc_feature 2, 3, 12, 19, 27, 41, 42, 43, 48, 479, 563, 654, 677, 706,733: n = A,T,C or G
gnntcaatgctnttctctngttctttntgcaggatttcatnnnctcgnattcggcacgagagaaaaacaacagagagaaaaagaatcctgagaatatgtagaagctttacgagcccaaatccaggagaaaatgcagctgtataatattactttacctccactatgctgttgtggtcctgatttttgggatgctcatcctgatacctgtgccaacaactgtattttctataaaaaccacagagcatatactcgggcactacattcattcatcaattcctgtgatgtccctgggggtaattcaactcttcgagtcgcaattcataattttgcttctgcacacaggcggactttgaaaaatctataataagaatctgaaattaactggtagtattttggcttttacttaaaatcatccctgagagagtatttaagaaaagctgttcaagttataaaatatataatctggaaagaaatactgnctcatataataattagattggaatcattggtttaatctctgtctgggaaccaagattgaaagctgacttacttctctcttctgncttgtgaaccataccggagcctattatttttaaaatatgatcagacaagtaaggcttctcttacttttgctctgctctggatcaggaagancctcatggtgaagtctttgagantctcttattaatcatctttcttaaactgngtttttgagcctgacagtactgaaaangctggg

SEQ ID NO: 5251 - DNA, 784 bp, Homo sapiens
  misc_feature 2, 12, 15, 24, 33, 37, 42, 90, 92, 94, 97, 115, 123, 127,131, 146, 149, 156, 165, 177, 191, 192, 196, 217, 218, 223,226, 227, 231, 238, 244, 279, 288, 311, 318, 323, 327, 375,377, 380, 424, 425, 429, 430, 436, 440, 444, 449, 453: n = A,T,C or G
  misc_feature 456, 457, 479, 480, 511, 512, 517, 523, 543, 545, 568, 569,595, 606, 607, 622, 623, 661, 662, 664, 668, 669, 672, 673,685, 695, 696, 704, 707, 711, 714, 722, 723, 725, 735, 753,761, 764, 766: n = A,T,C or G
cntcagcggccntgnatccaaagntgggggcgngcgnacganctgcgagcctgccttacgaggccgcaagccctttttgccaccctcggngncnggncgttccggccgttttggnggcatcanccgnccgncatggcagtgaacgnccngcaggcnccagccacngcctggggctanagattaaattgacnncccnagacccggcattatcaggagnngctanganncttnctgcatnctcggnaaactagcataagccaaagactcgccatgcagaantattagcanatagctgcgctcgataaaggaangaggagntaaanaatnaactagtgaaaacaagggagatggtggctttatcgtgggttagagctntnganctatgatgtcatcggctagatactatgtgaaatatcttactacnnttanncatgcnaatnagantgagnaagnctnngaccaagccccctttaatgagnncaagaaaaactcttggctggtagaggaaagnnaatcnagctanaactcggtgcacgaatatgngntcatatccaggcaaaccgggagnntgttgtaaacggtcaggaccaatggnaaccccttttnncctctgggggccttnngttggccaagggaacgcaattaaggaaccttaaatgcnnantagnnccnncaatttcccggnccatggaaannccaattgnccnggantgncccccttnngnccttgcctcnccccaaaagggggtttgnccaccaangtngnttggggaaaacaattccg

SEQ ID NO: 5252 - DNA, 1327 bp, Homo sapiens
  misc_feature 2, 3, 4, 5, 9, 12, 18, 24, 32, 79, 92, 95, 98, 100, 106,107, 116, 120, 122, 128, 129, 130, 135, 137, 138, 139, 143,145, 158, 164, 175, 179, 188, 190, 191, 194, 203, 218, 223,226, 228, 230, 236, 239, 240, 243, 246, 248, 260, 263: n = A,T,C or G
  misc_feature 266, 271, 277, 278, 280, 283, 285, 291, 293, 299, 301, 313,320, 330, 339, 342, 343, 344, 345, 347, 349, 356, 357, 358,362, 365, 367, 381, 382, 391, 394, 395, 397, 415, 416, 419,438, 440, 441, 443, 448, 451, 453, 455, 474, 513, 519: n = A,T,C or G
  misc_feature 520, 532, 534, 537, 539, 542, 544, 554, 555, 557, 559, 560,565, 571, 573, 578, 580, 581, 590, 598, 599, 609, 615, 632,639, 652, 660, 666, 693, 704, 711, 747, 750, 755, 763, 764,781, 786, 787, 790, 794, 797, 800, 803, 820, 822, 834: n = A,T,C or G
  misc_feature 838, 849, 851, 854, 857, 865, 868, 872, 875, 882, 885, 890,891, 904, 907, 909, 924, 930, 931, 938, 949, 957, 958, 965,967, 968, 969, 971, 989, 997, 998, 1003, 1006, 1007, 1008,1012, 1020, 1031, 1035, 1040, 1044, 1045, 1060, 1069: n = A,T,C or G
  misc_feature 1082, 1084, 1101, 1109, 1130, 1132, 1133, 1137, 1150, 1159,1160, 1169, 1178, 1189, 1194, 1210, 1221, 1236, 1238, 1241,1250, 1269, 1276, 1288, 1298, 1321, 1322, 1326: n = A,T,C or G
gnnnngttnctnctcttnaaaccnttgctctngttctttttgcaggcatcccatcgattcgaattcggcacgaggggcnctgtctgcttgcngcntgnanacgatnngtttgatcntctntnaactannnacttncnnngttngncttattgcagttntcatcnaacgctaacantgtngtctctatnannatnttatgaagnacatatctacgcttnatgancantntntgtcanaannggncanancctatgtcgtgngcnttntttgncaattnnanaanangagctnanggatcnancgatgtgaaagnacagctntactctgaanacatgctcntcnnnntngnatgtccnnntacntancnaacgaaatattccnntaaagaccnganntnatatggacatacaagaanngtncttcaaaaaggtcctttantnnanagttnttncncnggtttgactaccttgtagntaatttactaggaattcttggtaatcgaaatccaacttnccgtcnnggaactcgttgngntcnantantnataaagtggnngngnngaaancctggnantaaangnnaaccctggncattggtnngacccattgngaattnacttttatcccaagttnggacccncttttacccccanttgccccnttgtgngcttttgcccccaaaaattcccccctntcccattaacncgttaanccaaatttttccgccggttaacaataaatttttttntanccctnaaataccnnggggtttccttaaaaancgtcnnatncctnaanttnccntttgaaatttccctttncncttctggggccnttantttgaaccccnanaanttnaacttggnccntccncgngtttaantcnaacannatttgcccttacntananaaaatctcctacctnttggtnncttcaanatttttgaacnttaatctnnattttanannnanttaaataaactgtaatcnttggaaanntactntgnnncccnaaattccnttatacacatnggtnttttnatgnnaccaaacttttgagnaaccgcatngtcttataacccncnaaatttcttccgtaccnccggggtntcttcaatctttacctcaaangnngaancgttttcctttgntttcttacnnatacggctncgtttctcntctatttttantccanctaatggtaattcacntttttccgganctcttctgacctatntnacntctcttcanatctccccctaaagtcctnaatctcnaacttccaattnttacccccantatcaatgttttccaatcccttnnttcnt

SEQ ID NO: 5253 - DNA, 1267 bp, Homo sapiens
  misc_feature 10, 11, 12, 15, 16, 18, 20, 30, 31, 39, 40, 45, 46, 51, 54,55, 71, 79, 84, 89, 93, 94, 96, 101, 107, 123, 125, 137,147, 164, 174, 181, 199, 210, 228, 236, 237, 239, 243, 246,248, 249, 255, 258, 263, 266, 268, 274, 275, 278, 281: n = A,T,C or G
  misc_feature 282, 285, 286, 287, 288, 289, 292, 295, 296, 297, 301, 302,304, 309, 311, 313, 314, 315, 316, 319, 320, 327, 331, 333,334, 335, 337, 339, 340, 343, 344, 346, 348, 349, 351, 352,353, 356, 362, 364, 365, 367, 368, 374, 378, 379, 382: n = A,T,C or G
  misc_feature 383, 384, 387, 390, 394, 395, 396, 399, 400, 401, 402, 403,407, 408, 410, 412, 413, 414, 421, 422, 423, 429, 435, 436,439, 441, 445, 453, 454, 456, 457, 459, 461, 466, 469, 472,479, 482, 484, 486, 488, 490, 496, 499, 501, 507, 510: n = A,T,C or G
  misc_feature 511, 513, 514, 519, 520, 521, 523, 528, 531, 537, 538, 540,542, 543, 545, 547, 548, 549, 552, 554, 555, 561, 563, 564,568, 570, 572, 577, 587, 588, 590, 592, 594, 598, 599, 602,603, 605, 607, 608, 611, 613, 617, 621, 623, 625, 631: n = A,T,C or G
  misc_feature 633, 638, 641, 642, 645, 646, 649, 653, 654, 657, 659, 660,662, 664, 669, 671, 674, 675, 683, 685, 691, 692, 694, 697,698, 700, 706, 709, 715, 716, 720, 721, 724, 726, 731, 737,741, 745, 746, 749, 753, 755, 759, 765, 770, 772, 779: n = A,T,C or G
  misc_feature 780, 781, 783, 784, 788, 789, 792, 795, 806, 819, 820, 828,831, 835, 844, 846, 848, 850, 852, 853, 855, 862, 864, 865,875, 876, 879, 883, 886, 891, 894, 901, 905, 907, 911, 914,916, 918, 922, 925, 930, 931, 935, 936, 938, 941, 945: n = A,T,C or G
ggcttctacnnnaanngntnggaaactcanncgctcganngcgcnngggangcnnctagatcacacggacngctaccancgagnagggntttnntnaccanaatcangacctaaatgcacggntntatgtaccctgnccaccatctngtgcctctttatcattngcctcttccntcctatntcccttgcgttaaggaanaaaaatggtgncacaatttgtcaaaagtnattttaanngnaaanccntnncatganagnaaccntgnanttcaanncgnctnnaannnnnctnctnnnccanngnggacntngnnnntcnnaaccctnactntnnntncnnganncncnnannnccnatatcntnncnngagttnaatnncannncancantttnnntannnnngaannangnnnaattgannncttgtnccgganntancntcangatcccannannantnccgancgnaanttctatnaantntncnancaccanatncngtcganacnncnncgtcnnncngcacnatncactgnnantnnancnnnagncnncactgnanntacngnanctacnagcgctgacnntncntntccnngcnngncnngtncngtanatcncncnatcatntnagatntcnnttnnatntacnnatntnnantntcganantgnntcagcgancntatatnngnganncnacctanagngcacannacanntcnanacganacactnctcncagnnatnttcngncgtnctctgntgagncnctacacnnngnncacnnctntancagagtaatcncacactgtaatcnntataccanaantctncgtacgcanancncncnnanagcatcncnntgctgacgtnnacncatntcnacatntcngcacgtncatntntcantancncnaatntcntatgnnctanngntcnatcntatatatnntnnttgatatgnntntncgntancanacacgnacngngnacanacancncactnnannnanganncacncancncntnangncannnttngnnnnctcgcnanancgtagnatacgntactcagngcntancacncganncgcgantatctcncaananactnnncgctnnnanntatcactntctcntacatcgantctcngcngatctacncgctcagtnncnnctgannnnatatnagnatcnctcncatngatnanantannaancactgnnncnncnaacgngtncgcntanaagtagancgnnctcg

SEQ ID NO: 5254 - DNA, 462 bp, Homo sapiens
  misc_feature 3, 8, 50, 54, 55, 56, 58, 60, 61, 66, 70, 71, 74, 75, 82,83, 84, 92, 98, 99, 111, 112, 126, 129, 130, 168, 176, 216,265, 416, 456: n = A,T,C or G
tgngactntttgaactcctgttctttttgcaggatcccatcgattcgatnatgnnncnanncactntganngtnnatttatnnntttctccnattccnnaactaatgggannccggtgctggtatnganncttggggaaaatacctggagataccagtgcagctattnaaagctgnagcaagggctgcaatcttgcggagattttaaagagaagtnttaaagtttctaatactgatgcctctttttggtaaatacaagttttatnaatcctgccctgggatcctgattccccattaatcaagatttgtcagacttcaccttctataattagaaaacacagttataagaacagtcaattttttaaattttccaaattaaaaaattgcaccatgattttgaacaagcacttccaattncattacccatcttgtatgccataggtgggagtataattgncacagc

SEQ ID NO: 5255 - DNA, 765 bp, Homo sapiens
  misc_feature 2, 3, 4, 5, 10, 13, 14, 592, 631, 664, 710: n = A,T,C or G
tnnnnttttnaannttttcctaatgctggtctcgttctttccgcaggatcccatcgattcgtttgtgctttttaagaatatttttagactatttctttttataggggctttgctgaattctaacattaaatcacagcccaaaatttgatggactaattattattttaaaatatatgaagacaataattctacatgttgtcttaagatggaaatacagttatttcatcttttattcaaggaagttttaactttaatacagctcagtaaatggcttcttctagaatgtaaagttatgtatttaaagttgtatcttgacacaggaaatgggaaaaaacttaaaaattaatatggtgtatttttccaaatgaaaaatctcaattgaaagcttttaaaatgtagaaacttaaacacaccttcctgtggaggctgagatgaaaactagggctcattttcctgacatttgtttattttttggaagagacaaagatttcttctgcactctgagcccataggtctcagagagttaataggagtatttttgggctattgcataaggagccactgctgccaccacttttggattttatgggangctccttcatcgaatgctaaacctttgagtagaagtctncctggatcacataccaggtcagggaggatctgntcttcctctacgtttatcctggcatgtgctagggtaaacgaaggcntaataagccatggctgacctttggagcaccagtgccaggacttgtcttcatgtgt

SEQ ID NO: 5256 - DNA, 754 bp, Homo sapiens
  misc_feature 2, 3, 6, 8, 11, 12, 13, 27, 46, 138, 145, 212, 263, 274,310, 311, 339, 350, 352, 365, 368, 371, 407, 418, 422, 426,473, 475, 500, 662, 684, 709, 754: n = A,T,C or G
gnnttnanttnnnttccctttcaaatncttggctacttgttctttntgcagggatcccatcgattcgaattcggcacgagggaacctactagatggacaggctgaggtgtttggcagtgatgatgaccacattcagtntgtgcanaaaaagccaccacgtgagaatggccataagcagataagtagcagttcaactggatgtctctcttctncaaatgctacagtacaaagccctaagcatgagtggaaaatcgttgcttcanaaaagacttcnaataacacttacttgtgcctggctgtgctggatggnntattctgtgtcatttttcttcatggganaaacagcccananagctcaccaacangtnctncaaaactaagtaagagtttaagctttgagatgcaanatgatgagctnatcnaaangcccatgtctcctatgcagtacgcacgatctggtctgggaacagcananatgaatggcaaactcatagctgcangtggctataacagagaggaatgtcttcgaacagttgaatgctataattcacatacagatcactggtcctttcttgctcccatgagaacaccaagagcccgatttcaaatggctgtactcatgggccagcttttatgtggtacgtggatcaaatgggccactnaaattgacctgaagtggtggancagattaatgaattcaaaccatagnatgactgggttcctgtttcagaatttgagaactaacccgggtgtn

SEQ ID NO: 5257 - DNA, 1119 bp, Homo sapiens
  misc_feature 1, 3, 7, 8, 9, 10, 13, 15, 16, 19, 21, 23, 27, 28, 29, 34,35, 42, 44, 45, 46, 47, 48, 50, 51, 52, 57, 64, 67, 68,69, 72, 75, 76, 78, 81, 84, 88, 91, 100, 101, 102, 103,116, 117, 119, 120, 122, 137, 142, 149, 160, 173, 191, 192: n = A,T,C or G
  misc_feature 196, 201, 204, 211, 222, 230, 239, 240, 243, 244, 246, 249,257, 264, 266, 274, 276, 278, 284, 309, 331, 358, 366, 381,391, 414, 439, 456, 464, 491, 502, 530, 534, 540, 541, 551,563, 565, 570, 583, 585, 588, 592, 602, 612, 615, 622: n = A,T,C or G
  misc_feature 627, 635, 638, 647, 659, 678, 680, 683, 686, 689, 692, 701,708, 716, 731, 741, 750, 753, 755, 757, 761, 765, 770, 773,774, 778, 780, 783, 787, 790, 791, 795, 799, 801, 802, 807,811, 813, 820, 829, 835, 839, 843, 844, 847, 848, 849: n = A,T,C or G
  misc_feature 851, 857, 861, 863, 865, 871, 873, 874, 884, 886, 892, 896,904, 920, 922, 923, 924, 926, 932, 937, 942, 952, 954, 955,957, 968, 975, 976, 978, 979, 1001, 1006, 1008, 1011, 1015,1016, 1017, 1027, 1028, 1031, 1035, 1036, 1038, 1043: n = A,T,C or G
  misc_feature 1045, 1052, 1055, 1056, 1059, 1061, 1067, 1069, 1073, 1081,1085, 1089, 1107, 1110, 1111, 1113, 1115: n = A,T,C or G
ncncacnnnncantnntcnananccannnccaanncctcacncnnnnnannntctcnaaaccanccnnncgnctnncnatnacncaanggnaaggggcannnngattctagttttnntnnanttttttgaaaggccntttcnagagtcncttggcaagcngcttctaccagangaattcggcacgagaatnntccngtatntgnctcttcnaccctagaatnacttatanacgtataanntanncntcnaaatactnacaggtntnaaaataangntnatcaantactaatttaattctgtttcatcanaaagcacgaccatcgtggcatngaaacttgagttatagcctactatcangatcaatntaaaaaatatatatntagggctggntgcacgtggtgcacatctgtaancccaagtgctttgggaggctgaggngggtgaatcacctgaangtcacganttcaagaccaacctggtcaacatgacnataaccccatncctacaacaaaaatgtaacaaattagcnacgngttggnnacacacaccntatcactctacntncaatngggggcccgaatncngtngaanaatccgcctntgatctcttnagnaaacatncaaangcctgctncanaagctaatncatcattgcccnacctggaacttccaatccntnatngcnaancancaatctacncaccacntggtcccntaatatacggaacanactcacatcngactatctnaanantnccanagcnataanggnnacantnacnccancanntttncaancnntgccnaaananatacccnacaacaatntctagnacantatnnacnnncntttacncatncncncacatntnncccaaactcnantacacntccntcacactntcactcctctcctacntnnncnaaaaanactcntccgnaacccctccntnnantatacctcatntataccnnannaatctcctaacattttaccatntctcntnatncccnnnacacactttnnctnaacnncntctcnanataacgnaanntananctctcnangatntccaaaanactncacnaaattttgtcgcaaaaangtnntntnaccc

SEQ ID NO: 5258 - DNA, 788 bp, Homo sapiens
  misc_feature 2, 6, 7, 11, 15, 39, 44, 66, 67, 70, 74, 76, 78, 80, 85,92, 95, 101, 106, 107, 108, 109, 126, 129, 138, 140, 145,148, 150, 153, 159, 163, 166, 167, 180, 184, 186, 195, 198,201, 202, 207, 208, 214, 220, 224, 230, 235, 239, 244, 246: n = A,T,C or G
  misc_feature 251, 260, 274, 277, 283, 284, 285, 287, 291, 299, 304, 315,335, 341, 349, 351, 365, 369, 373, 381, 391, 392, 395, 401,405, 408, 410, 418, 421, 426, 437, 438, 446, 453, 465, 466,477, 485, 501, 512, 521, 523, 528, 532, 542, 543, 546: n = A,T,C or G
  misc_feature 547, 550, 554, 568, 571, 592, 593, 616, 621, 623, 629, 633,634, 637, 645, 650, 652, 656, 657, 666, 672, 674, 676, 679,683, 690, 692, 695, 698, 701, 704, 707, 708, 710, 714, 716,725, 726, 728, 735, 736, 743, 747, 749, 752, 753, 754: n = A,T,C or G
  misc_feature 759, 760, 762, 771, 772, 773, 774: n = A,T,C or G
gntttnnttcntttncttttcaaatccttggctactttnaattnctgcaggatcccatcgattcgnnttnggcncnangnggatntggcttntgnggaatnggatnnnnagctggtcgatgacggncancggatagananactgnagnanccntgctcnttgnagnncagtgctgtttangaanangatctcatngtntgnnttgannctctgnatgganccanggcgtntaccnaaantattntngacantgtgacacntcattattggaatngantatgannnanatgncatagcangaganataaaccagcnatattacaactatctcgcancgaccngatgctgngntctggaagacaatntggngagntttaggtntagcgccgtnnggntttcanctgntanangaacctgntgngaaanacattatcacnnctactcgntcctatngcaacaagaagnngctgactgtgntgctgctntgaactcctatgctgngctgctagtangatgagcangnaatangatnatcagctgannganngcnaagnctctgcttattgtntgngcaaatgctggttgtaagganntgaggttactttgcgctttgggnaagtncntactanattnnttnttgggacngcaangntttnnccgggtgancccaangngnaantggnaccttantnganccnatnaanggnntntcananggcatagtnnancctggannaaaggangttncnagnnntttanntncgggaaatnnnngacttactttttcg

SEQ ID NO: 5259 - DNA, 1411 bp, Homo sapiens
  misc_feature 5, 6, 7, 8, 9, 10, 11, 36, 39, 61, 62, 77, 78, 112, 113,123, 128, 129, 131, 132, 134, 136, 138, 139, 143, 144, 145,147, 148, 150, 151, 152, 153, 154, 155, 160, 161, 162, 164,170, 171, 172, 173, 174, 175, 178, 179, 180, 181, 182: n = A,T,C or G
  misc_feature 183, 185, 188, 189, 190, 191, 193, 195, 197, 198, 200, 201,202, 204, 205, 208, 212, 216, 217, 219, 221, 226, 230, 231,235, 243, 246, 249, 252, 253, 264, 267, 268, 274, 275, 278,280, 284, 287, 305, 309, 310, 313, 317, 323, 326, 331: n = A,T,C or G
  misc_feature 336, 338, 342, 352, 354, 359, 360, 364, 365, 369, 370, 376,377, 380, 384, 387, 392, 393, 398, 400, 408, 410, 417, 420,425, 427, 430, 431, 432, 434, 436, 438, 446, 447, 448, 452,454, 461, 467, 477, 478, 481, 484, 489, 490, 493, 501: n = A,T,C or G
  misc_feature 504, 505, 510, 518, 520, 521, 522, 527, 532, 545, 546, 550,555, 556, 557, 563, 569, 570, 571, 578, 584, 592, 594, 595,596, 600, 601, 611, 615, 616, 617, 618, 622, 624, 632, 641,643, 645, 648, 651, 656, 657, 660, 662, 669, 673, 676: n = A,T,C or G
  misc_feature 679, 682, 693, 696, 697, 706, 708, 709, 713, 726, 728, 734,735, 737, 741, 743, 745, 749, 750, 751, 752, 754, 757, 760,761, 762, 763, 773, 774, 776, 778, 783, 786, 799, 800, 803,804, 805, 806, 813, 816, 817, 820, 822, 824, 833, 834: n = A,T,C or G
  misc_feature 838, 839, 840, 843, 849, 852, 855, 860, 862, 863, 866, 868,872, 873, 874, 875, 881, 883, 894, 902, 909, 920, 921, 922,923, 930, 931, 933, 936, 937, 943, 949, 952, 956, 957, 962,965, 966, 967, 974, 975, 979, 984, 985, 988, 989, 993: n = A,T,C or G
ttgtnnnnnnngttttttttggcggtaaaaaaaaanggntttttttttggggggaaaaaannggggccgtttggctnngtggaaaaaaccccccttttttggggggaaaccnnttttcggggngaaanngnncncngnngggnnngnngnnnnnnggggnnngngagggnnnnnnggnnnnnngnggnnnngngntnngnnnannggngggngggnngnanttttnttgnnaggnggaggganttnttnggnngttttttttgncgnncggggnnggntngggnagnggggggcgagggaggggngggnncgngggnggaganagnaaggnagggngnggangcgtggggtngnggganngggnnagannaggcgnnatnaggnggnggggnngggangngggggagngngggtagnagnggggngnggnnngngngngggagggnnngcgnangggacgncacagngggggtcaannggnganggganntgnggaatgcnggnngggcncgggggcngnnnggagnggggntgggacagggtgnnggangccannnaggggngggggnnngccgagngcattnggtagcangnnnggcnnttcggggggngccnnnnggtnantgacgcgngcggggggngnanatncanggggnnagngnggggaanggcnccncgngtntgggggggganccnntgagggggngnnaagnaggggggggaagncngccaanngngtgntncngggnnnnanggngannnngggggggganngngncgggnganggggggggaaccnngtnnnngagaagnccnntgnangntgggagggnncggnnncangggggnggncanggggngnnaanantgcnnnngggggngnggaggatggcnggggagcntgggganagatgggggannnnagagcgnngnagnngtgtgngggggnggngatnnagagngtnnnggggggnngggnggggnnganngagngangggggnnaaaagnnanagggctantgggggggggnngannggnaaagagggggggggggggggngananngnngcgagngngnnggnaaanggggngnaaggggngntgnnngggggganaggggggntntnngngnngtancntngggaannnggggggggagngngcagaagnncngggggggnngtgnaaaangaaantgngggggggnannnacaggggggnannaggnangggggcnccganagctanggaggggnnnnnnnggnggtgngggggnganngggagaanaggggggggggtngngnaaggggggggnnaanagggggggannaaaaagagtnngggggggnagaanngnnaggggganggggngaggnggggatggggggggggnncacncannaccgcgn

SEQ ID NO: 5260 - DNA, 768 bp, Homo sapiens
  misc_feature 2, 10, 31, 54, 61, 65, 66, 78, 88, 90, 92, 96, 104, 107,119, 123, 124, 128, 130, 133, 143, 151, 153, 155, 160, 161,172, 176, 180, 191, 196, 207, 212, 217, 222, 223, 237, 240,244, 249, 251, 259, 263, 265, 274, 292, 296, 306, 322: n = A,T,C or G
  misc_feature 323, 329, 331, 332, 347, 348, 351, 357, 366, 370, 371, 376,380, 383, 384, 396, 399, 402, 404, 406, 410, 421, 424, 428,440, 442, 447, 485, 491, 494, 510, 518, 520, 521, 526, 528,536, 552, 557, 561, 562, 564, 596, 609, 613, 632, 641: n = A,T,C or G
  misc_feature 672, 680, 681, 683, 694, 710, 715, 724, 726, 729, 742, 758,766, 767, 768: n = A,T,C or G
gncttttacnaatgcttggctacttgttctntttgcaggatcccatcgattcgnattccgnacanngggcatacttgntgccttccangngnactntcaccaangtntctggcgtacancgtnnagancngcntgaccgcacnccatcgtnangngcagnngtgccttgctnctgngaanggggccaagtncggtntgtcatgcctntgatnccacnactgnnggaagctgatgcangcngatnacttnangtcatganttcnanaccagactngccaacatggtgaaaccntatntttactatanacaagagtagatcganngtgggngnngcacacttgtaatcnnagntactcnagatgctgntgcnnaatanttgnttnnactctggagatngangtngnantganccaaaatcgcnccnctgngctccaacctgngngacanagtaagaccctgtctcataacaaacaaaatacaactcnagcctntanaactatagggaagtcnggattacntnnatccngncatgatanggatacatcgattgantttgnacanncnacaacttggattgcaggtgaaaaaaatgcttntattttgtgaaanattncagtgctattgcttttatnttgtaaccnattataagcttgcaaattaatcatgtttaancaacaacnngnttgcattcatnttatgtttcaagtttnaaggnggaacggtntnggnaaggttttttaantatggcggtccggcgnggtccaannn

SEQ ID NO: 5261 - DNA, 782 bp, Homo sapiens
  misc_feature 3, 4, 5, 21, 24, 25, 26, 39, 700, 721, 747, 751, 779, 781: n = A,T,C or G
tcnnnctttctaaatgccttnggnnntccctttctaatngcttggctacttgttctttttgcaggatcccatcgattcgaattcggcacgagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttcctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgaaccgaagagttttgggaacgcagtccggcagaaaaaaccggaaccggcgggaacatggtgtctatgcctcgtccaaagaagaaaaggattggaanaaggagaaatcgcgggatccnagaactatgacccgcaagaagggacnaganattaaccgggattagaaagtaggcacancnt

SEQ ID NO: 5262 - DNA, 747 bp, Homo sapiens
  misc_feature 3, 5, 631, 677: n = A,T,C or G
ggngnttttatcagctcttgttcttttgcaggatccctcgattcgaattcggcacgaggtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatnacagtgaacacactggggagacctgctttttttggaaaactcaaangtgctacttcctgattcaaagaaatattctcatgttggtcattctagtttatattttcatttaaaatcct

SEQ ID NO: 5263 - DNA, 748 bp, Homo sapiens
  misc_feature 2, 5, 6, 10, 23, 35, 452, 461, 632, 633, 676, 728, 747, 748: n = A,T,C or G
gnttnnttcntttcctttcaatncttggctcttgntctttctgcaggatcccatcgattcgaattcggcacgagcagagctgtgatctgcccccaggtattctgacccccaaactggctctcaaccatgtttacatgatgaaaagaagaggtgactgttgtatcagctctaaaggcctcacttttggtgaaatgggacctaaatttgattgcatacttgattacttgctgtcaatactgaaattggcacttcataattttaatactattgaactttcaccataaccctgtcctataaagttgacttgcaaatgaagaaactctatctcttcaatattataaaatatatccaagagtcacaactagtgagaaaaggacaggatctaactaacaatgtgaggctgtgtcttcacaccaattcaacagagtatcttgtaaatgttgagaggagangtactttangtcatggggtgtctttcaataaagtgctttagaaaacaggtgacaactgattgggccttgaagtatgaatggatttagccaggcaattaaataggaaagcagatactcaagacagattaaaacagctttgagagaagtgaaatgagcaagtgtaaagacaattgatactgnncatggattttagaaagtgtgaagtggagtgattgtgatgaaancttggaaagattgccttgggccaaggctgttgaaagctttggttttgcttanattaagtcaaatgccgtann

SEQ ID NO: 5264 - DNA, 748 bp, Homo sapiens; identical to SEQ ID NO: 5263
  misc_feature 2, 5, 6, 10, 23, 35, 452, 461, 632, 633, 676, 728, 747, 748: n = A,T,C or G

SEQ ID NO: 5265 - DNA, 1407 bp, Homo sapiens
  misc_feature 3, 10, 16, 18, 22, 75, 86, 88, 104, 105, 107, 112, 114, 115,128, 129, 142, 144, 160, 164, 167, 168, 170, 172, 173, 175,177, 180, 182, 188, 203, 207, 208, 210, 212, 224, 226, 231,239, 240, 241, 248, 251, 252, 253, 258, 261, 262: n = A,T,C or G
  misc_feature 263, 264, 266, 267, 268, 274, 276, 277, 279, 287, 291, 292,293, 294, 302, 303, 304, 312, 315, 317, 320, 321, 325, 326,329, 334, 338, 339, 340, 341, 344, 345, 350, 351, 352, 355,361, 368, 371, 375, 380, 383, 392, 400, 401, 402, 406: n = A,T,C or G
  misc_feature 407, 413, 418, 422, 423, 427, 431, 443, 447, 448, 452, 454,455, 458, 459, 465, 467, 476, 480, 481, 485, 487, 489, 499,513, 527, 531, 551, 553, 555, 563, 566, 567, 573, 577, 579,580, 593, 604, 612, 617, 623, 624, 627, 630, 637, 638: n = A,T,C or G
  misc_feature 654, 656, 681, 685, 687, 696, 697, 702, 712, 713, 715, 721,734, 739, 740, 751, 753, 754, 755, 760, 765, 766, 773, 774,781, 784, 791, 797, 798, 799, 801, 806, 808, 812, 813, 819,827, 829, 832, 833, 836, 840, 841, 842, 849, 850, 858: n = A,T,C or G
  misc_feature 865, 878, 883, 889, 890, 892, 893, 898, 900, 906, 911, 928,929, 934, 939, 944, 952, 958, 962, 970, 971, 973, 974, 975,977, 979, 986, 991, 993, 994, 999, 1002, 1009, 1011, 1013,1021, 1022, 1026, 1027, 1029, 1034, 1035, 1040, 1043: n = A,T,C or G
  misc_feature 1047, 1051, 1053, 1054, 1058, 1071, 1073, 1075, 1076, 1084,1089, 1104, 1106, 1113, 1115, 1117, 1118, 1123, 1124, 1128,1132, 1135, 1137, 1140, 1141, 1144, 1150, 1151, 1156, 1157,1160, 1167, 1176, 1179, 1181, 1184, 1185, 1186, 1198: n = A,T,C or G
ggnttattcnttcctncnaatncttggcacttttattctgcggatccctcgattcgaattcggcacgagggctanctggcctcgtngnactattgtatgtttgnngncctgngnncttaacacttttnngcagttgtgcttnanctaatgggctaattgntttnaanntngnngntntcnanttaacnttttctttaaatttnaaanngntnaataaatttctntnaatcnacccttannngtatatnaannncatanaannnnannnactttnanncntatttttnaaannnngacacctnnngatcaatntgntnaanntttnnatncctanctcnnnnagnnttttnnnaanccttcncctgganttnttgntcaanacngaattttcnttatctcnnntgcnnttttgngccancacnnttcntcancacctattgtgncctnngcgnannatnntttacncntgcggttgntatnnacancntnctcttgcatngcgtcattaacctntagtgtatccacanaganatattttttagaggcgtatntntnatcatagngannatactntcancnnaattagtgctttnaatattttatnctactaantgatntcttgnnagngtntcatatnngatcctaatattgttntntattttttgtaaccctattgtgcanttcncntataatatnnggganaatttgtgcnncntttatnttctctatattanacatnnatattgggggnannnttacnactcnnttatatnnagaaganctntactccntatgtnnnanataananactnntatacnctatattngnaannagncacnnnttggganngcttttanattactncatacatacatgnatgtntataannanngcttncnatatgngcacnaaaatactctatatgtnnttgcnttacnaacancactattnttatcntacnttattatnntnnntnancaacccnactcntnntatancgnctctctntntnctgtctcnntatnntntcgcnntctcnttnactntggngnntacntattattagagangngnngatttatntctcntctgcgctaatggantnacaagtncntnntatannatanattngtncnctnncantcaatnnttatnnctntacatgnattagcatnatntnccnnnttattgtttaantnacacccntcaagatnntctactatgagantacacancttctcanananntatgnctcaatgtanatcntcctcactcgngnttttctgtccacatnttntcanaacttctancntntactaatatnntctaaantnccncgtnnatnctctncangnngnctgcncntcctttngnnntnncatatgnggtancatttcntcncnct

SEQ ID NO: 5266 - DNA, 1407 bp, Homo sapiens; identical to SEQ ID NO: 5265
  misc_feature 3, 10, 16, 18, 22, 75, 86, 88, 104, 105, 107, 112, 114, 115,128, 129, 142, 144, 160, 164, 167, 168, 170, 172, 173, 175,177, 180, 182, 188, 203, 207, 208, 210, 212, 224, 226, 231,239, 240, 241, 248, 251, 252, 253, 258, 261, 262: n = A,T,C or G
  misc_feature 263, 264, 266, 267, 268, 274, 276, 277, 279, 287, 291, 292,293, 294, 302, 303, 304, 312, 315, 317, 320, 321, 325, 326,329, 334, 338, 339, 340, 341, 344, 345, 350, 351, 352, 355,361, 368, 371, 375, 380, 383, 392, 400, 401, 402, 406: n = A,T,C or G
  misc_feature 407, 413, 418, 422, 423, 427, 431, 443, 447, 448, 452, 454,455, 458, 459, 465, 467, 476, 480, 481, 485, 487, 489, 499,513, 527, 531, 551, 553, 555, 563, 566, 567, 573, 577, 579,580, 593, 604, 612, 617, 623, 624, 627, 630, 637, 638: n = A,T,C or G
  misc_feature 654, 656, 681, 685, 687, 696, 697, 702, 712, 713, 715, 721,734, 739, 740, 751, 753, 754, 755, 760, 765, 766, 773, 774,781, 784, 791, 797, 798, 799, 801, 806, 808, 812, 813, 819,827, 829, 832, 833, 836, 840, 841, 842, 849, 850, 858: n = A,T,C or G
  misc_feature 865, 878, 883, 889, 890, 892, 893, 898, 900, 906, 911, 928,929, 934, 939, 944, 952, 958, 962, 970, 971, 973, 974, 975,977, 979, 986, 991, 993, 994, 999, 1002, 1009, 1011, 1013,1021, 1022, 1026, 1027, 1029, 1034, 1035, 1040, 1043: n = A,T,C or G
  misc_feature 1047, 1051, 1053, 1054, 1058, 1071, 1073, 1075, 1076, 1084,1089, 1104, 1106, 1113, 1115, 1117, 1118, 1123, 1124, 1128,1132, 1135, 1137, 1140, 1141, 1144, 1150, 1151, 1156, 1157,1160, 1167, 1176, 1179, 1181, 1184, 1185, 1186, 1198: n = A,T,C or G

SEQ ID NO: 5267 - DNA, 804 bp, Homo sapiens
  misc_feature 6, 10, 68, 69, 70, 71, 74, 83, 96, 97, 98, 100, 104, 105,111, 114, 117, 119, 121, 129, 130, 150, 154, 156, 172, 175,176, 188, 190, 199, 208, 216, 217, 229, 234, 265, 266, 267,270, 274, 276, 281, 286, 290, 295, 296, 297, 301, 302: n = A,T,C or G
  misc_feature 305, 306, 310, 312, 313, 315, 316, 320, 321, 322, 328, 329,332, 338, 340, 346, 347, 358, 363, 372, 376, 379, 387, 389,392, 397, 400, 402, 406, 407, 411, 421, 439, 441, 443, 444,451, 453, 454, 455, 465, 468, 473, 474, 478, 480, 492: n = A,T,C or G
  misc_feature 498, 502, 509, 516, 519, 521, 525, 526, 537, 540, 541, 544,552, 556, 558, 563, 569, 570, 571, 572, 573, 578, 584, 587,593, 594, 598, 609, 623, 632, 636, 644, 650, 659, 662, 683,687, 692, 694, 696, 702, 706, 709, 715, 716, 717, 718: n = A,T,C or G
  misc_feature 735, 738, 748, 749, 758, 761, 764, 765, 781, 791, 795, 796,798, 800, 802: n = A,T,C or G
ggttanttcntttcctttcaatccttggctacttgttctttctgcaggatcccatcgattcgaattcnnnncgnggaggcctncgcggcatctggnnncnttgnnatctgnttngcngntngagcgatnntcggctgttgtggacacgcntttnangcttctgttgtgcatntannttgattcacatngncttacacantgcctggangctgtctnntaggctaatgcnacttncacattgggagatacacctgctgatagtggnnnatngacncnctganttaangtgntggannngatnngtnntttnanngnntggnnnaaactnntcntattcncntgatgnnactttggatcncactnctgaggganatcngtnatggagcnanctngggcnggngnaccnncttntttttagaanatgaaatcatacatctgngngnntcagtgntnnnctggatatcngcntctgnnttantnacttccacccanagcatnatangacctcngacttanccngngtcnnagccttctganatnnggnctggaagnctgntnggctnccttannnnnccctnttgagnatnatgatnnaacncggctttgggnggttcccactgatntgacactgnctangcaagatncccaangatggcgantcntcttgcaatttgggaaggaantccnttttntncngcttgntagnatngccttnnnnataaccttgctttgaanttntttaaccccnntaatccagnttngannttgctttaggtaaaanccaattgcantcgnnananancg

SEQ ID NO: 5268 - DNA, 749 bp, Homo sapiens
  misc_feature 2, 5, 6, 8, 19, 30, 287, 408, 498, 513, 523, 626, 635, 637,638, 675, 681, 690, 709, 710, 748: n = A,T,C or G
gnttnncncctttcaattncttggctactngtctttttgcaggatcccatcgattcgaattcggcacgaggaggatctgccttctgaggaagtggatcacgagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatancaggagttattaaccagccatattacaactatgaggcaggaccagatgctgtgttggggaggacaatctggggagttttaggtttaggcgcctttgggtttcagctgaaagaagtccctgntgggaaacacattatcacaactactcgatcccatagcaacaagttggttactgactgtgttgctgctatgaaccccgatgctgtgctgcnagtaggaagagcaangaaataagantattcagctgattgaagcaaagcctcttgcttatgtatttgcaagtcctggttgtaagaaagtggggataccttgtgcttcagaaattattttaacatgctgntgggaggcnanntttaacccgatatcccattggggaatgttctttcaantcccanaaggttgtnaagcatatgaacttttctnngagtcctggcccactgtggaattatgactactatgcanc

SEQ ID NO: 5269 - DNA, 727 bp, Homo sapiens
  misc_feature 3, 7, 19, 25, 58, 60, 73, 76, 90, 100, 104, 115, 120, 123,126, 130, 133, 139, 149, 152, 160, 162, 167, 178, 181, 184,191, 195, 198, 201, 210, 229, 247, 250, 263, 279, 283, 284,290, 315, 324, 337, 340, 366, 378, 413, 418, 420, 436: n = A,T,C or G
  misc_feature 442, 449, 452, 461, 468, 469, 476, 487, 505, 507, 509, 511,516, 517, 518, 520, 532, 534, 545, 555, 563, 585, 589, 595,599, 603, 608, 619, 624, 640, 642, 649, 664, 669, 672, 678,679, 686, 713, 715, 722: n = A,T,C or G
tcnaatncttggctcttgntctttntgcaggatccctcgattcgaattcggcacgagntngagctggacactnagncacagtttagagtnttgatatatnactngaaaacagtancattnccnaanaccnatnaccccnaccctgtccnaangaatgatngntatgnatgtgaagttnatnttntgactcngatnatnacnttccacttnggatgcacaaccatgctgncctgtacagaagtcacangtnttgtgagaatttntaaactgatgatgtgnattnncatggnaacatgagtctacattttaccttcnatagtagcnatgaatcacaatnacntctttgtttataggttggtggaaaantaattgctgttntgccattgcttttaatggctgccacaactactttngcacnancctaatatttattaanactttnctttctnganacacaattnctgaaanngggattnatgtgctgagnctctaaggaccctgatantncntngtatnnntngttgaatgttgnanaatatttcatnactactcaantgatggtnctatgatctgggaggaagcctncttnagcatnttanccanattgnccagggtttcnagganaagtctaaagcctgtnangataccnatgggaccccaccgnggtgnaanggcttnntgtcttncggggactttgagcttaattttcccangnaaaaaanggctt

SEQ ID NO: 5270 - DNA, 753 bp, Homo sapiens
  misc_feature 15, 21, 26, 33, 81, 95, 109, 113, 114, 115, 117, 133, 137,145, 150, 153, 155, 158, 163, 182, 190, 212, 216, 231, 307,316, 328, 335, 336, 341, 350, 370, 372, 377, 384, 398, 413,415, 431, 441, 462, 480, 494, 510, 514, 531, 533, 539: n = A,T,C or G
  misc_feature 540, 547, 553, 560, 563, 564, 573, 581, 601, 616, 624, 640,643, 663, 676, 701, 720, 731, 732, 738, 740, 750: n = A,T,C or G
cctttcttgaaaccnttggcnacttnctctttntgcaggatcccatcgattcgaattcggcacgaggaggatctgccttcngaggaagtggattnagagctgattgaanacannnantgggaagaaatactgnagcnaccatgcncatcncantncantgctnttaaagaagaagatctcgnggtctggnttgatcctttggatggaaccanggantataccgatggtctncttgacaatgtaacaggtcttattggaattgcttatgaaggaaaagccatagcaggagttattaaccagccatatnacaactatnaggcaggaccanatgctgnnttggngaggacaanctggggagttttaggtttangngcctntgggttncatctgaaagaagnccctgctgggaaacncnttatcacaactactcnattccatagnaacaagacggttactgactgngttgctgctatgaacccngatgctgtgctgcnagtatgaggacagganattngattattcagcttattnanggcaannactctgnttatgnatttgcnagnnctggttgtnagaattgngatacttgagctccagaagncatttacatgctgtnggaggcangttaaccgaatccatnggnatgttcttcagtccaccaangatgttaaccatntgaactctggatgagtactgccacnctgaggattatgactactntgcaagcccannacatgngngagccccctnctt

SEQ ID NO: 5271 - DNA, 863 bp, Homo sapiens
  misc_feature 5, 9, 34, 55, 58, 62, 63, 64, 66, 120, 141, 177, 209, 217,226, 240, 242, 252, 275, 277, 285, 287, 299, 334, 344, 352,353, 359, 378, 449, 450, 451, 470, 480, 482, 492, 494, 513,530, 531, 536, 538, 539, 542, 550, 562, 567, 572, 594: n = A,T,C or G
  misc_feature 599, 613, 618, 630, 638, 643, 644, 646, 655, 661, 668, 696,699, 700, 705, 706, 707, 711, 731, 736, 740, 744, 754, 755,757, 758, 759, 760, 770, 780, 781, 787, 792, 806, 808, 818,821, 831, 837, 841, 846, 853, 857, 862: n = A,T,C or G
tttgnaaanccctttctgttgttcaccggaaacncttgggaaattcccatagctncangcannnantgcgatggcgtgcgcctgtagtcccaggtactccggaggctgtggcagattttnggcttattgaacacaggcagnttgtggccattcagcaaggagcataatgcccctgtnggtggtgatagtgaataagcactcagtgcagncaataagnatataattngagttaatgcatgncnaatgattccngtcccttgttgaatgtggatttntntatctcantnccaatacatttnctacaaagccaagtgccattccctggaattggccnatagcaatcnggaatgtnnaccatnggattcactcactggcagntcaagtctgtgaacaccatgaaggttaatcaacatgagggtttaaagccaactttataggcttgctatatnnnccttcctggtcagcaatanagcccattcncnggagcttccngnggggatgactcgtcccagngaatcttcctattaagnnaaccnannggnttaactgnagaaaaggcttnccgtnatctntaagatccttttggaaaccacntttantctaccctggcctncaagntccaatttgganagacccgnccatnnancctttggangaaatncccaatnccaggaaacccaatggccaaaacccctnttnnaaggnnncttnaacaagcccagggaaaaccnaattncccnaaanattggggccnntnnnngggggggggnaaaaaggctnnaaactntcccnaacttaaaacaaangnccccttgggnttntcaaaaaaanggggcntttnggaanggaaaangganccccna

SEQ ID NO: 5272 - DNA, 471 bp, Homo sapiens
  misc_feature 1, 2, 9, 15, 24, 67, 78, 82, 86, 100, 107, 109, 122, 128,131, 136, 146, 153, 157, 161, 162, 163, 167, 172, 177, 184,192, 197, 200, 206, 228, 240, 244, 265, 278, 308, 312, 342,345, 347, 376, 385, 391, 413, 415, 429, 434, 449, 451: n = A,T,C or G
  misc_feature 452, 456, 458, 467, 470: n = A,T,C or G
nntttactncctttnccccctctntttgcaggatcccatcgattcgaattcggcacgaggcagaacngatccagacanaaantgtntgcattttaccttntttcccncnccaattcttcttngtaganganagtancgtcagatgnctcttgncgancctnnnctcngttgnacatngcctatnctcctttnagatntanatgganatttgcttatgacttgtgttgnataacgaggtanaaanattgctgtcttctctgacatncctcctcaaaganatcattaatgtatgatatctaataaaccanctantgcatgtaacagtgatcagcaaattaatanatnanacctctattcatgcttaaattatcaaagntagtatttnaatganatgtgctattttcattaaaatntntggcaccatcgagnatganacttaccaattgcancnnaggnantgagccctnacnc

SEQ ID NO: 5273 - DNA, 976 bp, Homo sapiens
  misc_feature 1, 12, 13, 14, 15, 16, 21, 22, 67, 68, 69, 71, 74, 77, 78,81, 84, 86, 88, 90, 93, 100, 102, 103, 104, 118, 124, 127,129, 131, 136, 141, 142, 144, 149, 152, 175, 188, 194, 195,196, 198, 205, 244, 252, 264, 285, 289, 290, 321, 336: n = A,T,C or G
  misc_feature 342, 344, 347, 374, 385, 388, 392, 396, 405, 420, 421, 436,446, 447, 450, 472, 474, 475, 482, 486, 488, 494, 499, 518,519, 522, 525, 533, 577, 579, 585, 626, 667, 682, 697, 698,715, 725, 727, 735, 747, 764, 785, 834, 870, 965, 967: n = A,T,C or G
  misc_feature 971, 976: n = A,T,C or G
nggggtataaannnnnttttnngaatacagctacttgttctttttgcaggatcccatcgattcgcannngngcncgnnatntgntngncnatngaactgncnnngcacatcaatattngtgggnttncncnatctntcatnnantgtgnaanacagatctgacttggttatgttngagtgaccctgancaatgnnngnagacggntaggggtacacggagcacacattcgtcacaaattctatnggtgcatnttttgcaagggncgtttccagggtgcttattancganngcaaagggtacttggcaattgcaagattttncaatgagccccaagnaattcntngancgaattgcattggcaccccaaggtttnaggaaaagatnggnaaanccanttaccttcnaatttccaaccttgnnattttgaccttggantggttttaannaanaccccagggtagttacccaacntnngggcgantttncnaaagtnccccnatcccttaattccaccaannaanggntttaaaanaatggcctaatttcgggcgagttattcgaagaataatcgcttantngtggtncaaaacttacattactcaatggaaacattcacccaattttngaaagggaatctttaattcggcctggcattaaatccggagntgtcatgggctttcngaattcaaatgaaannggttatatttctggggngcaagatcananttgacganacccaatggaangatctactgataggcangttaccatcactggaatctgntgccagcatttagcctggctcaatatctaatcaaatgtcaaggcttttnccttgggaaaacgggttggcattgggggagcaactnggaacaatgcagattcaatccattaatcccttttctggtgttcaacaaccaacccattgaatccatctggggtaagttttcttgaaacaagtcancngaanttccn

SEQ ID NO: 5274 - DNA, 765 bp, Homo sapiens
  misc_feature 2, 3, 4, 5, 10, 18, 24, 28, 31, 41, 42, 43, 46, 47, 60, 185,187, 199, 219, 245, 324, 455, 458, 476, 501, 576, 640, 662,675, 693, 718, 721, 727, 749: n = A,T,C or G
tnnnnctttnctaattgncccctnattngcnggttccaatnnncanngaacgatcccatngattcgaattcggcacgaggtttttttttttttttttttcagttccagttccactttctttttatttaaataaccgaagcaacagccgtggcacagcagagggaagctgggttggggcgtgtganangtggcagcagtntggcctgatggggggactangtcacagtgaactccccacacgcctntcaggttcagcagtcatggccataggattgggagcactacggaggagccatcagttagtgatgtctctccaagtcccanagaccttagggacgggagctaagtcagctccctcaagtagcagggccagggcatcccagtcaggggtcacggggcccggaaggcattttcagcagccccagcggctgcattggcagctgcggttcgcaccncanggttggagaagacaccancagcaaattcttgctgggccttctnaaagctggcacctgtgcggcggtataaggagtggatcccgtttcagcatgacaattcctagcacagcaatgccantgaagagcagggcgaccagcacatgagcaccgatactgcttgtgttgcccttcggcaccaccanagcagaatatccaccctgaatnccaacctgggatncaatggcctgaggacaangacacattctggacgaagaaatganaanaaaacnagaaatttgatgaactgtactncggaaagcctttacat

SEQ ID NO: 5275 - DNA, 739 bp, Homo sapiens
  misc_feature 9, 19, 32, 518, 712, 732: n = A,T,C or G
gcttcaatnctttctaatncttggctaccggntttctgcaggatccctcgattcgaattcggcacgagagaaaaacaacagagagaaaaagaatacctgagatatgtagaagctttacgagcccaaatccaggagaaaatgcagctgtataatattactttacctccactatgctgttgtggtcctgatttttgggatgctcatcctgatacctgtgccaacaactgtattttctataaaaaccacagagcatatactcgggcactacattcattcatcaattcctgtgatgtccctgggggtaattcaactcttcgagtcgcaattcataattttgcttctgcacacaggcggactttgaaaaatctataataagaatctgaaattaactggtagtattttggcttttacttaaaatcatccctgagagagtatttaaagaaaagctgttcaagttataaaatatataatctggaaagaaatactgtctcatataataattagattgtaatcattgntttaatctctgtctgggaaccaagattgaaagctgacttacttctctcttctgtcttgtgaaccatacggagcctattattttaaaatatgatcagaccagtaaggcttctcttactttgctctggctctggatcaggaagagctcatgtgaaagtctttgagaatctcttatttatcatctttctaaaactgngtttttgagcctggacagtnctgaaaa

SEQ ID NO: 5276 - DNA, 1006 bp, Homo sapiens
  misc_feature 8, 15, 17, 24, 28, 40, 49, 53, 56, 63, 66, 75, 96, 104, 119,131, 134, 156, 158, 164, 176, 195, 197, 210, 211, 216, 234,245, 251, 257, 263, 265, 269, 275, 276, 277, 286, 288, 294,295, 300, 304, 307, 314, 323, 327, 328, 329, 333: n = A,T,C or G
  misc_feature 350, 352, 354, 365, 373, 377, 380, 381, 385, 386, 390, 396,398, 401, 402, 403, 412, 413, 415, 418, 420, 421, 427, 428,429, 435, 436, 438, 440, 446, 455, 458, 467, 479, 486, 492,498, 502, 507, 508, 511, 512, 513, 523, 526, 527, 529: n = A,T,C or G
  misc_feature 540, 542, 554, 560, 561, 570, 573, 591, 603, 607, 609, 615,618, 620, 635, 637, 650, 664, 675, 680, 684, 687, 690, 691,696, 699, 703, 710, 722, 724, 727, 736, 744, 755, 756, 763,764, 769, 773, 775, 780, 791, 795, 796, 798, 800, 803: n = A,T,C or G
  misc_feature 807, 808, 809, 811, 815, 817, 819, 821, 822, 823, 826, 829,831, 832, 843, 851, 854, 857, 858, 859, 860, 861, 863, 866,873, 878, 883, 889, 891, 893, 895, 896, 903, 904, 914, 919,920, 921, 924, 929, 930, 935, 938, 939, 947, 948, 953: n = A,T,C or G
  misc_feature 955, 956, 961, 962, 963, 964, 971, 973, 978, 992, 994, 996,1004, 1005: n = A,T,C or G
tatctttnctaaaangnccgtaantgcntggttttaattnccttggaangctnacntgcgttncgnattgggagncaggcctcatcaggaccctgntgactcgnggcgcgggagctggnagccaggctctncgngcctttctctggcttccttggntngcctgntgggggaagggnaggaggagattaaggaaangnaagatgttccacnntagantgatgaggtctaccggtncaagaccatcncttaanacgagnatcccnancctntgcctnnncgaaatgtnanctcctnncactnggcnccnagttatnagcccctcngaannntgtnacagccggacgtcttantncnttctgctcaangatgctcnaacncanncttnnattnggttgncngannntgcgggatnncngcncnnatatcnnncattgnntncncttaantggttcttntgnccccctttnaatcccttccantttgaantccttntgtggnttanaacgnnttnnngaattaatanccnncntataccattanantattggtacacnccttgnnttaccaaanttncaactgggacttttggtnatattaaaaggntatntntttatnatncnctccctattggggcncnaattcgtatttanagccttaaaactcnctcttctattntatanaccnctnccnntattntantctncccaaantttatataacgncnaancctatcatntatttctngcgcatttccnngattttnnataancatntntcatngggttataaancctnngntnaantgtnnntntctntncnannnttnttntnntaattttcaantgtacccnatnatnnnnncnaanaaccttntgttnacccngtttcnanancnntttttgnntcccatttanctcannnggncttcnnttaancanncctggggnntaatntnngggannnnctatttntntgatntttaaatagtatantngnataacaannt

SEQ ID NO: 5277 - DNA, 474 bp, Homo sapiens
  misc_feature 1, 3, 64, 66, 68, 73, 77, 84, 91, 107, 111, 113, 116, 134,138, 140, 147, 153, 156, 159, 161, 179, 186, 188, 190, 192,196, 197, 205, 206, 209, 210, 214, 226, 227, 228, 234, 269,279, 285, 288, 289, 300, 307, 310, 313, 314, 321, 327: n = A,T,C or G
  misc_feature 328, 331, 332, 334, 338, 340, 341, 343, 357, 359, 382, 385,401, 402, 408, 409, 420, 421, 424, 432, 434, 436, 437, 438,444, 448, 455, 459, 465, 469, 471: n = A,T,C or G
nanccttacaagctacttgttctttgtgcaggatcccatcgattcgaattcggcacgaggaaangncnagcantgangaatgtntttggtntttggagccacattanatcngnaanctctatgactatatccantgtncnctcccancagcanatngangncatgcatgcctcttttcntaactananananaacnntgggctcnngannctgngttacatcccannngctttnatattgcctcatggattcattggaaatacacgtgnatacacaaantcccanatnngtcttgcattntattttngangcnngcttctncaatanncanntntctntnntnaaagattatttgangnaacctaaggtccgtgagtctgtnctntaacttattgatgacnnataagnncagcattttcnntcncactgtcntnannnacctgntggnatcagcntcantgtctnggtngnacg

SEQ ID NO: 5278 - DNA, 764 bp, Homo sapiens
  misc_feature 2, 3, 4, 5, 14, 26, 31, 39, 42, 717: n = A,T,C or G
tnnnnttttgaaantttttgaaatcnctggnttctaatnttnggcacgatcccatcgattcggggatgggcctatgattgttcatgatgagcatggaggagtgtcggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttggttttagtgtcaaatttttagctgnatttgtagcaattatcaggtttgctagaaatataacttttaatcagt

SEQ ID NO: 5279 - DNA, 747 bp, Homo sapiens
  misc_feature 2, 8, 9, 11, 21, 31, 33, 609, 631, 679, 736: n = A,T,C or G
gnttcaanncntttccaaatncttggctctngntctttttgcaggatcccatcgattcgctcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacnggtaaaaagagaaccttagatnataattctgggagttcttcactttcagtctcttcagcagagacatggnttcattcactggtctctggttggtttctttaatcacccccaaaggtcgcgataatanttatttgcccc

SEQ ID NO: 5280 - DNA, 747 bp, Homo sapiens; identical to SEQ ID NO: 5279
  misc_feature 2, 8, 9, 11, 21, 31, 33, 609, 631, 679, 736: n = A,T,C or G

SEQ ID NO: 5281 - DNA, 741 bp, Homo sapiens; identical to SEQ ID NO: 5243
  misc_feature 2, 15, 415, 496, 503, 607, 643, 674, 676, 678, 680, 682,683, 687, 688, 697, 702, 711, 712, 713, 714, 717, 718, 721,723, 724, 729, 732, 733, 735: n = A,T,C or G

SEQ ID NO: 5282 - DNA, 804 bp, Homo sapiens; identical to SEQ ID NO: 5267
  misc_feature 6, 10, 68, 69, 70, 71, 74, 83, 96, 97, 98, 100, 104, 105,111, 114, 117, 119, 121, 129, 130, 150, 154, 156, 172, 175,176, 188, 190, 199, 208, 216, 217, 229, 234, 265, 266, 267,270, 274, 276, 281, 286, 290, 295, 296, 297, 301, 302: n = A,T,C or G
  misc_feature 305, 306, 310, 312, 313, 315, 316, 320, 321, 322, 328, 329,332, 338, 340, 346, 347, 358, 363, 372, 376, 379, 387, 389,392, 397, 400, 402, 406, 407, 411, 421, 439, 441, 443, 444,451, 453, 454, 455, 465, 468, 473, 474, 478, 480, 492: n = A,T,C or G
  misc_feature 498, 502, 509, 516, 519, 521, 525, 526, 537, 540, 541, 544,552, 556, 558, 563, 569, 570, 571, 572, 573, 578, 584, 587,593, 594, 598, 609, 623, 632, 636, 644, 650, 659, 662, 683,687, 692, 694, 696, 702, 706, 709, 715, 716, 717, 718: n = A,T,C or G
  misc_feature 735, 738, 748, 749, 758, 761, 764, 765, 781, 791, 795, 796,798, 800, 802: n = A,T,C or G

SEQ ID NO: 5283 - DNA, 785 bp, Homo sapiens; identical to SEQ ID NO: 776
  misc_feature 2, 3, 4, 5, 6, 7, 8, 24, 31, 32, 40, 42, 45, 47, 56, 115,164, 169, 207, 208, 214, 215, 244, 282, 453, 475, 498, 511,516, 526, 530, 535, 568, 600, 606, 620, 647, 674, 675, 678,686, 702, 703, 745, 759, 764, 772: n = A,T,C or G

SEQ ID NO: 5284 - DNA, 789 bp, Homo sapiens
  misc_feature 1, 36, 38, 39, 88, 102, 114, 208, 219, 242, 274, 296, 341,409, 470, 475, 609, 687, 695, 696, 698, 704, 724, 727, 729,731, 735, 738, 758, 764, 776, 777, 786, 787: n = A,T,C or G
ngatatcggtcgctgaggggccaagtgggaggcctngnnaggtgtggaggtggattccgctccgggcaccgatctcgccaagatcctnagtgacatgcgaanccaatatgaggncatggccgagcagaaccggaaggatgctgaagcctggttcaccagccggactgaagaattgaaccgggaggtcgctggccacacggagcagctncagatgagcangtccgaggttactgacctgcggngcacccttcagggtcttgagattgagctgcantcacagctgagcatgaaagctnccttggaagacacactggcagaaacggaggcgcgctttggagccnagctggcgcatattcaggcgctgatcagcggtatttgaagcccaacttgggcgatgtgcgaagctganagtgaacgggcagaatcaggagtaccagcggctcatggacatcaagtcgcggctggagcangagantgccacctacccgcagcctgcttagggacagggaagatcactacacaatttgtctgctcaaggtctctgaggcagcagctctggggcttttgttgtccttggaggtgttttctggtagagggatgggaaggaanggacccttaccccgggtttttcttgactgcaataaaattattgggcaaggaaaaaaaaaaaaaaaactccagccttanaactatanngngtcggnttcttaaatccagacatganaanananattnttngtttggacaaacccaacttnaatgcnatggaaaaaatnnttttttttnnaa

SEQ ID NO: 5285 - DNA, 1450 bp, Homo sapiens
  misc_feature 3, 4, 5, 6, 7, 9, 11, 12, 17, 20, 22, 52, 71, 82, 89, 109,138, 140, 143, 146, 148, 150, 152, 153, 157, 160, 162, 163,164, 165, 166, 167, 170, 176, 177, 180, 181, 185, 186, 187,190, 191, 193, 194, 195, 197, 198, 199, 200, 201, 202: n = A,T,C or G
  misc_feature 203, 204, 207, 208, 210, 211, 212, 213, 214, 217, 219, 220,229, 230, 231, 232, 233, 234, 235, 236, 238, 239, 241, 242,243, 245, 246, 247, 248, 250, 252, 253, 254, 255, 257, 259,260, 264, 265, 267, 268, 269, 271, 272, 273, 274, 276: n = A,T,C or G
  misc_feature 277, 280, 282, 283, 284, 285, 286, 288, 289, 292, 293, 294,295, 297, 298, 301, 304, 306, 307, 308, 309, 310, 311, 314,315, 317, 320, 321, 322, 323, 324, 326, 327, 328, 329, 330,331, 333, 336, 341, 343, 346, 347, 348, 350, 352, 355: n = A,T,C or G
  misc_feature 356, 358, 359, 360, 362, 363, 364, 366, 367, 368, 369, 371,373, 379, 380, 381, 382, 384, 387, 392, 395, 396, 397, 399,400, 401, 403, 405, 407, 408, 411, 415, 416, 417, 419, 422,424, 427, 428, 430, 431, 433, 434, 436, 438, 439, 440: n = A,T,C or G
  misc_feature 443, 445, 447, 448, 451, 457, 458, 459, 460, 461, 462, 463,465, 467, 468, 471, 472, 475, 476, 478, 479, 480, 481, 483,484, 489, 496, 498, 504, 506, 520, 523, 525, 526, 527, 528,530, 537, 540, 542, 545, 547, 548, 554, 560, 562, 565: n = A,T,C or G
  misc_feature 568, 575, 578, 585, 588, 589, 592, 596, 597, 601, 602, 603,604, 605, 612, 616, 617, 618, 621, 623, 626, 634, 635, 645,648, 651, 659, 666, 671, 675, 678, 683, 686, 688, 689, 691,696, 697, 712, 716, 722, 724, 726, 729, 730, 731, 733: n = A,T,C or G
ggnnnnncncnnttttnccncnccccccctacattcgaaaaaaacccccccnttttgggcccaaaaaaaanccccccccccnttttgcnaaaaaaccccccttttggcnaaaaaaacccccttttggggaaaaaaaancnttnccncnancnnccanacngnnnnnncancccgannaannaggnnncannannnannnnnnnngannannnnnccncnnattattttnnnnnnnncnnannngnnnnanannnncnannaaannannnannnncnnttnannnnnanncannnncnnagnagngnnnnnncannanaannnnngnnnnnnanaancaacnanaannngngnggnnannnannnannnngngnggcacnnnnanacnaacanacnnnannnananannaanacannnanacngnccnnannannanannngananannaanaccaannnnnnnancnnaanncannannnncnngaggnccccccncncaccanancagaaagaagacanganannnnanccagaangancncanannacaaanacaacnanacnaanaacaaanaanacaacanaannaanggcnnaaannnnncaaacanaaannngcnanacnaggacganngcgacaaacnacnccnagacatanacaacanacaanacanacnaacanaananncnaacannaaacagaacaagacncagncagacngnancannncncganacncnaacaacaancngccaannncanaancaaananacncacanaacananacnanagnnnaaaaangaagcaaanacganacnnanannngaagnanncacncacanncnanagcaccgacanagnganangacanganagannnaanccaacaanngaacaaagacncggnagnacaccnnacnnaagaaagcaacnaanancnccacnaacancngnacacacacacannngnganaaacanaccgnnaacaanacangncaaacgnanacnaagcacannncnnacaagcgacnngngaaagacaacgacacancagannacgacgaanngancaangnanagacgaaacacgnaccnnggaaanncaaagnaacangcacncacacnngacnacaaacanannncgacganacgnaaagaacgngnacncgnanannggnacacaaacnaancacaacgaacgacanagacgcanccacgcncacanngcccnangananncgagcacncagncgacgncgnanancacgccacacancnaacantaaannnggannnagacancnggnggagantcgacanngngacacagaacacanacnncannancaccnnncganacaacaacnagcgnacacnacgaacacanacancacaccaacacgnacaacangnacaacnnagaccnacnacccncgaccccaacn

SEQ ID NO: 5286 - DNA, 1450 bp, Homo sapiens; identical to SEQ ID NO: 5285
  misc_feature 3, 4, 5, 6, 7, 9, 11, 12, 17, 20, 22, 52, 71, 82, 89, 109,138, 140, 143, 146, 148, 150, 152, 153, 157, 160, 162, 163,164, 165, 166, 167, 170, 176, 177, 180, 181, 185, 186, 187,190, 191, 193, 194, 195, 197, 198, 199, 200, 201, 202: n = A,T,C or G
  misc_feature 203, 204, 207, 208, 210, 211, 212, 213, 214, 217, 219, 220,229, 230, 231, 232, 233, 234, 235, 236, 238, 239, 241, 242,243, 245, 246, 247, 248, 250, 252, 253, 254, 255, 257, 259,260, 264, 265, 267, 268, 269, 271, 272, 273, 274, 276: n = A,T,C or G
  misc_feature 277, 280, 282, 283, 284, 285, 286, 288, 289, 292, 293, 294,295, 297, 298, 301, 304, 306, 307, 308, 309, 310, 311, 314,315, 317, 320, 321, 322, 323, 324, 326, 327, 328, 329, 330,331, 333, 336, 341, 343, 346, 347, 348, 350, 352, 355: n = A,T,C or G
  misc_feature 356, 358, 359, 360, 362, 363, 364, 366, 367, 368, 369, 371,373, 379, 380, 381, 382, 384, 387, 392, 395, 396, 397, 399,400, 401, 403, 405, 407, 408, 411, 415, 416, 417, 419, 422,424, 427, 428, 430, 431, 433, 434, 436, 438, 439, 440: n = A,T,C or G
  misc_feature 443, 445, 447, 448, 451, 457, 458, 459, 460, 461, 462, 463,465, 467, 468, 471, 472, 475, 476, 478, 479, 480, 481, 483,484, 489, 496, 498, 504, 506, 520, 523, 525, 526, 527, 528,530, 537, 540, 542, 545, 547, 548, 554, 560, 562, 565: n = A,T,C or G
  misc_feature 568, 575, 578, 585, 588, 589, 592, 596, 597, 601, 602, 603,604, 605, 612, 616, 617, 618, 621, 623, 626, 634, 635, 645,648, 651, 659, 666, 671, 675, 678, 683, 686, 688, 689, 691,696, 697, 712, 716, 722, 724, 726, 729, 730, 731, 733: n = A,T,C or G

SEQ ID NO: 5287 - DNA, 775 bp, Homo sapiens; identical to SEQ ID NO: 787
  misc_feature 7, 8, 11, 12, 21, 25, 47, 53, 54, 56, 58, 59, 60, 266, 578,612, 633, 682, 736, 742, 761, 765: n = A,T,C or G

SEQ ID NO: 5288 - DNA, 799 bp, Homo sapiens
  misc_feature 1, 4, 6, 7, 8, 10, 27, 31, 601, 621, 629, 637, 662, 668,676, 703, 708, 734, 735, 744, 746, 780, 783, 786: n = A,T,C or G
ntcnannngngtccttggcccttgctntttntgcaggatcccatcgattcgccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgaaccccggagaggacccacgcgtgacccgggccaaagtacttcatttcgagaatgaagtttcttganggatcaagcacttgccagtnggaaaatngggccgtnacttactggttaccccttcattttnaacctncgcttgtngggaacaacttggggaaacaattccgnccgtngtggtttcaaaacggaactgggcccnnggacaattnantttaagcgggcaatggccacccttttgggtcaangtnccnaagcctggttttt

SEQ ID NO: 5289 - DNA, 890 bp, Homo sapiens
  misc_feature 11, 13, 15, 16, 21, 24, 37, 48, 49, 53, 64, 77, 79, 100,121, 131, 132, 147, 181, 238, 296, 311, 338, 344, 347, 349,350, 354, 358, 359, 363, 368, 378, 383, 389, 401, 409, 411,428, 449, 452, 461, 464, 476, 478, 501, 512, 513, 516: n = A,T,C or G
  misc_feature 523, 527, 528, 536, 538, 541, 543, 548, 555, 563, 567, 577,604, 610, 615, 619, 620, 621, 623, 624, 628, 633, 635, 639,640, 649, 653, 656, 659, 661, 665, 666, 671, 675, 681, 687,702, 715, 718, 727, 730, 733, 743, 744, 747, 752, 755: n = A,T,C or G
  misc_feature 756, 758, 759, 770, 777, 786, 788, 792, 793, 794, 798, 802,803, 804, 805, 809, 812, 818, 819, 823, 824, 827, 828, 831,833, 834, 835, 837, 841, 844, 848, 851, 853, 860, 862, 873,877, 878, 883, 887: n = A,T,C or G
gaaaggggagngnannttttnaanggcgttctaatgntggagcacgannctanaaagcgggttnggcacgaggctgnanctgcccgtgggcaccacgggnacactgtcttccgggacctgngggcccagannggctgggtgacgggncttcctaacagagtacgcggggccccttttcatntacctgctcttctacttccgagtgcccttcatctatggccacaaatatgactctacngtccagtcggcatacagtggtgcacctcgcctgcatctgtcactcattccactacatnaagcacccggaatanagcccgctgccccagtcggaaaaaaanaaaatnaanannatancctnnatgnataancaaaacttgngcctnttaaancttagtgagtcngaattacntnaaatccagaccatgatngagatcccattgatgaagttnggnacaagcccncancttagaaatgcnanggaaaaaaaaattgctttaattntgttgaaaatnngcngaatgcncatnngcctttantntgntnacgcnattattnaagcctgngtanttaacccaangtatatccacccaacaaaatggcatancaattntatanggtnnnanngctntcagngngcgnnaggttgctntganagnggntnttcnnaattncctncggganctgagngagccccaaatagcntttgggggtcccnggntcacctcanacnttncgggatatannccntacgnaannannggggtctaaanttgggcnccaccttgngngcgnnnaaantctnnnngggntcnaataanncttnnttnntcntnnngngttnaanaatntgnanatatacncncgtatacatanacanntctcnctgnccg

SEQ ID NO: 5290 - DNA, 740 bp, Homo sapiens
  misc_feature 1, 2, 3, 4, 7, 8, 9, 10, 11, 12, 13, 14, 18, 19, 20, 21,22, 24, 27, 36, 38, 80, 86, 87, 95, 109, 110, 112, 123,126, 132, 133, 137, 141, 145, 146, 150, 155, 161, 165, 169,177, 180, 182, 189, 191, 195, 198, 200, 201, 215, 220, 222: n = A,T,C or G
  misc_feature 223, 233, 234, 246, 251, 252, 256, 269, 280, 281, 284, 304,305, 339, 371, 389, 392, 403, 406, 408, 411, 413, 418, 420,422, 426, 433, 439, 441, 448, 460, 463, 470, 519, 533, 542,548, 552, 586, 622, 628, 648, 680, 681, 682, 694, 708: n = A,T,C or G
  misc_feature 734: n = A,T,C or G
nnnntgnnnnnnnntttnnnnngngcnttttatagncngctcttgttctttttgcaggatcccatcgattcgcagcaggnttgccnngtggctgntatggcatctatannantttcagggttnccntaaccnngggncccntgcnntgantgacngtgggnatcntgtngtggtaangancncaggacncnttgnatntnntggaaacaaatggnaacananngtatcctctnnggatactggctncccanntggnttaacacaggtancagctgctcannttnacctgagggatccagaggcnnttgtcaaactagctattcatggcatgctgccaanaaaccttcacagaggaccaatgatggaaaggntgcatctttttccagatnctntattccagaanatntnctnangaatntncnagangagcttnctcaancncgaaaantacctaaacgtntanatgagtnacacacgaagaaatggacgccttcccaagattgtggactccacctgacnattatcggctatangagagtaanacttgnacanaataacagtgaagtgattgaaactttcttctgangagtttctctacctacaggatggagttaaacactgntacagntcacacctgttttatgtgcngaatcactgtggggaaaggtactgacgtgtannncttcaatagganattggattgaaatntcactttattgaaccatttttatgtnatctga

SEQ ID NO: 5291 - DNA, 1221 bp, Homo sapiens
  misc_feature 2, 8, 9, 11, 12, 28, 35, 36, 45, 70, 71, 90, 92, 93, 102,103, 105, 106, 108, 109, 110, 119, 120, 122, 124, 125, 130,131, 132, 133, 134, 135, 136, 141, 143, 144, 146, 147, 148,149, 150, 152, 154, 155, 156, 157, 158, 160, 161, 163: n = A,T,C or G
  misc_feature 164, 165, 166, 167, 168, 169, 170, 171, 172, 173, 174, 175,176, 177, 178, 179, 180, 183, 184, 186, 187, 189, 190, 191,192, 193, 194, 195, 196, 197, 198, 199, 200, 201, 203, 204,205, 206, 207, 208, 210, 213, 214, 215, 216, 217, 218: n = A,T,C or G
  misc_feature 219, 226, 227, 228, 229, 231, 232, 233, 234, 236, 238, 239,240, 242, 247, 248, 249, 252, 253, 254, 255, 256, 257, 258,259, 260, 263, 264, 266, 267, 271, 272, 273, 274, 275, 276,277, 278, 280, 285, 287, 289, 290, 291, 295, 296, 299: n = A,T,C or G
  misc_feature 300, 303, 306, 309, 310, 311, 319, 320, 321, 322, 323, 325,326, 327, 329, 331, 332, 334, 336, 339, 342, 343, 344, 346,348, 349, 350, 351, 352, 353, 354, 356, 359, 361, 362, 363,365, 367, 368, 369, 370, 372, 373, 375, 376, 377, 379: n = A,T,C or G
  misc_feature 381, 382, 383, 384, 386, 388, 389, 397, 401, 404, 406, 408,409, 410, 412, 420, 423, 425, 427, 430, 431, 432, 433, 436,438, 439, 440, 442, 444, 450, 453, 455, 456, 460, 462, 463,467, 472, 473, 477, 481, 491, 493, 494, 495, 497, 502: n = A,T,C or G
  misc_feature 505, 506, 507, 510, 511, 515, 519, 525, 532, 536, 537, 539,540, 546, 547, 550, 551, 553, 560, 563, 564, 568, 569, 577,578, 580, 582, 583, 590, 593, 595, 599, 600, 601, 606, 607,608, 609, 613, 624, 626, 627, 631, 634, 638, 641, 643: n = A,T,C or G
anggccanngnnttttttcccaaaaagnggccccnnctttttccnaaaaaccccctttttgccaaaaaanncgccttttggggccaaaananntgccccgcnngnncnnnggttttggnncncnnaaaannnnnnnccccncnnannnnncncnnnnncnncnnnnnnnnnnnnnnnnnncannanncnnnnnnnnnnnnngnnnnnnanacnnnnnnnctttttnnnncnnnnangnnngnggggnnnaannnnnnnnncgnngnngcannnnnnnngnggggnanannncaanngannggnccnccnnnagacaacnnnnncnnnanannananacnaannncncnnnnnnnanaangnnncncnnnnannannncnannnncngnncccccccncgcnccngncnnngnggcgcaanacntnanccnnnnggnannnantncgagantgncnnaatnanngccncacannaagnccanaaccacaatncnnnanaactnctnnnatnngaanacanccagancccaaanaccnngnnaacacnnaannanaacccanctnnaagnnacgccagnngnanncaccaanacncncaannnccagnnnnaccnaacaccacgcnanncctnaanacanacnananncaaancnatngncncacgagtgngtaacnncnnaaccnacnaacacncagncgnncanacncncnannnncatnaccnacacnncnncgnaaanacngacnaacaaatcnaanaagcncnnnnantnnancaagnanatncnancnnnacgacntananantanccacnnnanacacacacncgacgagncaacaacnaccatnncnngcacgnaccnncngtctnnncacaanacactanncanccacccgnaaagaagaaactanccaaanntnnacgancnacctctnnaagnnccgcnagannacnanncacgncccaantnacaccnnacnnccnnacacncnaacgtnccannacataacnngaaccanaccacngcangaannnnacannncaagnnannacancanancnnggaacnnnagcgncgancanccnacgncgcaanncgacanaagntanagaagaacnacnaaacnnannncaaannnaannaaacctacccaganngtnnacacnacacantncnncnnacgagccgcatnnnncnananacgacggacancaaccc

SEQ ID NO: 5292 - DNA, 910 bp, Homo sapiens
  misc_feature 2, 3, 4, 25, 490, 492, 493, 533, 535, 541, 582, 618, 656,693, 698, 703, 729, 763, 802, 807, 824, 828, 838, 845, 875,881, 885, 887, 900: n = A,T,C or G
gnnntttcaaatagctaggctactngttctttttgcaggcatcccatcgattcgtgttaatcgtgtggtgataatcctgtcctccttttaaagcgaattctctactgaaaggtctgctctgcttaaggagctacaaactgctctcaaaagaatgaaatactgagttccaattcagtgaggcacagtgttggactatggcacatttagttggagtcggggggaggtcaggaatatgatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaatatacagaccatcatttagcaatactaatacatgattttccttggggatggcaggtttgagaatcctttagcaacaggacatactttccctaaattancnngggaattatttttttacccggggttaaaagcttttcaggntnccaaancttaaaggtgggggttgtcttaaccaacctaaaaaaacttnttcaccttaaaattcttcaaaaggaagaaaaagttnctttggccaaaaattttggtaaaaagtttccaccaaangggtggcaaaaaccattttttcccctttccttttaanggccnttttnaatccttaaagggaaaaggggccttntttgaaaaaacttgggggcccccaatctgggtanttaccaagggccttccaaaaattttacccgttttttttnaaaangggaaaggaaaatcttnttgnccaacctttnaagggcntttatttggccaggggaaaaatacccttcnattttngggnantggttaaaaaaanttttatttgg

SEQ ID NO: 5293 - DNA, 783 bp, Homo sapiens; identical to SEQ ID NO: 780
  misc_feature 2, 3, 7, 8, 10, 11, 12, 15, 17, 26, 29, 33, 37, 43, 44, 46,53, 60, 141, 217, 680, 736: n = A,T,C or G

SEQ ID NO: 5294 - DNA, 746 bp, Homo sapiens
  misc_feature 2, 4, 5, 7, 8, 9, 12, 15, 17, 25, 32, 102, 113, 124, 126,134, 137, 139, 142, 148, 152, 162, 237, 328, 626, 685, 693,729, 746: n = A,T,C or G
gntnngnnnccnttntnagggggtntaatgcngctctgttcttttgcaggatccctcgattcgaattcggcacgaggaatacctcaaacgtctaccattacngtggggtagantttagcccacntntgcctttncancntangggttnttcntaagaagaantactttgattctgaacttgagcttatgacatacattaatgaaaactgggatagattgcaccctggagagctggcngacacaccaaaatctgaaagatatgagcatgttctggaggcattaaatgattacaagaccatgtttatgtctgggaaagaaatacaagaanaagaagcatttgtttgggttgcgaattcgtgttcctcctgtgccaccaaatgtggctttcaaagcagagaaagaacctgaaggaacatctcatgaatttaaaattaaaggcagaaaggcatccaaacctatatctgattcaagggaagtaaagcaatggcatataaaaaaaaggaaagaaaaaatctgtaggtcgtccacctggcccatatacaagaaaaatgattcaaaaaactgctgagccacttttggataaaggaatcaatttcagagaatcctacttttggatttaccttggnctatagggagaactgagggaactgccattcatccagtacctcagatgtgggattttacnggtgcttncagtgcaaaaagaaactaccttcgctagcattttcnggccattatgattattn

SEQ ID NO: 5295 - DNA, 769 bp, Homo sapiens
  misc_feature 5, 13, 15, 21, 26, 29, 30, 33, 34, 35, 37, 40, 45, 46, 49,52, 54, 70, 71, 82, 86, 97, 98, 130, 135, 140, 147, 156,168, 169, 175, 179, 182, 183, 186, 189, 198, 199, 200, 202,204, 210, 222, 247, 248, 249, 254, 260, 269, 278, 282: n = A,T,C or G
  misc_feature 283, 285, 288, 292, 293, 296, 300, 309, 311, 313, 316, 317,318, 330, 331, 332, 335, 336, 343, 351, 355, 369, 401, 420,422, 425, 429, 430, 436, 438, 440, 442, 470, 474, 483, 490,499, 506, 509, 516, 518, 530, 532, 539, 546, 553, 554: n = A,T,C or G
  misc_feature 561, 573, 577, 582, 587, 594, 617, 631, 637, 640, 654, 655,663, 675, 684, 686, 691, 693, 696, 699, 723, 727, 728, 733,738, 752, 756: n = A,T,C or G
gaccnatcggttngngagacngcctnccnntcnnncngcntctgnnggntgntnttttgacacggtctcnngtgaaagtacncacncactcacacgnnaatgggcattgcaccccactcctgctcaaagngctgnacgcngtcatgngtagaattnctgtacgcctgnnctctgncccntanngcngantgggccacnnntntntatgancgcgacaccaangtgagtctgacctttctgacttgannnacaangtttgngggggctgncattcgtgntttnngngcncttnnaancatnataggagancntnatnnncgactgggaacnnnctnnacacatnctatctgngaantcatggggatcatnggaggaaacccttgtgctcgaaaataacgtgngtcaaacatgcactcatgngnccnggcnnaccacncntngnctgtttcctacctaaggtataccatggnatgnacacttacngtaattntgcaaagtnggcaaanatnttctcanancggagcctaacngnctaaatnaaaggtntttcatnnccagggncttgttaatatnggcnaaatntggcnaacaagnggttgactcactttaaaaggtgnaataagattttccncatttnttnaaaaggaacctggnngaaaaagntaagggccaaancctttaagncnctttncnggnaanggtttggccaaatccggggttggngggnnccaanaatgnttttcaggaggatngggnaaactttttttct

SEQ ID NO: 5296 - DNA, 1366 bp, Homo sapiens; identical to SEQ ID NO: 777
  misc_feature 2, 4, 7, 9, 10, 12, 13, 14, 15, 16, 17, 18, 23, 24, 27, 29,31, 32, 33, 34, 35, 37, 38, 39, 40, 41, 44, 46, 48, 52,54, 56, 58, 59, 60, 62, 63, 65, 68, 69, 70, 74, 75, 77,81, 83, 84, 108, 109, 113, 114, 115, 116, 117, 144, 145,146: n = A,T,C or G
  misc_feature 148, 150, 157, 166, 169, 172, 175, 188, 189, 190, 192, 195,201, 202, 203, 204, 206, 207, 208, 209, 211, 216, 225, 228,236, 240, 257, 270, 272, 292, 298, 300, 303, 305, 308, 330,340, 348, 350, 354, 355, 371, 373, 379, 382, 384, 385: n = A,T,C or G
  misc_feature 388, 417, 429, 433, 450, 451, 454, 460, 461, 462, 468, 478,483, 485, 488, 490, 492, 493, 501, 504, 512, 520, 528, 531,533, 537, 540, 541, 543, 545, 547, 565, 575, 576, 586, 592,603, 612, 614, 620, 628, 631, 633, 637, 639, 640, 654: n = A,T,C or G
  misc_feature 664, 674, 676, 681, 686, 690, 697, 706, 708, 717, 720, 726,733, 742, 744, 747, 758, 760, 762, 767, 771, 777, 781, 794,796, 801, 802, 805, 807, 815, 828, 846, 855, 858, 866, 874,876, 880, 884, 892, 898, 899, 904, 910, 914, 917, 920: n = A,T,C or G
  misc_feature 932, 938, 953, 959, 961, 968, 970, 971, 976, 978, 980, 986,990, 999, 1000, 1003, 1006, 1007, 1022, 1023, 1024, 1031,1032, 1033, 1038, 1042, 1048, 1049, 1051, 1052, 1067, 1068,1076, 1083, 1088, 1090, 1094, 1098, 1122, 1124, 1133: n = A,T,C or G
  misc_feature 1136, 1140, 1146, 1147, 1171, 1183, 1185, 1190, 1192, 1195,1197, 1199, 1210, 1214, 1230, 1240, 1242, 1243, 1247, 1249,1265, 1271, 1272, 1273, 1274, 1277, 1279, 1290, 1291, 1292,1296, 1300, 1305, 1318, 1325, 1339, 1341, 1342, 1351: n = A,T,C or G

SEQ ID NO: 5297 - DNA, 852 bp, Homo sapiens
  misc_feature 13, 14, 29, 32, 51, 54, 57, 65, 88, 128, 139, 146, 151, 164,166, 171, 187, 191, 197, 201, 204, 242, 249, 253, 262, 271,272, 290, 324, 336, 342, 343, 363, 370, 372, 384, 399, 401,429, 432, 444, 450, 456, 459, 461, 468, 478, 491: n = A,T,C or G
  misc_feature 497, 509, 515, 542, 553, 582, 595, 600, 604, 606, 619, 621,629, 631, 655, 671, 683, 689, 691, 695, 706, 715, 728, 740,743, 753, 773, 786, 796, 800, 809, 812, 828, 834, 851: n = A,T,C or G
tgatcctcaggcnnctgggatgacacgtnaancatagaagctggaggaggnggnccngcgcttgntcataatttaaaaaaattaaaanaacgcaacagccgcttttcttaatccatatcccttttaanacacagaggcnggtaatnagtgnaatagaagaatgntnttgtntcttcctacggtgacngttnttattncacnggnttctttagcaggactgttctactcaacctctgtggaanaaaactntccncagggctgnctaacacanncagcctttgcttttacancctgctcttgcctattaccataccactgtatgtnttcttccacctntggacnnggatgggtattaaactcttnaggcatnantgatgcaactanagtcaatatgctgtntntattaatgagagctcttgggcatccatntcntgaaagctcaantggatngaattnagntngcggganagaggctttnctttgctcatatnacgctnatggactggggnaggctnaaattgcaaatgctgcttttaattgcnctcttggatcnacccatgaaaaattggaaggctcttgacnaataactggtggngtcanaaananaacatttttgacncnggtcatgntntggagaatgaacatccctaaatcnaccatgtggaagaccnatttcataaatncattcntntaanaaaaaattggnaaatctttnttttgctttggtnggaacaactttnaangggcttttgngcaaagtcaccatggttaangggatggacttgnaattaaattncccnaaggaattnaanggttggggaaataatncccctnttaaagggaaaaaaaang

SEQ ID NO: 5298 - DNA, 799 bp, Homo sapiens
  misc_feature 8, 9, 10, 11, 13, 39, 40, 42, 44, 52, 53, 58, 60, 63, 65,68, 74, 126, 127, 343, 347, 350, 359, 376, 377, 406, 424,429, 438, 441, 449, 455, 475, 504, 542, 548, 549, 562, 571,588, 612, 614, 617, 618, 623, 625, 628, 637, 638, 645: n = A,T,C or G
  misc_feature 650, 653, 654, 655, 665, 671, 675, 685, 686, 690, 696, 702,703, 714, 727, 730, 731, 733, 736, 741, 744, 751, 753, 754,765, 771, 779, 783, 784, 795, 798, 799: n = A,T,C or G
tggttttnnnngngggggggttttctaattgcagtcaanntngntgtcctanncccgntnccncnggncgcccnaacttggaggtggcccgcttccagaccatggaggagaagaaagcattcattnntaccactgaagaaagaccgaattgcaaaggaagaaggagcttaatgccaggaacagattttgcagttggtggggtctcaataaaagtttgtttcagtggaaaataacttttattgagacaaaaaaaaaaaaaaaaaactcgagcctctagaactatagtgagtcgtattacgtagatccagacatgataagatacattgatgagtttggacaaacnacanctngaatgcagngaaaaaaatgctttatnngtgaaatttgtgatgctattgctttattngtaaccattataagctgnaatanacaagttancancaacaatngcattnattttatgtttcaggttcanggggaggtgtgggaggtttttttaattcncggccgcggtgccaattgcattgggcccggtccccacnttttgnncccctttagtganggtcaattncgcgcttggccttatcntgggtcatagctgtttcctgtgtnanatnnaatgncnttncacttttcnnacaattnaagtngcnnnagaaatccancactgncaanttgggggcanncacngcttgntaaatnnggtatttttcnaggagcttttaantanntnggntcaanggnacaagcnannttagctccatnggcttngacctccnttannaaccaaaatgnttnn

SEQ ID NO: 5299 - DNA, 793 bp, Homo sapiens; identical to SEQ ID NO: 774
  misc_feature 2, 4, 5, 6, 10, 13, 28, 42, 43, 54, 119, 120, 221, 626, 640,706, 744, 762, 787, 792: n = A,T,C or G

SEQ ID NO: 5300 - DNA, 1095 bp, Homo sapiens
  misc_feature 3, 4, 5, 11, 32, 38, 40, 41, 52, 54, 89, 95, 96, 97, 99,107, 108, 109, 110, 112, 113, 114, 117, 118, 119, 120, 121,122, 123, 124, 125, 126, 127, 128, 129, 130, 131, 132, 133,134, 135, 136, 137, 138, 139, 140, 141, 142, 143, 144: n = A,T,C or G
  misc_feature 145, 146, 147, 148, 149, 150, 151, 152, 153, 154, 155, 156,166, 167, 168, 173, 185, 187, 188, 189, 190, 191, 192, 193,194, 195, 196, 197, 200, 201, 202, 203, 204, 205, 206, 207,208, 209, 210, 211, 212, 213, 215, 220, 221, 222, 223: n = A,T,C or G
  misc_feature 224, 225, 226, 227, 228, 229, 230, 231, 232, 240, 242, 243,244, 245, 246, 247, 248, 249, 251, 252, 254, 255, 256, 258,259, 260, 261, 262, 263, 264, 265, 266, 267, 268, 269, 270,271, 272, 273, 274, 275, 276, 277, 279, 280, 282, 283: n = A,T,C or G
  misc_feature 284, 285, 286, 287, 288, 289, 290, 291, 292, 293, 294, 295,296, 297, 298, 299, 300, 301, 302, 303, 304, 305, 306, 308,309, 310, 311, 312, 313, 315, 316, 317, 318, 319, 320, 321,322, 323, 324, 325, 326, 327, 328, 330, 331, 332, 333: n = A,T,C or G
  misc_feature 334, 337, 338, 339, 340, 341, 342, 343, 344, 345, 346, 347,349, 350, 351, 352, 353, 354, 355, 356, 358, 359, 360, 361,362, 364, 365, 366, 367, 368, 380, 382, 383, 386, 387, 388,389, 395, 397, 399, 401, 402, 405, 406, 409, 412, 416: n = A,T,C or G
  misc_feature 418, 420, 421, 424, 426, 427, 429, 430, 431, 432, 433, 434,435, 437, 442, 443, 444, 445, 446, 448, 451, 452, 455, 459,462, 465, 468, 472, 473, 474, 475, 478, 481, 484, 485, 489,490, 491, 492, 496, 498, 499, 500, 502, 503, 505, 509: n = A,T,C or G
cgnnnattttnccgcccctcctgggaaaatcnccttgncnngtgaaaaaacncntgggtgaaaaaccccttttggcaaattttcgttgnaaaaannntncccccgannnngnnnttnnnnnnnnnnnnnnnnnnnnnnnnnnnnnnnnnnnnnnnnttttttttcnnnccccnttttttttttcngnnnnnnnnnnnttnnnnnnnnnnnnnngnggggnnnnnnnnnnnnngggggggnannnnnnnntnngnnngnnnnnnnnnnnnnnnnnnnnanncnnnnnnnnnnnnnnnnnnnnnnnnnannnnnnannnnnnnnnnnnnnannnnnaannnnnnnnnnnannnnnnnnannnnnannnnnggggggcggggngnncgnnnnacgacngnanannagnnacnacngaananannagnannannnnnnnanaaaannnnnanagnnaanacgnagnaanaanaagnnnnaanaangannacgnnnnacanannncnnanaaannnacaaacnanacaanatanananncncnagannaananacncnagaanaaaannaagaannnaagcnngnnncgnaananccctaacncananngaaagnacngananannnccgagannaanagnnaagaaagnaacanagnngnnagangagaaagacnannagaacnanaangananangcannnngcncncnctnanaaanananannatanangatnnaancgnnganagnaannacnagnncgacgcgnnngananngaacgganntcgnnnangggnnnaancacnncncnaacaagnanangcgagagtcaananncanannnanancngaanannannnagnngnaananananacanacnanaanangnnnanagacagangcangannnngcgcnannagnagnagagnnnatnangnntananaagncananacgacannanaacgtnacgccgnncnananangagannnnganaanacgngagagagnagaanagnacanagananagcnacgnnngacagcanaaacganncnanaagcggnaaatanngangcnagnngnnngacagcc

SEQ ID NO: 5301 - DNA, 744 bp, Homo sapiens; identical to SEQ ID NO: 730
  misc_feature 4, 26, 96, 97, 98, 127, 136, 280, 289, 296, 310, 318, 344,356, 366, 379, 392, 401, 405, 406, 441, 444, 446, 448, 455,470, 473, 475, 483, 489, 492, 536, 572, 576, 594, 600, 635,645, 652, 669, 670, 671, 674, 675, 684, 694, 703, 709: n = A,T,C or G
  misc_feature 721, 722, 731: n = A,T,C or G

SEQ ID NO: 5302 - DNA, 809 bp, Homo sapiens
  misc_feature 528, 580, 666, 671, 711, 728, 738, 747, 759, 768, 798, 806,807, 809: n = A,T,C or G
tatcacatatacacatatgtgtcccatatacacatatacacatatgtgtacccatatacacatatacacatatgtgtacccatatacacatatacacatatgtgtacccatatacacatatacacatgtgtacccatatacacatatacacatgtgtacccatatacacatatacacatgtgtacccatatacacatatacacatgtgtacccatatacacatatacgcatatgtgtacccatatacgcatatgtgtacccatatacgcatatgtgtacccatatacgcatatgtgtacccatatacgcatatgtgtacccatatacacatatacgcatatgtgtacccatatacacatatacgcatatgtgtacccatatacatatatatacctgtgtcctatatatacacacacacacatatatatatctatatacctacatatatatacacacatatatatatacctggatcattttttaaaatgctcaacagtacacacatgtaacagcatttcagtcaatggntggactgcatatttgatggtggcccataatattataacggacagaaaaattncaatcacctagtgaagcatagcacaatgcattaattactcttggggttggggggcatggctggtgtaaacaaacctaccatgctgncagtnccataaacatatagcatatatagggtatatattatacttnaataataactatggtgntggggtaagnatttaatgnatttaccatggntttaaaganaactcctcctacttttttccaaaagtactntaaaacanncn

SEQ ID NO: 5303 - DNA, 840 bp, Homo sapiens
  misc_feature 531, 571, 577, 584, 612, 613, 663, 664, 679, 681, 689, 690,697, 702, 704, 707, 718, 726, 730, 740, 746, 750, 777, 796,803, 826, 831, 838, 839: n = A,T,C or G
agggccagtttgatcattccaaagatggttggttaggccccggccctatgccagctgtcacaaagcggcaaatggacactcaagaaccaagatgatatcaacctccatcaagacagctcggaaaagtaaaagggcatcagggctgaggataaatgattatgataaccagtgtgatgttgtttatatcagtcaaccagtattaaaggcctgcctgatatacaaccctcgaatgcaacacagtgtccttctgaggccactctaaaggccaggaaaggtttgctaagaagtctgtgctgttaaaaacagaagaaaaagacccttatcccattgctctgtgtctggtggctatagggatagtatttcataaaaaaagaaaggcaaaaataattttcaaaaatgattcaagaaatgctgtcaaagatagcaaaagaacagagtcctcagagaacagtgcccaggacaggataagcactcaataacatataacactgggtaatgcttgttgagtgctggctggttgttgagtgctanctattggtggagtgcttgttgttgagtgctaactgcttantgctanctggtgnttgagtgcttggttggttgaagtgcctnncttgtttggttgagtgcttgttggttgaaatgcctacctggttggttganntgattgttggttgantngctaaccnnttgtttnatgcntnctngttgttgaatngctttgtngttnaaagctaacntgtttnttgnatgctttgtcctggcctggggcccttntttttacccctttgatgtnccatttnttccatttaactttccccaattnccctntttgggnnc

SEQ ID NO: 5304 - DNA, 980 bp, Homo sapiens
  misc_feature 9, 12, 66, 267, 305, 315, 328, 331, 342, 350, 353, 359, 365,368, 374, 378, 381, 400, 411, 415, 422, 423, 428, 442, 445,452, 455, 464, 466, 490, 510, 512, 534, 539, 600, 630, 632,657, 664, 676, 687, 716, 784, 802, 805, 808, 809: n = A,T,C or G
  misc_feature 810, 814, 816, 818, 825, 826, 830, 834, 836, 837, 851, 853,854, 855, 880, 885, 902, 904, 907, 911, 912, 916, 923, 930,933, 934, 936, 937, 945, 958, 959, 980: n = A,T,C or G
ttcctaatnctnggctctcgttctttttgcaggatccctcgattcgaattcggcacgaggaagccnaattgaattgtgggaacaggaacattcaaaggcatttatggtgaatgggcagaaattcatggagtatgtggcagaacaatgggagatgcatcgattggagaaagagagagccaagcaggaaagacaactgaagaacagccaggctggtcttgaattcctgacctcaggtgatccacctgcttcggccttccaaagtgctangattacaggtgtgagccaccacgcctggctaattttgnatttttagtntaaatgggggttnttncaaagcttggnctttgaanttncccaancttcanggnggaatncccnccncccttttgggcttcccccnaaatggcttgnggantttccannggccntttaagcccaaccnttngcccccnggncctggaatngnttttttttgaaatggaattttttntaaaaaaatgggggtttttncnaggccatttttaaaaaaacccntttanaacttggatttttttaaaattattattttaaaatttcctttttttaaaaacctccaaattnttaaatgggttaaaatattttaccttggtnanccacctttaacttaagcctttttcntggaaanggtttgggtccntttggagaatnaagaatttggaaaaaatggaccaggtttngtttggatttttcttgaagggtaaattttacccccaaaatttaaaattattatggtattgtggtaccntttgaaaaaaaaaacatnttntannncttntntnctctaanncctncttntnntataaaaaaacctncnnngggcccttttaaaaaccttttttgnggggnggtccctttttttaccngntanaatnncccnaaccttngatttanggnnannccttttgnttgaaatttttgnncaaaaccccccaatcttttgn

SEQ ID NO: 5305 - DNA, 761 bp, Homo sapiens
  misc_feature 5, 6, 7, 8, 9, 10, 11, 14, 17, 31, 44, 46, 48, 52, 58, 63,64, 72, 127, 687, 728, 735: n = A,T,C or G
tgggnnnnnnnagngtnggcttttcttattntggctgtaaccgntngnagcncgcacncaaannggctgggncgaattcggcacgagggttggaacagcagcactatacatgaaatataaaccaaanacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatctttatgatgctgagccatgttctgcactggtgctaatgtctaatataattntatatttacacacataccgtgctacccagagattaatttantccatangaaccattgacccattgttcattgac

SEQ ID NO: 5306 - DNA, 753 bp, Homo sapiens; identical to SEQ ID NO: 710
  misc_feature 2, 3, 4, 5, 6, 7, 8, 9, 10, 11, 14, 22, 31, 45, 57, 683,685, 690, 695, 702, 715, 719, 721: n = A,T,C or G

SEQ ID NO: 5307 - DNA, 913 bp, Homo sapiens
  misc_feature 8, 16, 505, 516, 535, 536, 537, 545, 547, 551, 557, 566,567, 570, 572, 575, 576, 580, 583, 588, 593, 607, 610, 613,620, 621, 625, 633, 634, 638, 641, 644, 673, 680, 686, 691,699, 703, 706, 707, 708, 714, 719, 722, 756, 768, 769: n = A,T,C or G
  misc_feature 771, 795, 799, 800, 815, 827, 834, 835, 844, 850, 855, 859,868, 870, 871, 876, 877, 881, 889, 892, 898, 911: n = A,T,C or G
gcgtcccntttcaacnttgctaatcgctggctatcgttctttctgcaggacccatcgattcgaattcggcacgaggccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgnataacaaggancatgttattgatgccctgnnncagggccnanaccnagtttnctggccttnntancntanngatnttngaganaagtntcattttaactttnctntgnctatatnncaanggttttanntttngtngantgaaaaagcgggcttcatcccaagatggnctgtggnggtcanagttncattcccnagtngtnnncccttntgganaanttggctggccccttgcactcattgacggccttcncaattggtgctnnanccccctttttaatttctttaatcnaatnnactttattacctttncctggctctaancttaatnntctcatctncatctntaatntctnacactaccnannttttnntcantattcccntcnaacctnatcaaactttttncg

SEQ ID NO: 5308 - DNA, 1274 bp, Homo sapiens
  misc_feature 6, 20, 21, 22, 23, 24, 25, 26, 27, 28, 29, 30, 36, 37, 40,41, 42, 50, 52, 58, 67, 70, 71, 78, 79, 80, 81, 107, 108,109, 110, 112, 119, 129, 142, 164, 165, 166, 167, 168, 170,171, 172, 173, 174, 175, 176, 177, 178, 179, 180, 181: n = A,T,C or G
  misc_feature 182, 183, 184, 185, 186, 187, 188, 189, 190, 191, 192, 193,194, 195, 196, 197, 198, 199, 200, 201, 202, 205, 206, 207,208, 209, 210, 211, 212, 215, 216, 217, 220, 221, 222, 224,225, 228, 229, 230, 231, 232, 233, 234, 235, 236, 237: n = A,T,C or G
  misc_feature 238, 239, 240, 241, 242, 243, 244, 245, 246, 247, 248, 249,250, 251, 252, 253, 254, 255, 256, 257, 258, 261, 262, 263,264, 265, 266, 267, 268, 269, 270, 271, 272, 273, 274, 275,276, 277, 278, 279, 280, 281, 282, 283, 284, 285, 286: n = A,T,C or G
  misc_feature 288, 290, 293, 294, 295, 296, 297, 298, 299, 301, 302, 303,304, 305, 306, 308, 309, 310, 311, 312, 313, 314, 315, 316,317, 318, 319, 320, 322, 323, 324, 325, 326, 327, 328, 329,331, 332, 333, 334, 335, 336, 337, 338, 339, 340, 341: n = A,T,C or G
  misc_feature 342, 343, 344, 345, 346, 347, 348, 350, 352, 353, 354, 355,356, 357, 358, 359, 360, 362, 363, 365, 366, 367, 368, 369,370, 371, 372, 373, 374, 375, 376, 377, 378, 379, 380, 381,382, 383, 384, 385, 386, 387, 388, 389, 390, 391, 392: n = A,T,C or G
  misc_feature 393, 395, 396, 397, 398, 399, 400, 401, 402, 403, 404, 406,407, 408, 409, 410, 412, 413, 414, 415, 416, 417, 418, 419,420, 421, 422, 423, 424, 425, 426, 427, 428, 429, 430, 433,439, 440, 441, 442, 443, 445, 446, 448, 449, 450, 451: n = A,T,C or G
tttttngggggggttttttnnnnnnnnnnngggggnnttnnnggggggcngntttttnccttaaaanagnngactggnnnngctgaaaaactcgggccttgggggannnngnccccccncgaaaaacancagggaaaaaaanggggggggctgggggggggggnnnnnannnnnnnnnnnnnnnnnnnnnnnnnnnnnnnnnggnnnnnnnnggnnnggnnnannggnnnnnnnnnnnnnnnnnnnnnnnnnnnnnnnggnnnnnnnnnnnnnnnnnnnnnnnnnnangnggnnnnnnngnnnnnngnnnnnnnnnnnnngnnnnnnnngnnnnnnnnnnnnnnnnnnancnnnnnnnnngnngnnnnnnnnnnnnnnnnnnnnnnnnnnnnngnnnnnnnnnnannnnncnnnnnnnnnnnnnnnnnnncanaagggnnnnnanncnnnnnnnngnnnnnnnnnnngncnnnnnnannnngnnnnnannnnnggnaagaangnnncnnacgagnnnnnngannnacgannnnngnnaancnnnnncnagngccgnatnagancacgaatnggngagaggancngannangnnggnnnnnggnnaangnnncgnnaangaannggnaccagnnnggannncnnnannggangncnnnagnnnnngnngggnnncnnnaacncnnggggnnnannanngnanannnggnnctnngggnnnnnnnnnnannnnnnnnnaannnnnnnnnnnnnnnnnnnnnncnnnggnnnngggnnanannnnnnnnnnnnnnnnnnnannnnnnnnannnnnnannanngnncannnnnngnnnnnncnnnnnnnnnnaggnnnnnnnnnnannnnnannngnnnnnnnannnnnnnnnnnnannnggnngnnananannnnnnnnnnnnnnnnnnnanangggggnnnnnnnnnnnnnnnnnnnnnnnnnnnnnnnannnnnnncnncnnnngnnnnnnnannnnnnnnntncnnnnnanccnnnngnnngnnacaannncnnctngnnggnctnngnangnnncncaanannnntnnngnnnnnnnnntngnngncaaanangggnanannnantnnnnnatgggngggggacnnaantnnccnccctnattcaannantggnggaaaaaactggnggnnnaanantnaaaccccagannggcnnaaantcattccttaccaaaagggttangacctggnaancctngtgggcnanaaaggtnctnaaacattcntttnanc

SEQ ID NO: 5309 - DNA, 1039 bp, Homo sapiens
  misc_feature 5, 6, 7, 8, 9, 10, 11, 12, 13, 14, 15, 16, 34, 35, 36, 51,55, 69, 84, 88, 95, 100, 102, 109, 110, 112, 116, 117, 118,121, 127, 135, 141, 161, 167, 174, 187, 189, 191, 194, 201,205, 207, 220, 235, 236, 244, 255, 257, 284, 288, 293: n = A,T,C or G
  misc_feature 305, 308, 309, 316, 327, 336, 339, 346, 365, 376, 382, 389,408, 409, 432, 458, 461, 467, 477, 478, 519, 520, 538, 575,583, 610, 650, 651, 656, 657, 661, 685, 689, 707, 710, 722,729, 740, 743, 759, 771, 774, 798, 808, 829, 842, 851: n = A,T,C or G
  misc_feature 853, 862, 866, 870, 876, 896, 902, 904, 907, 911, 931, 933,934, 935, 936, 952, 954, 960, 962, 965, 967, 971, 977, 978,979, 989, 992, 1006, 1014, 1015, 1023, 1024, 1030, 1036,1038: n = A,T,C or G
atggnnnnnnnnnnnnttttttttggaaaaaaannnccccccctttttttncctnaaaaaattgggccnttttggggcaaaaantttnggccctncttcntnctttggnntnttgnnnatncccccnattcgggnattttnccggaaaatttccggggccnaccggnagggggnattaggccctttnananagncccaaanggtntnttacccaaagggntataatttttaaagnnatgggggnaccagggtgtntngccccaatttaggaaagggaaattttntctnaaatnaagttgggggtntanntggccangtggttacctnggggcattnggnaaatatnttcttgggaacttgaggtntaaactggaangggagnagccctnaaacctatagtaacttcanntccccacaagtatactagaattngtgcatcctcgatttatattgcaagngtntcaaangtgtcactgnnacacaaatagaaacactgccaacttggtgtaacttaagctnncatttaactaaaacattnttttcttgcaaaacttatttattcatgatcaattttntggttatntattatactttgattcctaaattagtncatccttgaatctatgaaactggtgcagtcattatgcccnnaaatnntctnaaaatatattaatgggtcaccttnctgntcaaaggggtggtgcaanggncttgcagcattnttacatnttgtgctttgntangaaaatgtaaactctnaggctccacaanttnactttgctgcattttttaacaaanaatccccaangggatatgtaatgctcataanaaatttgggacanctgggttcnantggaaaaangggntctnaagggnatggcataaacttggtggtnccggtnanggntttnaaggccttttccaactttanannnntttctgattttggaantnttccantnggntntaanaacctnnnttatatatcnaanattaggggcctttnaaaaaaanncttatttnngctagnaaaccntnc

SEQ ID NO: 5310 - DNA, 931 bp, Homo sapiens
  misc_feature 22, 30, 31, 39, 42, 59, 61, 62, 63, 65, 73, 76, 87, 99, 100,108, 112, 119, 122, 126, 127, 132, 139, 142, 144, 146, 147,154, 157, 166, 171, 173, 177, 179, 184, 186, 188, 191, 194,198, 199, 202, 203, 204, 206, 212, 213, 214, 223: n = A,T,C or G
  misc_feature 224, 225, 227, 230, 231, 238, 241, 242, 243, 244, 246, 247,248, 249, 253, 261, 262, 276, 287, 288, 292, 294, 295, 297,301, 309, 311, 312, 315, 318, 323, 326, 329, 331, 332, 334,335, 339, 346, 347, 348, 349, 350, 351, 357, 364, 365: n = A,T,C or G
  misc_feature 366, 371, 385, 387, 388, 399, 402, 404, 406, 410, 414, 415,416, 418, 420, 425, 433, 434, 437, 439, 441, 444, 445, 446,447, 449, 450, 451, 452, 453, 454, 458, 460, 474, 476, 479,485, 486, 489, 496, 500, 509, 512, 515, 516, 520, 522: n = A,T,C or G
  misc_feature 524, 525, 526, 530, 532, 537, 539, 540, 541, 542, 546, 549,554, 556, 557, 559, 560, 561, 562, 564, 568, 574, 576, 586,592, 599, 605, 612, 614, 623, 624, 629, 633, 636, 642, 644,648, 650, 651, 660, 669, 670, 671, 675, 679, 685, 687: n = A,T,C or G
  misc_feature 688, 691, 698, 699, 702, 703, 708, 713, 724, 725, 729, 732,733, 734, 736, 737, 738, 739, 740, 742, 743, 744, 751, 753,754, 761, 763, 766, 768, 771, 774, 775, 779, 783, 793, 801,802, 809, 810, 811, 818, 822, 824, 826, 834, 835, 840: n = A,T,C or G
  misc_feature 848, 851, 855, 859, 865, 867, 868, 869, 870, 871, 873, 874,878, 884, 886, 889, 890, 893, 898, 900, 902, 908, 910, 917,923, 924, 925, 927, 930: n = A,T,C or G
ggaagcgggggggtacgttttncaaaaggnntttcaatngcnggtgaacgcccctaaanannnanccatcganacnaattcggcacnaagggcttccgnntaaaccantcangggtatnccnatgnntaagncatcctnggncngnntataacnggncccattcanctgtnanatanancttcnananttntcnacannggnnnanattttnnntctgcaatnnnanagnnaaccttnttnnnncnnnntaangaggcagnnagctacctttgaangaactacttgnnaacntnntnttgnaattcaangnnaanccntcttnttntcnanntnnttantgttgcnnnnnnctcaantcgtatnnncatgngggctcccatcacntnnttacttataantantngnttanaaannntngncctantatagggnnatncntnttnnnnannnnnntccntncaaatcccaatctngnaangaattnnccntttctgnaatncaattattnaangannaatngntnnnctantncattnannnnctantantttcncnncnnnncnttgnaattcncnttatacccantaaatngctactnttaatnaggattnanagtacccannttgcntttnttncacaantntaancnntgcattatntaaaatcannnaagncganaaattntnntcnaaccccnngcnncaaantaccnatttctaatanngacntannngnnnnnannnccctaanannatatacnanatntnttnccnnacantccnagagtagaantccccttnntcacacnnntctctantacncntnaattttcnntacanatataaantantttntctnattaangnnnnntnnaaanttctancnaanntanattancnancctctnanataatcntttttnnngnatnc

SEQ ID NO: 5311 - DNA, 804 bp, Homo sapiens
  misc_feature 2, 6, 23, 35, 45, 50, 54, 61, 84, 91, 93, 98, 101, 117, 138,147, 155, 166, 188, 195, 197, 199, 200, 204, 214, 218, 263,306, 308, 320, 330, 333, 334, 340, 353, 355, 359, 360, 369,370, 373, 378, 380, 388, 389, 403, 418, 429, 441: n = A,T,C or G
  misc_feature 462, 479, 484, 490, 498, 512, 513, 516, 519, 527, 531, 533,534, 537, 548, 552, 565, 566, 567, 571, 576, 584, 598, 604,612, 615, 616, 622, 631, 645, 650, 655, 660, 668, 671, 675,701, 702, 706, 708, 709, 711, 718, 720, 724, 732, 733: n = A,T,C or G
  misc_feature 735, 739, 749, 752, 754, 756, 762, 764, 771, 772, 773, 778,782, 786, 788, 795, 797: n = A,T,C or G
cnaatncttggctactcgctctnttgcaggatccnttttgacgcntttgnacgnccgtatncttcaaccaatgtctagtgcacntatcctntntaacncanaattctcaaacccagntttacaacattgggtaggatnctataaagngctaatcntattctggatnatgacgaattttgcatgctaantctttgnancnngtcncccccgaagntgcnttacatgtacagattcgtgtaaccacgtgtaaccacataaaactnatgaacacaaagtccctcatgctaccttctatgcttacactcnanccaaacctaacnctgccaaccnctnntctccnatcaggatcattncntcanntcatgaatnnganagaantnaaattgtnnttgcacatggtatntataaattttatatngataagccatntgaatgcttatngatagagagtctgtgagctcntggcatttctggcactnagcanattacncctaaggnttatatgagtagannaanagntgtattancatnannttntaccaccatgnatcngacccgatgaaannnggtnatatntgagagtngtgtacaggatttnatgtgnaaattcgnatnnattcancgatgaganatattgcactgttntcccnggtcntaacngccctggnatnaaanatgccttgggaaaaatgttatcaaannaacntnnancagcccnangggnaaaaaccnnangaanttcagaggcntcntngnaccaantntggaggnnnaaaanaccngggncncctgganantaattcc

SEQ ID NO: 5312 - DNA, 1116 bp, Homo sapiens
  misc_feature 3, 7, 10, 13, 15, 18, 20, 25, 27, 37, 45, 49, 63, 109, 110,144, 202, 206, 226, 285, 298, 349, 356, 373, 413, 434, 446,449, 481, 501, 516, 535, 546, 549, 560, 564, 613, 620, 641,645, 647, 655, 680, 688, 713, 720, 739, 784, 807, 811: n = A,T,C or G
  misc_feature 820, 830, 860, 865, 870, 874, 880, 882, 898, 902, 906, 930,940, 950, 955, 983, 988, 1017, 1021, 1027, 1032, 1041, 1057,1061, 1070, 1085, 1092: n = A,T,C or G
tantacntanctnanccntntggcntnagtccgtccnctatcgcntgtngcttaaattactgncgcgttaaacgtcggactggaaacctgcgtaccaactaatcgcctnnagcaaaatccccttttggcagctggcggtaaaancaaaaaggcccgaaccgatcggcctttccaaacagttggcgcaaccctgaatgggcgnaatnggaaccccccctggtaagcnggcgccaattaaaccccggccggggtggtgggtgggttaaccccgccaaccggtggaanccggtttacaacnttgggccaagcggcccccttaaaccggcccccggctttccctttttcggcntttttcnttttcccccttttcccntttttctttcggccccaaccggttttcggcccccggggcntttttttcccccccgggtccnaaaggcccttcnttnaaaaaattccggggggggggccctttcccccnttttttaaagggggggtttncccccgaaatttttnaaaattgggcctttttttnaaccggggggnaanccccttttggnaaanccccccccaaaaaaaaaaaaaactttttgggaaatttaaagggggggtnggaaatngggggttttccaaacgggttnaaantngggggggnccccaatttcgggcccccccttggnaataaagnaaaccgggggtttttttttttcggnccccccntttttgggaaccggttttnggggaaggttccccaaccgggttttccttttttaaaaataaaggngggggaacttccttttgggtttncccnaaaaacctnggggaaaacnaaaacaaccttttaaaaacccccttaattntttcnggggncctnaatttncnttttttgggaattttnaatnaaangggggaatttttttggccccgaanttttccgggncccttaattnggggnttaaaaaaaaaaatggaaagcctggaanttttnaaaccaaaaaaaaatttttaaaccgccgnaaantttttnaaccnaaaaaatanttttaaacggcctttnaacnaaaattttncccttggaagggccnggggggnaaaaaaaaaatttttttttttttt

SEQ ID NO: 5313 - DNA, 766 bp, Homo sapiens
  misc_feature 4, 6, 15, 357, 422, 476, 478, 494, 504, 599, 614, 618, 636,651, 658, 666, 700: n = A,T,C or G
aatncnagctctcgntctttttgcggatcccatcgattcgctagttcgagttttttttttttttttttttcatgaaaatatagtcatcaaatttattttcattgggatgccattttttgaagaattcctaagactaatgtttcttgacatgcaagagttagcattaatagcttacgttactataaatactgctgcttggaagcagtacaactgttttagagttttaagactacagactttcattactcaaatcttattcagtaaatgtaaaaatcagaaggttctgaacagctggttaggaaggtagccaagatgcaggaaagatgtctgcgcctccttttcaagggcagccaactnttgaacagtaggtgcccaaaatatccacatggcctttatagctttcaccaccagcagcccttttntgaccgtaggtaactttcccatcaaattcatccactggtacctttatatccggntnaacctgagaaatggtncagttcaggngttcttctatctcagatagtaactgcatctcgttgtaccatatggtcaagcctcatcttccttgagtcttggggtataacacccttttccacggntgctacatacatggnaccnaaccataaggaacaccgnggatatcaattcctntagcagntcatctgngcaaatcaagaatctttacatctccttcttaaancttttccaagtttgcctttctctcatgggccattggaaatttctcaaaataatgaccaggttttct

SEQ ID NO: 5314 - DNA, 926 bp, Homo sapiens
  misc_feature 2, 3, 4, 5, 6, 7, 8, 9, 10, 12, 13, 14, 15, 16, 17, 19, 20,23, 25, 26, 27, 28, 29, 31, 32, 33, 34, 35, 36, 37, 38,39, 43, 44, 46, 47, 48, 49, 50, 51, 52, 53, 54, 55, 56,57, 59, 60, 62, 63, 64, 66, 72, 73, 74, 78, 79, 80, 81,82: n = A,T,C or G
  misc_feature 83, 84, 86, 87, 88, 89, 90, 91, 92, 93, 94, 97, 119, 121,122, 123, 138, 139, 143, 146, 150, 161, 164, 168, 175, 176,177, 184, 189, 193, 214, 217, 224, 226, 234, 251, 260, 264,267, 270, 273, 275, 281, 296, 298, 299, 307, 328, 331: n = A,T,C or G
  misc_feature 333, 348, 365, 376, 378, 381, 383, 387, 391, 401, 404, 412,413, 417, 424, 426, 428, 429, 439, 461, 478, 480, 488, 492,495, 496, 503, 505, 512, 513, 528, 531, 534, 535, 537, 542,549, 555, 558, 561, 581, 583, 592, 594, 597, 606, 615: n = A,T,C or G
  misc_feature 617, 654, 658, 662, 665, 666, 669, 673, 698, 708, 713, 724,729, 731, 736, 749, 763, 773, 786, 793, 798, 799, 801, 802,806, 810, 823, 836, 837, 841, 848, 855, 865, 868, 870, 872,876, 881, 882, 884, 890, 891, 895, 896, 926: n = A,T,C or G
annnnnnnnnannnnnngnnggngnnnnnannnnnnnnngaannannnnnnnnnnnnannannnangggggnnnaacnnnnnnnannnnnnnnnagnttgaattcctaaagccaaaccncnnntttggcaggaagcanncagnccngggntccgcaacgcnggnaagnggacagnnnggaaaanaaatntttngcagacaaggatgtcaagggnggnggcgggngnataacacncggcaagtgggacagcnttgaacaanaacnagnagncgncnggaacngcctaaccggagccnanngctcgaanaaggaaataaggaagccacanggnangcagacctcactganacatgaacccagcgcanaggtggcggancngcncnaaangacnagagaggcanagngaaaaaanncatnaatgccngncnngagaatgaanaacagcgctacaacaggcatgnggatatgggaaacaacnantggggacnaganacnnagggaangnacgggannaaaaaaggggggganttnaanncnccganggagggngcgagnacncantggaaagaaagggaagacantncacggaaancnganctgacaaangatgaatangnggccacagggaggaagggaactggcctgagagggaanaaancggnacnnaangaanggaacccagggccaagggcaccaanaagaaaaaanccccngaaaaaaaganggggnantatgngcctggggggggnaaaagcccaccaanttaaaggcanaaaaggggggggnaaaaacnctggnntnncaancaanaagggggggcccncccgggggggggnncccncgaaaanaaaaacngggggggggnttnangngggnggganncncacccnncccnngaaaaaggggggcaaaaaaaaaaccccccn

SEQ ID NO: 5315 - DNA, 924 bp, Homo sapiens
  misc_feature 14, 15, 25, 27, 34, 45, 46, 47, 50, 55, 56, 59, 61, 62, 64,67, 75, 79, 80, 83, 88, 130, 152, 186, 187, 191, 195, 215,221, 223, 237, 249, 254, 258, 268, 279, 316, 332, 349, 406,411, 413, 424, 429, 442, 444, 448, 451, 454, 465, 473: n = A,T,C or G
  misc_feature 476, 477, 485, 488, 504, 513, 520, 527, 541, 558, 559, 561,564, 569, 575, 580, 588, 592, 594, 604, 608, 610, 618, 622,623, 630, 631, 651, 654, 665, 667, 668, 685, 687, 695, 696,697, 702, 712, 713, 714, 722, 723, 735, 739, 741, 755: n = A,T,C or G
  misc_feature 760, 777, 778, 784, 790, 793, 795, 803, 805, 809, 812, 819,820, 822, 833, 844, 849, 863, 869, 876, 877, 896, 901, 905,913, 914, 915, 922: n = A,T,C or G
acaccttgggtgcnngcaccgcatnanaacccantcccaccacannncangagcnngtngnncnctnttggaggnggcnnagngatgncccgaatccgtgggctactagggagccctcacttgggctacngggtggaggcccatgatattgnggcctcaaagatgttatgattcacctccatcaanncccngaantgaataattcttcctatcanttaatnanggtgattacccagnagaatgccattncggtntgcnttggtatttnacaaaaagaanctgggggaaccacttgggtgtgacattttatgggttnaaaataatgatctggnaaattgccccggatccnccatgggggaatgatagatcgacaaggtctacttcatggtgggagatatgattaaangaagncnatggccattgnggttnggaaataatccanangganttncanccaattactgnaaaaaaanttnnttggaagnggncacccctaaaaatctntcccagttnttagagnatacccnttacttccttaaanaagggatttgttgaaanngncanttttncaaatntaatnccaaacanaggncnacccttaatnaccntngccaaagnagcnngttttgnngatttttcccaaaagggagnaanattcctttccngnntttggcgaaactgtagnanaattcccnnntttgnggtgggcggnnnttagcccnnttctaaaaaaanggangngaacccccttgtgntttcntattccagagcccgctnntcctcngtaaanaananaaataaangnccanttnttttatnnanagaaattgggncccaatcttanggacnctttttgtgggaancttatnattcccnnacatacacaaaaaaaacancctcnccgncccctttnnnaactttncg

SEQ ID NO: 5316 - DNA, 902 bp, Homo sapiens
  misc_feature 49, 222, 305, 415, 448, 527, 555, 574, 583, 592, 606, 622,656, 671, 687, 696, 699, 708, 713, 721, 725, 735, 740, 746,750, 753, 773, 802, 817, 827, 829, 835, 838, 860, 871, 872,873, 881, 898: n = A,T,C or G
ttcagaagaacgcacagatgaaatgacacataaagaaacaaatgagcangaagaaagattgctcgcccagcttcttcactaaatcatcccgcagcagcagggactcggtctagcaaggccatcttgttgccggacctttctgaaccaaacaatgagcctttattttctccagcgtcagaagttccaaggaaagcaaaagcttaaaaaatagaggttcctgcncagctgaaagaattagtttcggatttatcttctcagtttgtcatctcacctcctgctttaaggagcagacaaaaaaacacatncaataagaacaagcttgaagatgaactgaaagatgatgcacaatcagtagaaactctgggaaagccaaaagcgaaacgaatcaggacgtcaaaaacaaaacaagcaagcnaaaacacagaaaaagaaagtgcttggtcacctnctcccatagaaattcggctgatttcccccttggctagcccagcttgacggagtcaaagagcaaacccagaaaaactacngaagtgacagggaacaggtctttggganggaccagaaagaaactgtntttcttttnccaaagcanaattttacgccaanaaaaaatgcttgttantttttttggggaagatttttaatgtacccccttntttggtaaaggtcantcaaaaaataggtggnggggattanttnaaaataatnttaanttttgggnaagnaaaaaataanttttntttttnaaanttntttggttaaaaatttttttntggttaaaacaagaaaggggcttttcaanttaaggttaaaggtnaaccttcccntnttgggnggnggaattgggtttcaaattcccncgggccaaaannnttccctantttttaatattttaaanactt

SEQ ID NO: 5317 - DNA, 816 bp, Homo sapiens
  misc_feature 2, 3, 4, 5, 6, 11, 15, 29, 350, 378, 425, 431, 433, 439,449, 461, 472, 485, 511, 522, 569, 615, 734, 751, 773, 798,808: n = A,T,C or G
gnnnnntttcnaatncctttcctaatacnagctctcgttctttttgcaggatcccatcgattcgaattcggcacgaggacttctgaagaacatgaagcaagcagaagggtgaaagcggagctgctggttcagatggatggtgttggaggtacttctgaaaatgatgacccttccaaaatgggtatggttctggcagctctaattttccctgggatatagatgaggctttaagacgacgccttgagaaacgaatctatattcctttgccgtcagcaaaaggcagggaggagctattaccaataagtctacgtgagttggaattggctgatgatgttgaccttgcaagtttntcagaaaacatggaagggtattcaaggnccggcatttccaacgtgtgcagggatgccttccttgatggcaatganaaagcncnttgaangttttgactnccaggaaatccnaaatcttttcnaagaagaaatgcncatgcctacaactatggaggatttcnagatggctttnaaaaagggttctaagtcagtgtctgcttgcagacatttgaaaagatnccagaaatggatatttgagtttggatcatgctaaattctccatgtnaactgtgagaaatgtgcccttaagtggtttgaatattaaatgcccgtaattcattggactggagtgcttatatttttttttaactttcattaatggtaagaattttttttaaaaaaaancccttatgaattcttgnaataaaaggccaatattttttnaagcctggaaaaaaaaaaagccctnttagaaactntttgtgga

SEQ ID NO: 5318 - DNA, 878 bp, Homo sapiens
  misc_feature 9, 21, 89, 94, 99, 118, 148, 168, 195, 209, 210, 212, 249,250, 256, 264, 268, 289, 292, 293, 294, 298, 338, 339, 340,345, 352, 365, 381, 389, 396, 401, 403, 431, 432, 441, 444,448, 453, 464, 473, 479, 485, 486, 493, 495, 496, 515: n = A,T,C or G
  misc_feature 520, 522, 531, 532, 533, 536, 537, 541, 543, 544, 545, 551,552, 555, 559, 564, 565, 570, 572, 581, 587, 590, 593, 594,596, 599, 603, 606, 609, 610, 613, 614, 626, 629, 631, 635,638, 646, 651, 655, 656, 663, 689, 690, 691, 712, 717: n = A,T,C or G
  misc_feature 726, 741, 743, 748, 749, 750, 753, 760, 761, 763, 767, 773,776, 778, 786, 791, 792, 794, 798, 801, 805, 819, 838, 839,842, 846, 848, 854, 855, 872, 876: n = A,T,C or G
ttcctaatncttggttctcgnatctctgcaggatcccttcgattcgaattcggcacgaggggggaaaatgacagaggaaaaagagaaantggancaganaaaaatagtggaagaaatnatagctaaaaaattcagaattcagtgacangtagaaatttacagatatcngatcatatgctcaagaaacaccaatgngaataaatatttannantcccacgctggttcttgcaaactttttgaaaaccaannttgaanagcaaatnttgnaagcacatgataaaagccatnccnnnaatnatccagttaattggcttgacttcttactggaaaccctttnnnaccanaaacggncttggaataaacnttttcaagggttcttntaaagaanaattcgnaaaantnttaacccccaattttttttttttttaanntgaaagacnccncttntgttncccaggttggnagtttcccnttccgntgcccnngccttangnnaacttttttggaggggganactcntntgacttttnnnccnngggntnnncctttnnttncctngcccnntttcntntttttgacntttttntgngcnntncanggcnttnaannccnntgacccccttcnaantncatnggngggaaacnggggntaannggcatangctcttttatttaagaaagcaccccnnnaatccccctaaacttttcttnaattnacccttttngggacccctctaggncngcttnnntgntttaccnngntccnccaaanttncnaacttggnaaacnntnttgnaantccngggggaatataggnacctttggaatttttaaanncancctnanttggcnngccctttgggcctttanaaanct

SEQ ID NO: 5319 - DNA, 714 bp, Homo sapiens
  misc_feature 2, 4, 5, 7, 15, 595, 657, 699, 713: n = A,T,C or G
gngnntntatagcangctcttgttctttttgcaggatccctcgattcgaattcggcacgaggtcaaggctcagtcgccagcatttcccaacacaaagattctgaccttaaatgcaaccatttgaaacccctgtaggcctcaggtgaaactccagatgccacaatggagctctgctcccctaaagcctcaaaacaaaggcctaattctatgcctgtcttaattttctttcacttaagttagttccactgagaccccaggctgttaggggttattggtgtaaggtctttcatattttaaacagaggatatcggcatttgtttctttctctgaggacaagagaaaaaagccaggttccacagaggacacagagaaggtttgggtgtcctcctggggttctttttgccaactttccccacgttaaaggtgaacattggttctttcatttgctttggaagttttaatctctaacagtggacaaagttaccagtgccttaaactctgttacactttttggaagtgaaaactttgtagtatgataggttattttgatgtaaagatgttctggataccattatatgttccccctgtttcaaangctcagattgtaatatgtaaatggtatgtcattcgctactatgatttaatttgaaatatggncttttggttatgaaaacttttgcagcacacttgaaaagctgnctgtggatcattgng

SEQ ID NO: 5320 - DNA, 786 bp, Homo sapiens
  misc_feature 7, 23, 36, 40, 46, 52, 56, 57, 76, 94, 100, 101, 105, 114,121, 166, 216, 220, 225, 229, 257, 258, 270, 289, 293, 344,347, 355, 359, 360, 361, 363, 381, 385, 403, 405, 428, 454,472, 506, 512, 532, 541, 542, 558, 559, 562, 567, 573: n = A,T,C or G
  misc_feature 581, 582, 587, 589, 602, 613, 614, 617, 625, 628, 632, 636,639, 641, 650, 655, 657, 658, 660, 663, 665, 667, 671, 682,689, 691, 706, 710, 711, 713, 720, 721, 722, 723, 724, 728,729, 732, 739, 740, 754, 760, 764, 772, 776, 784: n = A,T,C or G
ggttcancgaatgcctgtggaanccgcccttctctncagnagcccntcgatncgtnntgaactatcaactagatcngggaagatagaacaggcntttttnncatngcctcgttnacaaagngtcatcacgaaaagtgttcctctaggaaggcataatatgtggccngatggatgtgatgagtagattgtaaaagggttgggattctggcagaacangaanagatnactnaattattggaatcaactgagaaaagagnncattagcatgcnggctaatagaccctaatanaacngggtgtgaaaagatgggatctggacctagaggcagtcttagagccataatnctngatttctncttnnngngaaagcgacaggtacttntggnctgaggccataaatcagntntatcctaaatggaaaactatatnccactggggatggtaatcaccctttngataagaaagggtagaanccacaatcttcaacagaaatggaacttatcaatntaattnaagaatcctcaacagtacanttttaaggnnatggaaccccctgtgnnaancccangttccnactgccanngcctnancaatcctattatnactgattagcnnganaaaagaangcngcancccnttncnaatttttcntttancnncnggnantncccntgaaaggtaanccccttntnaaagggggaaattcnaccnnanggaggcnnnnnggcnnggngaaattnnccttgaaccccccnaggcanaaangttgcttnttanccccagancc

SEQ ID NO: 5321 - DNA, 723 bp, Homo sapiens
  misc_feature 4, 12, 13, 14, 616, 642, 672, 687: n = A,T,C or G
gcgntctaatgnnngctcttgttctttttgcaggatcccatcgattcgaattcggcacgaggaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctgctcactcagacccggaagacctgccccatttgcaagcagcctgttcatcggggtcctggggacgaagaccaagaggaagaaactcaagggcaagaggagggtgatgaaggggagccaagggaccacccttgctcaaaaaggaccccacttttgggttctagccccactctttccaccttctttgggtcctttagccccagctnccctttggtttttcctggggcctttnaacagatcccccactgtccccttccttttnccctgtaatcctggnctaataaccccccacaacttacacctttgggggacc

SEQ ID NO: 5322 - DNA, 764 bp, Homo sapiens
  misc_feature 1, 368, 676, 691, 727, 740, 761, 763: n = A,T,C or G
naatagcagctcttgttctttttgcggatccctcgattcgaattcggcacgaggctgtccactccagttgcccttggctaagtttagcctaacacacagggttttgacccatagttctaaaatacacaaattttgagactacagcacttctttggaaagaggaagaatgcaaagttcagtatttcaatactttgtattttacttgaaattacccttagtagcatcttttttttcctgtctgaaagcttttgtgtggatgagaagggacatttcatttcctcccttaacaaagtgtcattctgaggttctcatgtgtgtttttggaaatagagatactggttttgtagagtttgcctttgggtatgttntctttttttcttaaatctccaaggaagagaactgactaaaatagtaggaacatgaaagtattaaatgccaattaatttgttgtagtaaagtatcttcattagcgttatactccatcatatctggtgtaaactgctcacagaaaaccctatgaaaccaaagggggaccattcaggtctaaaaagcgacaggtcccgagactgggtctgtcacctgggcattttcaaagaggacattttggaagaatttgcatattcagatttttaaaatgcacttaacatacttcattacagaattcttgggtagggangatgggataggccanggatgggatggaatcagtctgcctgggaacttaatnccgaatcatttanccttctggattaacccttggncng

SEQ ID NO: 5323 - DNA, 836 bp, Homo sapiens
  misc_feature 532, 554, 567, 601, 639, 641, 677, 710, 711, 715, 753, 756,770, 771, 779, 787, 794, 802, 810, 827, 834: n = A,T,C or G
gaggaaatcagtacgctgaggggccaagtgggaggccaggtcaagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccactgggcgatgtgcgagctgatagtgagcggcagaatcaggagtaccagcggctcatggacatcaagtcgcggctggagcaggagattgccacctaccgcacctgctcgagggacaggaagatcactacaacaatttgtctgcctncaaggtcctcttgaggcagcangctctggggcttnttgctgtccttttggagggtgtcttcttgggtanaagggatggggaaaggaaagggacccttaccccccggntntttttcttgaccttgccaattaaaaaatttttggtnccaagggaaaaaaaaaaaaaaaaaaaactccanncctnttaaaactattagtgaggtcgtattaccttggaatccnganattgataagaatcnnttgatganttttgggncaaaccnccactttnaatgcccnggaaaaaaaatgctttntttgggnaa

SEQ ID NO: 5324 - DNA, 1174 bp, Homo sapiens
  misc_feature 7, 14, 22, 34, 41, 51, 57, 61, 66, 81, 82, 85, 86, 87, 88,93, 95, 99, 103, 117, 160, 166, 181, 188, 192, 208, 237,250, 255, 278, 299, 305, 316, 323, 348, 349, 352, 355, 371,388, 400, 402, 423, 427, 444, 453, 502, 504, 507, 515: n = A,T,C or G
  misc_feature 534, 651, 730, 810, 891, 897, 921, 925, 941, 966, 969, 980,986, 992, 1017, 1020, 1026, 1032, 1035, 1041, 1084, 1102,1116, 1131, 1132, 1133, 1147, 1148, 1174: n = A,T,C or G
ttttttnccctttnaaaaaaantttggggccccnttttttntttttccttnaaaaantttnggggnccccttttttttttnnttnnnntgggncntatngggnaaattccccccccnaattcctgttaattttttccgggcccgggaaaaaaggtttccnttttcngggggtttccccccncgggccnaacntttccgggtttttccntttcgggaaatttcctttccggggggttnccgggaaaccccnttttncccaaaaaggttttcccccaagnaaattccccgggcaaaccggnaaaaanggggttccccnaaaaggntttccccaaaagggttccccctttnnggnttncggggggttccttttnccaaagaaatcctttcnggtttttccggncngggggttcccaaaggggttcncccnggggttcttttggggtnccaaagggnaagttcccttttcccccaaagtggttcccaaaaagaaagggggaaatcncnaantccaaagnggtcgccgatcgaagagtncccccaagtctcctgaagaggaaggagcggtgtcctcttaagaaaatgatgtatcggcaagcagtgtaaacggaggacttggggaaaaaggaccacatagtccatcgaagaagagtncttggaacaagcaactggctattgaaaaggttattttgtaacatttgtctaactttttacttgtttaagcttttgcctnagttggcaaacttcattttatgtgccattttgttgctggtattcaaatttcttgtaatttagtgagggtgaacgactttnagatttcattattggatttggatatttgagggtaaaaatttcattttggtatatagtgctgactttttttgtttgaaattnaaacangaattgggtaacctaaattttgtngggncttcctggactttttnaagggaaaaacgttgttggccaggnccntttctacaacnaggccntaaaangcttgttcaaagaagattttggacntcnggggantttggnccntttaantttccttttaaaaatttaaaaaaaccctttccaaaaaagtttnggtgggtaaaaatttggngatattggggttantttttacccttttcnnnaatcttttaaaatnnggggtaatttttgggaacccccaacn

SEQ ID NO: 5325 - DNA, 860 bp, Homo sapiens
  misc_feature 1, 4, 9, 11, 12, 18, 33, 37, 45, 47, 49, 51, 52, 62, 63,70, 71, 72, 75, 81, 90, 92, 94, 97, 100, 116, 117, 120,129, 134, 137, 138, 155, 156, 158, 161, 168, 169, 170, 184,185, 186, 192, 195, 196, 200, 204, 217, 222, 236, 246, 259: n = A,T,C or G
  misc_feature 260, 264, 267, 269, 273, 280, 283, 284, 285, 295, 300, 302,304, 306, 318, 319, 332, 333, 342, 343, 351, 352, 358, 394,407, 411, 412, 415, 417, 418, 427, 433, 441, 445, 455, 456,460, 465, 474, 493, 498, 505, 510, 512, 527, 534, 535: n = A,T,C or G
  misc_feature 549, 552, 556, 564, 567, 569, 574, 579, 587, 598, 601, 608,617, 627, 633, 635, 642, 643, 646, 660, 672, 674, 680, 689,694, 703, 706, 712, 713, 716, 738, 753, 768, 769, 772, 782,784, 785, 789, 790, 791, 796, 799, 813, 815, 821, 823: n = A,T,C or G
  misc_feature 824, 828, 837, 842, 844, 848, 856, 857, 859: n = A,T,C or G
nctnacacngnncagatngcaccaccttatggnactncacacatntngngnntaattgcctnnaatttgnnnaangggatngcctagtgntncntgnctncagaagggaaagtggnntanatagaaaangacanccnnggctatatacacttaanngngtnatagaannnggctactgaagtcnnngacttntannattnaaancctaaatcacttnttgtnggacggttttcatntacctgccanatatacagcccannaccnatngntggngtgaggnatnnntgtgccgggnttctntntnanttctaacacccnnagttgccataaanntactccggnntattttgnntgctcncaaacttgattttttttttcttaaccaccgcttganttagtggtcctcnattnnggntnnagaaggatncccacntgaaaggngatnaactggtcgnnccanaacanttgtgtggntctctgtcacttttcaagnccatntagtttnctaananccgcggggtattccnctttccnngcctattttttttnccntganaacattcngtnantttanaatcngggggaangaccccctttnaanaaactgngcccctaantgttggtttncacttncncggacgnnttnttttccaaaaaagnttgctttccccncnttccanaaaggaacnaattnttcttaaanaancttctnntcncctcggggaagaaggcccaagngcctttgggaaaccncaagggggacccccnnccntggacaactnannaacnnnttccnggngcccaaacctcttnanttggcntnncccnggtccttanaacananaaangggcgganntnt

SEQ ID NO: 5326 - DNA, 1407 bp, Homo sapiens
  misc_feature 1, 20, 28, 34, 41, 44, 54, 65, 66, 69, 72, 73, 77, 78, 83,86, 89, 91, 92, 94, 95, 96, 100, 101, 102, 107, 110, 111,112, 114, 117, 121, 122, 123, 124, 127, 128, 129, 144, 148,150, 152, 154, 171, 175, 176, 188, 189, 190, 191, 192: n = A,T,C or G
  misc_feature 193, 195, 197, 198, 203, 204, 207, 211, 214, 220, 223, 224,232, 233, 234, 247, 256, 260, 265, 266, 267, 271, 275, 277,282, 283, 290, 291, 294, 299, 301, 303, 305, 307, 309, 310,313, 315, 317, 319, 321, 322, 324, 332, 336, 337, 339: n = A,T,C or G
  misc_feature 341, 344, 345, 346, 351, 355, 358, 361, 364, 367, 371, 373,375, 379, 381, 382, 389, 393, 394, 398, 399, 400, 401, 402,405, 410, 417, 418, 423, 430, 432, 434, 440, 444, 451, 452,454, 460, 461, 462, 463, 464, 473, 486, 494, 498, 503: n = A,T,C or G
  misc_feature 516, 518, 519, 522, 523, 526, 528, 533, 534, 542, 544, 545,548, 554, 556, 560, 561, 565, 573, 576, 577, 578, 580, 588,593, 595, 599, 603, 605, 606, 609, 616, 619, 621, 623, 628,630, 631, 635, 636, 638, 640, 641, 643, 649, 651, 655: n = A,T,C or G
  misc_feature 662, 664, 666, 674, 680, 681, 682, 683, 690, 691, 693, 703,709, 725, 730, 735, 739, 740, 741, 743, 749, 753, 755, 756,757, 763, 768, 769, 771, 772, 775, 779, 783, 793, 798, 799,813, 817, 822, 823, 825, 833, 835, 844, 845, 850, 851: n = A,T,C or G
  misc_feature 855, 857, 860, 862, 866, 873, 878, 881, 893, 902, 909, 914,917, 919, 925, 927, 932, 934, 940, 944, 945, 949, 955, 959,968, 974, 977, 979, 983, 992, 994, 1003, 1005, 1013, 1015,1017, 1019, 1024, 1034, 1038, 1039, 1040, 1043, 1044: n = A,T,C or G
ntttccaaaatagcttgggnaaactccnagagcnatttagnganactttgaaancctttggaaannccnaannattnnaaaanaanacngnnannntttnnncaganaannnancanaaannnnacnnngggttttttctaaanaacncncnangatacaaatgagaaganaatnnaaaaaaaaagannnnnntnannaattnnatnaaanacngagtgnaanngaaacgcnnnaaaaaaaaaacanatattaaanaaantttannnaaanaagngnaaaannacacatnntcnaaaancnananantnnaancnanananntntatatcanctanntnantannnaaacntatnatnaanttntanatancnanatgnannaaacagnaacnnatannnnnaanaatgnatatgtnntaacnatataantntnttaganaganatgatanntntaaatnnnnnactatatanataagaatatatnacagagcncctncacanatgatacactgancnnatnntanantcaanngtggactntnngantataananggannacanactagacnatnnntngaaaaganaaatngngganacanannagnttacganatnananacagncnnatanncnanntntgtcananatanatagtancnancaaagaanatggannnnacgacanntnccgtacatcnagacgntcttactatacatacnagagngagancacnnncnacactntgcntnnnaacatntgtannanntanatanatanaatacacacnagccnncatatattacacgnagantgagnncnctacgtanantatatatanncatcnngaananatntnacangtatacncgtanacntacagagtcatnacacgtaantctagtnatctnttnangaacantnttaanangatatnattnnaaangatatnagantctacgtangcgcgnaantnaatntacacatcnanatatagacnanacgtgatntnananatganatactatganaacnnntcnnaacactnacatatntatanaaatacataagagtanacatncacaancacatacagagananaannacacanaananatacataatnaananantcatgantanacttaatcacgnaaaanttannaagcnattnaacganngaacangntacntatacggntanaatacncataaantancanctananaannaaagnnnnnntnncacanannactnaancatgacgatanataacangnatctcaatantnagacntatgaacaaaantagacgaanagtaatatatatcnntagatnantanannaacgagaccactgaacntntnnanatatntaanacatnaactacaatancacacc

SEQ ID NO: 5327 - DNA, 755 bp, Homo sapiens
  misc_feature 13, 16, 25, 33, 34, 35, 49, 60, 72, 85, 89, 91, 92, 93, 100,103, 106, 109, 110, 122, 132, 141, 148, 168, 169, 175, 176,182, 222, 238, 248, 250, 260, 263, 285, 286, 287, 301, 312,315, 344, 346, 357, 359, 361, 362, 372, 376, 380: n = A,T,C or G
  misc_feature 382, 391, 397, 425, 437, 441, 458, 465, 467, 468, 473, 476,479, 489, 530, 544, 546, 562, 563, 565, 567, 568, 574, 607,610, 613, 624, 639, 644, 645, 654, 657, 671, 684, 691, 702,703, 710, 715, 722, 723, 726, 727, 734, 737, 738, 742: n = A,T,C or G
gcgacgcgccganggnaaaaccccnaggcggannncaaggacgcggagncggcacgaggngagagagatcangccgcacgggccncttnannnccccccncgncgnaanncagcaggcgggnccagtgtgcnctgcatccncacccgngaggccgacgacactatcanncccacnnataggnggaggagacagaggcacagagcgcccaaagccccacagcnggcgagcggcagggcnagcgagcgangnccactagacnggngacagacgcagaagccgcgcannncacccccgggaacnggaagacaacnccngacgagcgagacccaggagaacgcacagncnagccagaaaangncnngcaaccgcanacangcancngacagaaangcgacngcccacggaaaaagcgagcaacggaacnaagagaccaacnagcngccgggggcaagggaancgggcancnnggcgncanacnaagaccgaancgggaagccggacccaaccccaaaacggccaaaggggacanaccacaaacagggnancccaaaaacaccaaanncnanncacaanccgaaggaaaaggccgaaaccaaggcccgaggncanggngagcaccaacngaagccaaaccgggncaganncaaacccgnaancacccaggaggcancaggccggccccnggggganccaggcaaggnncccgggnaaaanccccagnnccnngcccccnggnnccangggggaaaccccg

SEQ ID NO: 5328 - DNA, 1273 bp, Homo sapiens
  misc_feature 2, 5, 6, 7, 8, 9, 10, 11, 12, 13, 14, 15, 16, 17, 18, 19,20, 21, 22, 28, 29, 30, 31, 32, 33, 34, 35, 36, 37, 38,46, 50, 60, 70, 71, 103, 115, 120, 121, 122, 123, 125, 126,127, 129, 144, 145, 161, 167, 168, 169, 170, 171, 172, 173: n = A,T,C or G
  misc_feature 176, 177, 178, 179, 180, 181, 182, 183, 184, 185, 186, 187,188, 189, 190, 191, 192, 193, 195, 197, 198, 199, 204, 205,206, 207, 209, 211, 212, 213, 214, 217, 218, 219, 220, 221,222, 224, 228, 229, 230, 231, 232, 233, 237, 241, 243: n = A,T,C or G
  misc_feature 245, 246, 247, 250, 251, 252, 253, 254, 255, 257, 258, 259,261, 263, 265, 266, 267, 268, 269, 270, 272, 273, 274, 276,278, 279, 280, 282, 283, 284, 285, 286, 287, 289, 290, 291,292, 293, 294, 295, 299, 301, 302, 303, 304, 307, 308: n = A,T,C or G
  misc_feature 309, 311, 312, 314, 318, 323, 325, 326, 327, 328, 329, 331,333, 335, 336, 337, 338, 339, 340, 343, 344, 348, 349, 350,351, 352, 353, 354, 355, 357, 358, 364, 365, 366, 367, 368,370, 374, 375, 376, 377, 378, 380, 381, 382, 384, 386: n = A,T,C or G
  misc_feature 387, 388, 389, 390, 391, 392, 393, 395, 396, 398, 399, 400,401, 408, 409, 412, 413, 414, 415, 416, 417, 418, 426, 430,431, 432, 433, 435, 438, 439, 444, 445, 447, 448, 450, 462,464, 467, 472, 474, 475, 483, 484, 488, 505, 514, 518: n = A,T,C or G
  misc_feature 519, 523, 525, 526, 527, 534, 537, 540, 546, 551, 557, 558,559, 561, 563, 566, 567, 569, 570, 573, 574, 582, 590, 591,593, 602, 607, 612, 619, 620, 622, 624, 630, 635, 636, 640,641, 643, 645, 647, 653, 657, 658, 659, 660, 661, 666: n = A,T,C or G
anggnnnnnnnnnnnnnnnnnnagtttnnnnnnnnnnntttttttncccnaaaaaaattngggccctttnnttttccaaaaaaatggggccctttttgggggncaaatttttttncagannnncnnnangttttttggaaaaanncccccttttttggggnaaaacnnnnnnnggnnnnnnnnnnnnnnnnnnangnnnggggnnnnanannnnggnnnnnnangggnnnnnnattntttngnannnggnnnnnntnnnangngnnnnnntnnnanannntnnnnnngnnnnnnngggngnnnnttnnntnnangggnggggnannnnngnanannnnnnggnngggnnnnnnnngnnggggannnnnanatannnnnannngngnnnnnnnnanntnnnngaatggnnaannnnnnntaaggggnaacnnnngngcnnaaaannannangaggggaggaangnacngaaancnnagaggtanngaanaaaatcgcacgggaacntgggaaacnaaannatcnannncttaacnaanatntaaagnaacanaaagcnnngnancanngnntgnnctgttagnagatctcnngnaacaatttntaaanggatnaaatctnnangnaagagnagctnngaanngnanangaaaangaannnnnaaacngangannacanataaacnaagngnaaggtnnctggantanaagaggatnaagaacgtngaaancannaancanananaactngatgcccanctgagnttnnaacnnattatnncaangaaaantgncntacatcanattgggaanatctaagcntcanaaaanaattnnagnanagnatncctnngtatanaaactnngatnctnngnacgaagctataanaataannggaannnnncataanngnannaannaaataatntatnntggtnngngncntatanntaagnaanggcatacaagatnatataaganaagntactatnaanatncntngggaagngantcnacacactantntntncccnntggangnnatnagatnanncnanttnngnntancncnnctgtcatnntnaaagaaangttnanacaganatcctcganatananaaagncaaagacanaggnannacaaacttngcnnannncaaangtcacttcgtantnnacatngnaatancanatnatnnnnanacnncgnaangcacaaaangtanananacatnnataaaaanntngnatgntcgacngnagaangctccncn

SEQ ID NO: 5329 - DNA, 1240 bp, Homo sapiens
  misc_feature 5, 6, 7, 8, 9, 10, 11, 12, 13, 14, 15, 16, 17, 18, 19, 20,21, 22, 23, 30, 32, 33, 34, 35, 36, 37, 38, 39, 40, 41,42, 51, 55, 63, 68, 77, 78, 79, 80, 95, 102, 113, 118, 122,132, 140, 143, 144, 149, 150, 153, 158, 159, 162, 172, 177: n = A,T,C or G
  misc_feature 189, 194, 195, 207, 209, 220, 225, 255, 267, 291, 296, 298,316, 326, 340, 342, 343, 344, 345, 346, 347, 348, 349, 351,361, 364, 367, 368, 369, 370, 372, 374, 375, 376, 377, 378,379, 380, 384, 385, 386, 387, 388, 389, 391, 392, 393: n = A,T,C or G
  misc_feature 394, 396, 397, 401, 402, 403, 404, 405, 406, 407, 411, 412,413, 415, 416, 417, 418, 425, 427, 430, 431, 432, 433, 434,435, 437, 440, 445, 446, 447, 448, 458, 461, 462, 466, 475,481, 488, 498, 500, 501, 504, 505, 507, 509, 513, 519: n = A,T,C or G
  misc_feature 534, 537, 545, 549, 554, 555, 556, 557, 558, 559, 563, 568,569, 581, 589, 594, 595, 597, 598, 600, 607, 613, 616, 619,621, 628, 631, 635, 646, 654, 655, 659, 663, 664, 670, 683,684, 694, 696, 697, 698, 699, 701, 702, 706, 712, 713: n = A,T,C or G
  misc_feature 716, 718, 723, 726, 729, 736, 742, 743, 744, 745, 746, 750,755, 756, 757, 758, 759, 761, 763, 765, 769, 772, 775, 777,781, 787, 788, 792, 793, 794, 797, 806, 808, 810, 815, 820,825, 830, 833, 837, 840, 846, 848, 849, 851, 855, 857: n = A,T,C or G
  misc_feature 861, 867, 869, 875, 879, 886, 889, 890, 891, 892, 894, 901,903, 904, 906, 908, 910, 913, 917, 919, 920, 923, 925, 927,934, 940, 942, 944, 947, 953, 957, 960, 964, 968, 969, 970,977, 980, 988, 989, 993, 994, 995, 996, 999, 1000: n = A,T,C or G
agggnnnnnnnnnnnnnnnnnnngagggtngnnnnnnnnnnnttttttttncccnaaaaaaantgggnccccctttnnnntgccaaaaaaaaatngcccccnttttgggggcnaaaanatcngggcccaaancccccaangcnntttannaanccggnnggnttttcccctngggtngggccccagggnaaaannggaaaaaaggtntnaaaaaaaaatnacctntgggcctttaaaagggaaaaaagggggggnaggggggggggnggttggggggggaaagggggggtngggtnangggggaagggaagggggnaaaggggggnaggggggaaaaacngnnnnnnnngncgggggaaanaangcnnnncnannnnnnnaaannnnnncnnnncnncccnnnnnnnccannnannnnagagccncnggnnnnnnanaancacannnnaggccgcccngcnnacgnaaggggccngggcangaaaaangaaaacagcnanncanncncntgantgcatnccgcactgaaagganggncaaacacnggangaggnnnnnntccnaaganncaagggcaaatnaaggaccntgggnncnntnggacacntaaagnaantgnancggatgnctnccanatgacagagangactgggnngcangggnnatgatnaaaagtaacccanngaagaaacgngnnnnannaccngataanncgntngcaanctnganaacggcngaaccnnnnncacnagcannnnncncnangcanaanaancnatangaaaanngggnnntanagggggggntncncacanaaaanggacntatgnganagcnggncaccananncnaaancnaaangggggnantgaacnatangggggcnggnnnnanaggggcnanngngnancanatanannccntngngggggcnagtaanananccnggagcncggncanccanaaannnccgccanaanccaggcanncaannnnccnngngannnccagccnatnncanganggantnaaanaggnancgngcaaagagccnacganagcaanngnnacnatnnantcanngaaacggcnnaaacnnnagagncgaatcancgacacgggcaaacantnaatagacaancacaanncangtnngngagaagtaacnccggctncatncaaaacnnccncgcntacccaaanngnacntccannnnnnnaanaaanacngtgcncgacc

SEQ ID NO: 5330 - DNA, 1444 bp, Homo sapiens
  misc_feature 1, 2, 4, 7, 9, 11, 15, 17, 19, 21, 23, 25, 26, 28, 29, 30,31, 34, 37, 38, 39, 41, 42, 45, 47, 48, 49, 50, 52, 53,54, 56, 57, 58, 59, 60, 62, 63, 64, 65, 68, 70, 71, 74,75, 78, 79, 80, 82, 85, 87, 88, 90, 95, 97, 103, 105, 106,109: n = A,T,C or G
  misc_feature 110, 112, 115, 119, 122, 124, 125, 126, 127, 129, 130, 131,135, 137, 138, 140, 141, 142, 146, 147, 151, 154, 155, 157,158, 159, 161, 162, 165, 166, 170, 171, 173, 174, 175, 176,178, 179, 183, 184, 190, 196, 197, 200, 202, 203, 215: n = A,T,C or G
  misc_feature 216, 220, 222, 224, 227, 228, 230, 235, 238, 242, 244, 246,247, 248, 250, 252, 257, 258, 259, 260, 262, 264, 266, 268,270, 294, 301, 305, 306, 308, 323, 332, 337, 338, 353, 355,356, 361, 362, 363, 369, 371, 373, 374, 375, 379, 380: n = A,T,C or G
  misc_feature 390, 391, 392, 394, 396, 397, 398, 400, 402, 406, 408, 411,414, 420, 422, 423, 425, 426, 427, 428, 429, 430, 431, 434,435, 436, 443, 448, 450, 453, 456, 457, 460, 462, 463, 464,467, 470, 471, 474, 475, 477, 482, 485, 486, 487, 488: n = A,T,C or G
  misc_feature 490, 491, 492, 496, 497, 498, 500, 513, 519, 523, 527, 532,533, 538, 540, 542, 547, 548, 551, 554, 555, 558, 559, 560,561, 566, 568, 569, 575, 580, 582, 585, 587, 589, 592, 593,601, 605, 609, 612, 614, 619, 624, 626, 627, 632, 635: n = A,T,C or G
  misc_feature 641, 642, 645, 646, 650, 654, 667, 671, 674, 675, 677, 682,686, 691, 692, 695, 698, 704, 709, 712, 715, 720, 721, 724,728, 733, 737, 738, 744, 748, 759, 777, 778, 789, 794, 797,799, 800, 805, 811, 817, 819, 820, 824, 826, 827, 833: n = A,T,C or G
nnanaananantaantnantnanannannnnganaannnannaanannnnannncnnnnnannnnaanannaannatnnnanganannanaaaananataaanannaannanaanaaanganannnnannnagangnnannnaaannatcnaannannnanngannaagnnannnncnnatannaagagnaagggnnatnannaaagggggagcnnaaanangnganngnggaanatnggangnannnantnaaaannnnanananananggggagagttcctaaaggttgggnaaaaacncacnncncaaaaaaagacgagnaatgggcantggannaaaactatcactaangnnaccannncacaantnannnggtnncaacactaannnantnnnantnctangnganganattaancnntnnnnnnnttnnnaatctancatcncncantanntancnnnatnaanntcnnanctaancannnnannnagannncnattgaaaaattanaatatncacnatancaaannaacancnantaatnnaanaannaannnnaagananngccaancatcnanagncnanaannacaatcgnaacntaancancnattanttatntnncaaanganattaannacnngctntatntaaaactacatantctnaanncnaatantatntaatnnatntanacacanatcanagnagnaaaannagntaanaaacntctnngactantaanatatctaactncacaaaagataaaatcannacgtatacganttatnganannactcnacaaantctatnannaaangnntcacanagtancntnaanaanantnnaacatnagagcatngccacaangtatannaatataaantagtancacantatnnctcannnaacatatnnatanngntatnntggagctanannagtctnannnnanagacacatnnncanaatanntatatnnaaananaacaatangtncntgatnnannncnacncacncacanatacantncatnaanacattnacacaanntannanaatcacanctaacatctcatnnatacnannntccttcacatannntcnnactatntantcactnnaaaaacataanannanggacaactnnacncnctaatntaccanatnncatanangatanatagancnanaacaaanattagaantanatanaaaatttaaacgantcatanaaatattnnaannanacacatancncancaatannaactacnattanatcatnacanaantantcgaccataaananacataaatantatnannaanatnannntaaggccanncanattaaatcacatatatntatatanatnanaatgncagaagatatananncnataactaaaantanacatntaatantcnctatnng

SEQ ID NO: 5331 - DNA, 1390 bp, Homo sapiens
  misc_feature 3, 4, 5, 6, 7, 8, 9, 10, 11, 12, 13, 14, 15, 16, 17, 19,21, 27, 28, 29, 30, 31, 32, 33, 34, 51, 63, 75, 76, 96,109, 110, 115, 127, 128, 129, 130, 132, 133, 134, 135, 139,140, 147, 148, 149, 153, 154, 155, 156, 157, 158, 159, 160: n = A,T,C or G
  misc_feature 166, 167, 168, 169, 170, 171, 172, 173, 175, 176, 177, 178,179, 180, 185, 186, 187, 188, 190, 191, 193, 194, 195, 196,197, 198, 199, 203, 204, 205, 206, 207, 208, 209, 210, 211,212, 213, 214, 215, 217, 218, 219, 220, 221, 222, 223: n = A,T,C or G
  misc_feature 224, 225, 226, 227, 228, 229, 230, 231, 232, 236, 237, 238,249, 250, 251, 252, 253, 254, 255, 257, 262, 265, 266, 267,269, 271, 273, 274, 275, 276, 277, 278, 279, 280, 281, 282,283, 284, 285, 286, 288, 289, 290, 291, 292, 293, 294: n = A,T,C or G
  misc_feature 295, 296, 297, 298, 300, 307, 309, 311, 313, 318, 321, 322,323, 324, 326, 328, 329, 330, 332, 333, 334, 335, 341, 342,343, 344, 345, 346, 347, 348, 351, 353, 356, 357, 359, 363,364, 366, 367, 368, 369, 373, 376, 377, 378, 383, 384: n = A,T,C or G
  misc_feature 387, 388, 391, 392, 393, 394, 396, 401, 403, 406, 408, 409,411, 412, 414, 417, 418, 419, 423, 424, 426, 427, 428, 430,431, 432, 433, 434, 435, 437, 438, 452, 453, 454, 459, 462,472, 478, 480, 482, 484, 486, 487, 495, 500, 507, 510: n = A,T,C or G
  misc_feature 512, 513, 520, 521, 522, 526, 528, 534, 535, 541, 545, 556,557, 560, 563, 565, 566, 569, 577, 580, 584, 587, 591, 595,600, 605, 606, 608, 609, 611, 618, 624, 631, 634, 641, 642,649, 654, 658, 659, 666, 667, 673, 676, 678, 681, 683: n = A,T,C or G
ggnnnnnnnnnnnnnnngnanggtttnnnnnnnncccctttttttttgccnaaaaaaaaattngccccctttttnnttgccctaaaaaaattgggnccctttttggggnnaaaantttttttcccgnnnngnnnnaaannttttttnnnaaannnnnnnntttttnnnnnnnnannnnnnagggnnnngnncnnnnnnncttnnnnnnnnnnnnntnnnnnnnnnnnnnnnntggnnnatttttttttnnnnnnngnctatnggnnngnanannnnnnnnnnnnnnannnnnnnnnnngnggggganantntntattntannnngnannntnnnngagggnnnnnnnntantnggnngncganngnnnngatnaannntggcnntgnnggnnnnanatatnanatnanntnngncannnaatnngnnnannnnnnannagggggggcggcannnacaancanttaagctaanaaattncnantnanntgctgaantgaangaacatncanannttaacannnctgnanggctanntgaagncaanatggcttcaannaangcntnntanggacttanggntacnggntatnaggnacctncttanntnntnctaaccntatctngaacggnctncacctcnnaaattgnactantatnntaaaaannatcatnatnanatntnngganaangctgtcaaaaantnnnnnaancnnnnngganannngtatctanntnnacntggaatgncntaaacctataaaaaannangnnataaaanntcaacnnanannnanacntaaatntanaccntntaaagcncntanacnnatttcgagnncctngacaatanttttaanntcatacaaatgtgnnggganantncntatacacgngggtanantgnacnnnnnatcttgnggtanaagnntnctanagcgntatntnnttagnggnnaanatantntntngaggtatcatgagnntaactctcnnatnnanntcgatntacctcacgtngtgtgnatatnnntncantnnatctctanatncntatanatatcgcanaanatntacancacnnnngtnaatatantnnntannntntacnggantngagctctacagatgttntcgannaanattttanganaaaaataggtacanatanntgngggnactnataaaacnnganggnnnntnntttnnaaaaggnnnnacagnactttcnatnaataggatataactccangagcnactttancccanagatcatntcatacgncgngnaannnnnnctancataagnctnttgagccnatacnngctntatancnacangnatannncatnnggaaagnactctatnangatnnananncgcncanacn

SEQ ID NO: 5332 - DNA, 960 bp, Homo sapiens
  misc_feature 8, 12, 32, 107, 193, 266, 287, 306, 339, 348, 349, 354, 356,373, 380, 382, 386, 392, 397, 398, 400, 410, 419, 421, 431,445, 450, 482, 503, 508, 513, 524, 527, 535, 542, 550, 561,590, 595, 598, 604, 608, 609, 610, 619, 640, 649: n = A,T,C or G
  misc_feature 659, 666, 673, 677, 680, 692, 700, 718, 729, 733, 735, 762,771, 778, 783, 788, 808, 812, 824, 828, 829, 831, 834, 839,846, 849, 851, 852, 856, 864, 873, 874, 876, 878, 884, 885,888, 889, 891, 893, 896, 900, 901, 903, 904, 911, 913: n = A,T,C or G
  misc_feature 919, 920, 927, 932, 933, 946, 949, 953, 954, 955, 956, 958: n = A,T,C or G
ttctaatngctngctctcgctctcttggaggntccctcgattcgaattcggcacgaggctcgtgggaggctgaggcaggagaatctcttgaacctaggaggcagatnttgcagtgagccaagattgtgccagcctgggcgacagggtgaggctcttgtctcaaaaaaaaaagtccacatcttcatgaaccctnagactctggagttggggtgtcggcttttttagcccagcttttgtgggaattgccttttgacctattaaagaangaaagtggggtaatgggagtnccagccactcaagagactnggatatccccccccaaaatgggttgggttaccnagcttttgnnccccntnggaaaaatgaaaatctnaaacctntntcanctgggnttttnncntttgccaaanttcattttngngtttttaaanttttttcttaattnaccanttaaaactcccttatttttcccatggttcttncaaggggccccttggggtttnaacangaacnacccagctttngantttttaanaagccangaccattntgggcggaaangaaaaaaccaatggggcaatttggaaatnggtgnccngaagtncccnnnaccaaaatngtttaattttaattattaccncccattccnaaaatttttnaaggaanaaaaaantggnaantttcctttttangggtttcnaaaacccctgggaaattngatttttaaangccncnaaatttaaaaaccctggtttgccaaangttccaaanaaaaatnacatnttacnatcctcttcatacctaatcnctcnactacctcaatncttnntncanatctntcaactnttnannattnccattctngatatccanntnanataacnnatnncncntanaaanntnnttatctnanataatnnttctgcnattcnntctcatccctctnatnctcnnnntnct

SEQ ID NO: 5333 - DNA, 1024 bp, Homo sapiens
  misc_feature 4, 6, 110, 222, 244, 255, 284, 289, 299, 302, 303, 325, 336,338, 342, 343, 346, 348, 350, 355, 360, 366, 370, 374, 382,384, 388, 389, 390, 391, 401, 410, 419, 420, 429, 433, 450,454, 467, 487, 488, 507, 511, 519, 526, 528, 538: n = A,T,C or G
  misc_feature 550, 575, 587, 600, 602, 604, 606, 614, 635, 645, 658, 666,694, 707, 711, 720, 725, 742, 743, 747, 768, 788, 799, 807,828, 831, 841, 857, 858, 859, 869, 879, 894, 922, 941, 943,944, 961, 974, 976, 989, 995, 1000: n = A,T,C or G
aatncnaggctctcgttctttttgcaggatccctcgattcgattcggccgaggattccgagtgtttactaagcctgttgaccctgatgaggttcctggttatgtcactgnaataaagcaaccaatggacctttcatctgtaatcagtaaaattgatctacacaagtatctgactgtgaaagactatttgagagatattgatctaatctgtagtaatgccttngaattcaatccagatagagatnctggagatcgncttattaggcatagagcctgtgctttaangaganactggctatnccnntaatttaaagaaaaaccttttngaaaccttttncngctnnttngnangaaantttcnggaatntttnaaanaaaaaaangnttgnnnncgttcccccnaaaaaattncccccccgnnttttaactnaccnctggtggattgggcccnaaangcccaaaaatttncccctcctttgggttggggnnggatttaaaaaggattccntganccccccgnaggcccngnaaattggganaaaaggctttanaggaacacccccggggttaaccttnccctggtggggncttttggccaaancnancntttccttnggctttcaaaattttgtaaangaaagggganaaaaaattttctngcccaaanaaaaagggttccaaaaaaaccttggggntgacctttttaangggnccacccccnttttnttaaaaaaaaaagcccnnaaangggggaaaggaaatttttttnaaccaaggggggcccaaaanggggattgggnatttaggnccccccggaaaattggccccnttngggaattccncccaaaaaaatttggnnnaaagttgganttccccccanggggaaaaccttcanggaccccaaaggtggttagaatccattnatgggggacccggaaaacncnnggagaagtctttcgggngggaagaaaattnanaaaaccgccaaantgcccnttttnaaagcaaacttggaattgggaaaa

SEQ ID NO: 5334 - DNA, 834 bp, Homo sapiens
  misc_feature 2, 3, 4, 5, 6, 7, 9, 10, 11, 12, 13, 26, 30, 39, 40, 53,61, 80, 91, 157, 158, 172, 177, 178, 179, 180, 184, 218,226, 252, 407, 437, 450, 507, 523, 560, 579, 580, 605, 640,649, 653, 672, 678, 698, 700, 701, 707, 708, 709, 713, 717: n = A,T,C or G
  misc_feature 719, 724, 728, 735, 736, 740, 744, 746, 751, 754, 755, 768,776, 783, 788, 789, 810, 813, 816, 817, 822, 826, 827, 828: n = A,T,C or G
gnnnnnntnnnnntttcaaatgcttngcantcgcttggnngcaggatcccttnggaagccnttggacgacacgtggcgtnccgctgaattnaagcatattagtcagcggaggaaaagaaactaaccctctagttttaattggacacttctttgctgnngcaatctatgccgngtatnnnngctntaagtcagaaccttggattacaaaacctcgagcncccccagnagtggtgctgtattgtcaaagcgtgntctgtaatatttcctctaatttactcagaaatgaagtatatgggtcattaagcttaaaggggaaccatttgtgaatgaatatttggaacttaccaagtcctaagagacttttggaagaggatatatatagcatagtaccataccacttataaagnggaaactcttggaccaagatttggattaanttggttttgaagntttttggatataaatatgtaaatacatgctttaatttgcaatttaaaatgaaggggntaaataagttagacanttaaaagaaatgattggtaccataaattagtgctaangctgaggagaactacaggnnttcctttggattaaggatttgagangagttggtggggcatgcaaattaaaatggaagaanggaaaaaanaaanaaaaaaaaaacctcggagncctctngaaacccattagcgggggcngnnttaccnnngaancccngnacatnggtnaaggaannccantggnanggaanttnnggggcaaaaaccncccaaccntggaaangccannggggaaaaaaaaaaggccttnaanttnnggggnaaannncgggcc

SEQ ID NO: 5335 - DNA, 940 bp, Homo sapiens
  misc_feature 11, 23, 24, 27, 42, 45, 53, 55, 56, 59, 65, 83, 94, 102,103, 105, 118, 126, 132, 134, 139, 144, 155, 169, 172, 192,195, 196, 206, 221, 225, 228, 233, 235, 237, 238, 240, 244,248, 252, 266, 268, 290, 302, 307, 342, 352, 354, 369: n = A,T,C or G
  misc_feature 389, 401, 409, 419, 427, 429, 436, 444, 473, 495, 502, 512,530, 532, 536, 541, 550, 559, 576, 589, 615, 664, 665, 673,692, 712, 724, 729, 740, 742, 760, 774, 780, 782, 793, 794,796, 805, 806, 807, 810, 813, 823, 829, 851, 859, 885: n = A,T,C or G
  misc_feature 887, 888, 898, 906, 910, 923, 931, 932: n = A,T,C or G
gtaggcccggnttaagttttacnnttnaaattttcagccacngantggttccntnncgnccgggnttcttggagggttttttntggattttctnttttcctnncnaccattttcattnccttcatnatttcngngcccnttacntttaaaggttntaccgtccggtatngcntaatggaaggggtaaaatcnggnnaattcatggnttggccattctggcnctgngtnccccntncnnanaggncttnaccnaaccttgatggggncntctacttcccccctaagctttnttgtgccacctngttgnttcttaggtacaaaactattccaaatggtacctgncctggatccntnggccaatggggaccncatgggtaagattctgggtntttttaaccatnaaaaaagngccattaaanatcccggntnaagattncaaaatgntattgggggcttccatgaatgggacttgnggactggaaattctctggggantcaatgnaataatggtnaatgaatgtgaagacctnanaccntgcantacttgganacttcttanacacttgtgccaatttnggatattacctanaatttattttaaaaatgggtttttcntttccttttaagtaaattaaaatttaacccctttaggcctttacctggnnaaaccttntttttttttacccttccanttaaaaccctttaaaaaaanttttttaaaaanttttntttggggaccntntttttttggttaaaaaanaaaatttttagccntttttnanccccccccctnntngaaaaaaannnttnggnaaacttcccngggggncctttttaaaaaaccttttagngggggggnccgaattttacccgtgggaaaccccncnncccttttatnaaagaaancccntttggatggaagnttttgggnncaaaaccc

SEQ ID NO: 5336 - DNA, 840 bp, Homo sapiens
  misc_feature 6, 9, 16, 60, 72, 117, 189, 196, 202, 204, 216, 224, 245,249, 326, 334, 342, 371, 381, 387, 389, 390, 396, 417, 421,439, 462, 493, 504, 529, 541, 552, 578, 582, 588, 597, 602,624, 636, 638, 664, 665, 669, 680, 697, 700, 715, 737: n = A,T,C or G
  misc_feature 745, 747, 767, 769, 789, 805, 806, 810, 822, 826, 836, 839: n = A,T,C or G
taatanctnggctatngttctctttgcaggatccctcgattcgacacccaatggcgggtnacgccggtgcanagggggggcccgggggccctggtggccctgggatggggaaccgcngtggcttccgcggaggtttcggcagtggcatccggggccggggtcgcggccgtggacggggcccggggcccnagccccngacttncngaggcaaagccnaggataangagtggatgcccctcaccaanttgngcccttggtcaaggacatgaagatcaagttcctggaggagatctatctcttcttcctgcctattaggaatcagagancatttgantttttctngggggcctttttcaaagattaaggttttnaaaaaatttnccaatncnnaaacanacccttccggcaacgcaccangttnaaggcatttgttgctatncgggactaacaatggccacctcnggtctgggtgtaaatgctccaaggaagtggnccaccggcatncgtgggggcattattctggccaaanctcttccattcntccccctgccncaaaaggcttacttggggggaacaanattnggcaanccccaaaanttgtncctttgcaaaggtgaacaaggnccattttcgggntnttgtggcttgggttacccccttaatnncttnggaaccccaangggcaacttgggcattntanttttcccgtaacctngtggcccttaaaaaaaaacttntttcattnantggcttggggattccaatgnantggcttacaaactttaaacncccgggggctttcaannttgntcaaaccctttngggnaaaattttgnccnt

SEQ ID NO: 5337 - DNA, 760 bp, Homo sapiens
  misc_feature 2, 12, 83, 85, 86, 87, 93, 94, 95, 98, 105, 120, 123, 125,127, 132, 135, 151, 170, 175, 183, 187, 193, 201, 211, 212,214, 218, 221, 229, 230, 231, 234, 238, 260, 262, 275, 277,283, 284, 293, 306, 312, 326, 329, 330, 334, 341, 342: n = A,T,C or G
  misc_feature 344, 354, 368, 370, 406, 409, 418, 419, 425, 441, 457, 468,496, 507, 524, 534, 544, 560, 562, 566, 571, 576, 585, 593,630, 641, 649, 652, 661, 677, 679, 700, 701, 707, 719, 726,738, 739, 750, 759: n = A,T,C or G
cntttttgaaancccttggctacttgctctttttgcaggatcccatcgattcgaattcggcacgagccaacgtgttaggcctncnnngcacgnnnctnaagctgnttctgaatgagaccnagncncntgaanttncacaagacatccccgngaagactttgaatatgaanactgngtgtgtcnatgngttacnaacaacantatacttctnncntgtnctnatcaatgnnnatngggnaacccttccctaattacacctntnccctacacatacntncccatnnacacacacntgaacacactgangatgtnccctttaagtgtgngtnnaatntgctgcnngnattgaaattnaaatgggattgatnantcaagtgacttgagacctgacagcatctttacactnaancttagacanntatgcnctcatgtgggcagcangttacaatggtacttnagcccacagtntattgctatacttgagttcttaactcanaacatatattntgatttgaatggcatantgtatatatnatttcatgcncttttaaaattatctnanaccnctttnatganatgggcagnatgataantgtctaacacctgggatttaactggataattttgctngaatcttttangttttganctnttcaggacnagttaacagacctcanantgttccaaaggcttaaattgnnaactcnaagccctttttnaaaattnatggagtccaannttacctggganccaggacant

SEQ ID NO: 5338 - DNA, 793 bp, Homo sapiens
  misc_feature 2, 4, 5, 9, 15, 16, 19, 21, 40, 48, 67, 94, 95, 96, 102,111, 115, 137, 151, 155, 163, 175, 176, 184, 201, 205, 212,214, 223, 224, 226, 235, 243, 248, 264, 266, 274, 278, 281,286, 288, 298, 299, 300, 304, 305, 310, 322, 325, 326: n = A,T,C or G
  misc_feature 333, 337, 341, 355, 369, 371, 374, 376, 384, 387, 394, 397,410, 416, 417, 455, 465, 482, 491, 496, 505, 506, 509, 529,535, 541, 556, 563, 578, 595, 602, 612, 615, 629, 655, 685,688, 689, 703, 709, 716, 721, 729, 738, 748, 750, 756: n = A,T,C or G
tnanngtanaagacnncgngnaaagcccatcagccggaangcaaaggncgcgggtggccccaagagngggaggagtgggctgacagaaggcccnnntcccanccgcgcacnggcngacccccaggggctaggatacnggagatgaggaacngganaaggggcncaaagagcacanntgactggnagaggacacagagctgncctncaagcanangaacgaagnncncataccccnggaacctnccccnctccaggctcacaccncnagctccancaanganacctnangcgacaacannnaagnnccctnccccaacctagnccnncagcccnaaangaangaacacagatgaanagccctgaagacancnggngnccacaggnggngcccgangcnccgggtgaaagtngaaganngaccagtaagagggaagaaagaatggctcctccctcanttcagagaanacatcctagtcacaagngcccctaangcacncaaggtctnnganagctacattccctcactgancccagnagaaanacactaccaactgangcaccanctaggattaacaacnagccaagcctccccttncctttcncaaggaaacntcnccccacaagggccnccccaatccagaaaatgcctataaanccctggccaacttccggggaaaggggaccnccnngaagaaacaaattnaaaaanaaaaacnaccgntaataagnaaccggggngaaaaaaggncnaacccnccaaagggcccccgggcaaaaaaaatccccaaggccg

SEQ ID NO: 5339 - DNA, 1487 bp, Homo sapiens
  misc_feature 12, 13, 20, 22, 24, 37, 48, 54, 75, 81, 84, 85, 88, 97, 101,102, 103, 112, 113, 115, 116, 120, 127, 131, 136, 142, 144,145, 146, 147, 149, 151, 152, 160, 164, 167, 176, 185, 194,195, 196, 199, 207, 209, 219, 221, 223, 228, 229: n = A,T,C or G
  misc_feature 232, 241, 251, 262, 266, 267, 269, 273, 276, 287, 289, 292,295, 296, 300, 301, 303, 306, 310, 314, 316, 317, 318, 321,322, 329, 335, 338, 343, 353, 354, 356, 359, 360, 361, 368,372, 379, 382, 386, 392, 394, 397, 399, 400, 410, 414: n = A,T,C or G
  misc_feature 415, 416, 421, 426, 429, 430, 433, 434, 439, 446, 454, 455,456, 457, 459, 460, 464, 468, 474, 477, 481, 489, 499, 506,507, 508, 509, 510, 512, 521, 522, 524, 529, 534, 537, 539,540, 541, 551, 552, 556, 558, 564, 585, 587, 597, 599: n = A,T,C or G
  misc_feature 600, 605, 607, 609, 612, 613, 620, 623, 627, 628, 637, 640,642, 657, 658, 659, 660, 662, 668, 675, 680, 682, 685, 695,710, 713, 716, 722, 723, 724, 730, 740, 757, 758, 760, 766,770, 781, 788, 791, 797, 802, 806, 811, 822, 826, 836: n = A,T,C or G
  misc_feature 839, 841, 848, 858, 859, 865, 870, 873, 876, 888, 890, 898,901, 903, 904, 905, 910, 913, 915, 929, 930, 932, 934, 937,940, 942, 945, 951, 955, 956, 957, 958, 964, 969, 977, 986,994, 995, 996, 997, 999, 1001, 1005, 1011, 1017, 1021: n = A,T,C or G
  misc_feature 1023, 1024, 1044, 1047, 1052, 1054, 1062, 1075, 1079, 1084,1085, 1091, 1093, 1095, 1107, 1110, 1114, 1123, 1129, 1131,1141, 1145, 1155, 1160, 1161, 1165, 1166, 1170, 1177, 1181,1188, 1189, 1193, 1199, 1201, 1204, 1205, 1213, 1219: n = A,T,C or G
agggggaggggnntttttancncnccccctttagggnggaaaaaaaancccccntttttggggagaaaaaaaggncccccnaanntangggggaganatgnnngaagagggnnanngggnaaagcanaccnaaagngggganannnncngnnaaaaaaangcgnggncaagacagnaaggggggncgagagagnnngcnggggagananaaggggaggntntntgagnnaanggccgaatngacgaaggtncggatgggggncaannangggnganaggggaaaggngnaanggnntacnngngantggnaaangnnnatnnggggganaaaggngantgagncgggcaaaannantannncggatangggnataggtngantgangtggangntancnnagataggcgnagannngaaantgagnatnntgnnacacnatggggnataaggcnnnnanngaanggancaggangangaangggcatantagggcgaangaagaannnnngntaggatggnngnaaaanaaaantgntnnngaaagagaanntgangnaagtgncggagaaggacgaagaataancnatgcggaagnannaaggngnangtnnaaaaggncangaanncagaacatngangncgaaaaagcacaggnnnnanggaagngggtgcnaaggngnaanaagagctatnagggggaaaggaagnggntgngggaannngaaganaaggggaggnaagcaaggaaacgatgnnanaagaanaggntaaacgcaagnaggtatnaanaaaganacaancgangtganaggggaagggngggncacaatgaangangngaatggntaggacgcannaagacntaganganagncaaagacgtagngncaaagganganannnacgcnagngnggagacgtaagggnnangngtnagncnaanagatanggannnngaaaanagggngaggagangtagaaagncgaacagnnnnangngagngtgggngtaganagantnnggaaaaaaggggacgcgtanganaacgnangacgcaangaggaacgaagcnaaanagagnnaggagnananaagcgaggaganaangatnagggagagntgagananaacgaatggncganaagagagagnaggtnngcanngagnagaagancganggaggannagantgacgngnagnngagagaantacacntatnaggnnngagaagataaangcngagaagatnganngngangaganacganagnnatgnaganagnnaanntagnagagagagagngngngagagaaaaangtgagaggagaggnaagangaancgngagnggacaggangagagnnntatgnnnggnnanggganagtgnntntcntgngcnacanncnnatnnggacnacgagatgtgcanaganangnngngnagangnngnntagatagagannanagggnataagagacng

SEQ ID NO: 5340 - DNA, 768 bp, Homo sapiens
  misc_feature 2, 3, 9, 11, 12, 13, 17, 24, 27, 28, 30, 32, 40, 49, 57,60, 61, 64, 69, 70, 95, 109, 111, 177, 188, 198, 219, 243,258, 294, 329, 374, 376, 379, 392, 432, 486, 537, 559, 573,576, 586, 587, 588, 639, 646, 657, 667, 686, 708, 737: n = A,T,C or G
  misc_feature 751, 752, 755, 766: n = A,T,C or G
tnnaggttngnnntgtngggcctnttnncntngttgtaancgctggctngctcgcancannctngctgnngcgaattcggcacgaggtgcattgnggccaatggtggcntntgtagttcctgaacatcagctgggaactgcatatggcttcatgcagtccattcagaatcttgggtnggccatcattnccatcattgntggtatgatactggattctcnggggtatttgtttttggaagtgtncttaattgcctgtgnttctttgtcacttttatctgtggtcttactctattnggtgaatcgtgcccagggtgggaacctaaattatnctgcaagacatagggaagaaataaaattttcccatactgaatganangtncaaatgaatgtgncatgagaatgggcttaacacatcgttggtttgaaaacttncatttttaaaaatttagagtttagtcattagaaaaaataatggactggaaagtnatatgtatatccaaatatacctatttcaaagtgtatttgtgaggcctgttntagcctgtgtcttgtgtattgngtgtcgctaaaganttntacttttacnnngctcatcaacaatgaaagggtttgaaaattgctgtggaacatccacgtganctttttngaaagacagtnaaaaaatggnaaacgtttggagctttctnttgagataatctacatttaggnaatataatcttaagggatacagccctttncctttattcttatnncangaaaaaaaaanct

SEQ ID NO: 5341 - DNA, 718 bp, Homo sapiens
  misc_feature 2, 4, 10, 14, 31, 419, 675, 718: n = A,T,C or G
gngnctttanatancttgctcttgttctttntgcaggatccctcgattcgagcggccatggccaacttggaggtgaagaaagcattcatgggaccactgaagaaagaccgaattgcaaaggaagaaggagcttaatgccaggaacagattttgcagttggtggggtctcaataaaagttattttccactgaaaaaaaaaaaaaaaaaactcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcanggggaggtgtgggaggttttttaattcgcggccgcggcgccaatgcattgggcccggtacccagcttttgttccctttagtgagggttaattgcgcgcttggcgtaatcatggtcatagctgtttcctgtgtgaaattgttatccgctcacaattcccacaacatacgagccgggagcataaagtgtaaagcctggggtgcctaatgagtgagctaactcacattaattgcgttgcgctcactgcccgctttccantcgggaaacctgtcgtgccactgcattaatgaatcggccaacn

SEQ ID NO: 5342 - DNA, 760 bp, Homo sapiens; identical to SEQ ID NO: 444
  misc_feature 2, 5, 13, 14, 16, 19, 21, 26, 27, 49, 52, 54, 63, 70, 71,74, 225, 489, 494, 513, 549, 559, 566, 573, 600, 622, 684,703, 706, 709, 714, 750, 755, 760: n = A,T,C or G

SEQ ID NO: 5343 - DNA, 799 bp, Homo sapiens
  misc_feature 6, 20, 21, 26, 30, 37, 45, 51, 54, 64, 65, 68, 70, 71, 85,105, 108, 126, 128, 131, 133, 138, 141, 142, 152, 153, 154,159, 166, 175, 183, 196, 198, 202, 208, 213, 215, 218, 222,229, 235, 251, 252, 254, 256, 262, 263, 264, 276, 278: n = A,T,C or G
  misc_feature 280, 286, 287, 291, 295, 307, 310, 313, 317, 319, 324, 329,339, 342, 348, 349, 352, 361, 364, 368, 373, 376, 377, 384,386, 389, 390, 398, 406, 412, 413, 415, 416, 421, 426, 428,432, 450, 462, 476, 477, 479, 480, 498, 504, 509, 511: n = A,T,C or G
  misc_feature 515, 522, 525, 526, 531, 532, 542, 545, 552, 562, 565, 570,571, 583, 594, 599, 604, 605, 614, 618, 620, 625, 628, 634,636, 638, 640, 644, 651, 654, 655, 656, 659, 664, 670, 671,679, 680, 684, 687, 688, 690, 691, 696, 698, 705, 708: n = A,T,C or G
  misc_feature 710, 711, 712, 718, 721, 727, 735, 740, 744, 748, 761, 768,778, 779, 785, 795, 798, 799: n = A,T,C or G
ttaagntttttttggttggnntttcnaatnttgccanaaagctgnctactngtnctttccgcannatncnntcgattcgaattcnccacgagctgataggtgccnccnttaagacttttcatagancntangncgganccnncaccttctcnnntgaangatactnacccagggnaatggtgnatgctgtgaacanantggngaaccnctcantntgntaanattactnactaanctcaaaagttaagctnnancncacacnnntatcctacctcntncnctgagnntcangttncacacaaaaggnctnaangccntngatcnacctnattatggacntgntcatcnnaancctaatatnctnctcngtacngtnnatatttncnacnnagcattcnctatcttncatccnntnnccaanctggncnctancttactacttgcacctcnctgtacccaacntttccatccattgnntnncctatcaaactccttcanttatgnccttnanctcncgtaaanacnnatgcnnatcttgagtncanacttttnttgcgccgcngtngctcnntttcttttaccnttggaacccgnataancatgnnttttagaanaatnancaccnggnaccttntnancnctanatatgcnctnnntantgctntgactnntaaactannctcnaanngnncttananccttatnaantnnncccttnatnatagtntcattaanggtantccntttncggatccatttanccctttnccatttttgnncctacntcatttaacnttnn

SEQ ID NO: 5344 - DNA, 794 bp, Homo sapiens
  misc_feature 5, 6, 28, 83, 86, 96, 112, 130, 132, 135, 207, 208, 211,266, 278, 284, 296, 344, 350, 356, 374, 379, 389, 411, 417,418, 432, 439, 443, 444, 453, 466, 469, 479, 487, 500, 523,527, 535, 542, 554, 556, 561, 566, 571, 572, 587, 588: n = A,T,C or G
  misc_feature 589, 609, 613, 616, 648, 650, 651, 652, 657, 660, 662, 668,676, 697, 698, 709, 727, 733, 740, 742, 757, 759, 760, 771,793: n = A,T,C or G
ggtgnnttccccctttgaaaccctttanacaagctacttgttctttttgcaggatcccatcgattcgaattcggcacgagctnttntccccctatnaaatttgcaacaatanagggtggagggtaatctntnctntcctatactgccaaagaatgtgaggaagaaatgggactctttggttatttattgatgcgactgtaaattggnncantatttctggagggcaattcggtaaaatgcatcaaaagacttaaaaatacggacgnactttgtgctgngaactntacatctagcanatttctctttaaaaccatatcagagatgcatacaaagaattatatatnaagaanggtgtntaataatgatagctatantaatnaataattganacaatctgaatcccttgcaatnggaggnnaattatgtcttagntataatnaganngtgaatcanccaactgaaaatnctntttgcatatntcaatgtnctaaaaagacacngttgctctatatatgaagtgaanaaangatatggnagcattntatagtactagntntgctntaaantgctnngtaaatatacaaaannnctagaaagaaatatatatancctngtnattgtattttgggggagggatcctgggataantnnntatgntcntngaatcncttctggngtcttcacatttttctaccanngaatttaatcnaatagtaaagttgttggnaaaaantcaaagntnggatttagaaagatncnnttcttgaaaanacctgcttttggtaaatgaaanc

SEQ ID NO: 5345 - DNA, 769 bp, Homo sapiens
  misc_feature 18, 23, 27, 28, 30, 35, 55, 62, 138, 198, 278, 360, 392,404, 537, 544, 557, 573, 599, 622, 627, 646, 647, 682, 684,694, 706, 708, 710, 719, 721, 723, 724, 729, 734, 737, 742,750, 751, 754, 759, 761, 767, 768: n = A,T,C or G
tggttttttaggtttggntttcnaatnngnctaangctgggctcttgttcttttngcagganccctcgattcgaattcggcacgagatgagaaccagaacaagtctggcagcgaggccggcagtccccggaggccacnaagacagcggtcagatcaggactcagacagtgaccagccatccagaaagagaaggccctncggttctgagcagtctgacaatgaatctgtgcagtcagggagaagccactcaggagtttctgagaacgactctcgcccancttctccaagtgccgaatcagatcacgaatcggagagaggatctgataatgagggttctggccaaggctctggaaatgaatnggaaccagagggatccaacaatgaggcctcanatagaggctcanaacatgggtcagatgatagtgactaggttttatttcatcaataagcttcatctctggaggaaacttttttaatatatgaaagctgtgatcaaaatgtttcacatgtttagtcaattgtgaaatttttcttaangcaattntcttttctatcantttgtatattactaanccccaagagacattttctgtgctagnagtccaatattttgagtctctcntgcanatgagacttattcttttgnngtacaatttcccctatcatatgtgaaaaactgctntntcaaatttancccttatgctanantnattcctacnanannttctncctgntanctgtngctacaannttntattntntttttnnt

SEQ ID NO: 5346 - DNA, 1338 bp, Homo sapiens
  misc_feature 5, 6, 8, 40, 48, 59, 70, 81, 84, 87, 92, 103, 109, 113, 117,120, 125, 139, 145, 163, 164, 176, 181, 182, 184, 187, 188,190, 191, 194, 195, 197, 201, 203, 205, 208, 209, 213, 215,225, 228, 230, 232, 234, 236, 238, 243, 244, 245: n = A,T,C or G
  misc_feature 246, 247, 249, 250, 252, 259, 263, 266, 273, 277, 279, 281,283, 287, 289, 290, 294, 297, 299, 300, 301, 302, 303, 305,307, 311, 312, 316, 320, 324, 325, 327, 328, 329, 332, 333,335, 336, 337, 338, 340, 343, 344, 345, 346, 347, 350: n = A,T,C or G
  misc_feature 354, 355, 360, 364, 365, 366, 368, 372, 374, 377, 378, 379,381, 383, 386, 387, 391, 393, 396, 398, 399, 401, 402, 403,405, 407, 412, 415, 418, 420, 421, 431, 432, 433, 437, 441,445, 446, 447, 449, 453, 458, 463, 468, 469, 470, 473: n = A,T,C or G
  misc_feature 476, 477, 479, 480, 481, 483, 485, 486, 490, 494, 497, 498,499, 501, 508, 509, 512, 513, 514, 516, 520, 522, 524, 525,526, 530, 533, 534, 538, 539, 540, 542, 546, 547, 555, 563,564, 566, 569, 570, 573, 578, 579, 585, 586, 590, 591: n = A,T,C or G
  misc_feature 592, 593, 596, 599, 606, 607, 608, 609, 612, 613, 614, 615,617, 622, 623, 629, 631, 632, 633, 634, 638, 641, 643, 646,647, 650, 656, 657, 666, 667, 669, 671, 673, 676, 679, 680,687, 692, 694, 698, 700, 701, 704, 710, 711, 712, 716: n = A,T,C or G
  misc_feature 718, 725, 729, 734, 735, 736, 737, 739, 743, 748, 749, 750,753, 755, 756, 758, 768, 771, 775, 786, 791, 794, 797, 803,804, 805, 807, 808, 811, 813, 814, 816, 818, 819, 826, 828,830, 833, 834, 841, 842, 843, 844, 846, 850, 854, 857: n = A,T,C or G
agggnngntctttccaccccctttgtttggaaaacccccnttttgaantaccaagcctnactttggtgtnctttttttggncanggnaatcncccaattccgncatctncggnaganagntcccnacacactagccagnacacanatctcatcaccaataacnngttttttatcantatcnncncanncnntcnncncgantntncgnngtangntgtcgacaanttntntncncntntaaannnnncnntntactatnatcnatngtcatcntcancnantnttcntnnctancgnannnnntncncttnnctantctnactnngnnncanntnnnnanatnnnnnctnctannaacancacnnngntatntnacnnntntnacnnttgncnctnanntnnnantnctatncanttncnncattaacatnnncccnatancaannntnaccnatcanatacnttttnnnganacnnannnancnntctncttnccnnntncctaacnntannnantctncngnnntttnaanncttnnntnactnncactactnatacattnntntannggntccannaaactnnagtnnnnccntanactgatnnnnatnnnntncttcnnctattncnnnngtanttnanacnnacnatcatnncttttcatnncncnanttncgnnaatcatntgtantntaanannaantcctannntcgncnctcttcncttnctcgnnnntntatncactnnnatnanntnactaccactnctntatntcataccagantatanatnttnaaatcnnntnntcncnnancnntctctcncnangcnntacgacnnnnantcantttngtncantgaactaantaaaantgtctnttctatatcnncagncnatnntntnataaatactctctcatnnatnntnatnacacatatntntncncattctcctatnatctgnatatnntcgtcncnntctcnganacnnncactctatgatatnntntacncactatatntacnanngtatgntangnnacatanaangcttaaactnnanangnatacgacttcantatcncatataacncctcgntatgcananaatcgnactgttaatgactngtatntcgatacncctctanangcntnngtatacntntnggtcnncanancttcatntacnctngtanttatgntatatatangcacngannncnngnaganatcnantacacccttatannttacnananntatatntctaatnngncctctntnactctcnacgntangnnnnactgntatnttcacacntaantattataatncg

SEQ ID NO: 5347 - DNA, 884 bp, Homo sapiens
  misc_feature 2, 4, 5, 9, 13, 17, 19, 22, 28, 41, 46, 61, 63, 65, 66, 87,102, 107, 113, 116, 117, 119, 121, 122, 126, 138, 167, 170,184, 193, 198, 200, 203, 204, 211, 225, 228, 231, 235, 289,294, 298, 306, 318, 320, 331, 338, 339, 349, 350, 352: n = A,T,C or G
  misc_feature 353, 354, 356, 366, 371, 375, 383, 393, 394, 399, 403, 406,410, 413, 414, 416, 421, 423, 425, 428, 430, 435, 436, 438,439, 441, 444, 449, 457, 459, 466, 467, 470, 475, 476, 480,483, 484, 498, 499, 502, 510, 511, 514, 518, 519, 528: n = A,T,C or G
  misc_feature 540, 541, 551, 560, 561, 567, 570, 585, 588, 589, 592, 596,611, 618, 619, 620, 625, 628, 629, 637, 638, 640, 649, 651,656, 662, 669, 675, 684, 686, 688, 690, 694, 702, 703, 706,712, 722, 726, 729, 743, 748, 750, 756, 765, 776, 780: n = A,T,C or G
  misc_feature 791, 792, 795, 800, 805, 809, 816, 817, 818, 819, 825, 826,838, 840, 844, 848, 851, 856, 857, 858, 864, 865, 872, 875,878, 881, 882, 883: n = A,T,C or G
cncnntctnatgngggnangtnggtctntcctacctctttnagganaccctctcgcctaanancnnggctggggcgaattcggcacnagggaatggatattnggggnggagantanntntnnattncctttaggatcnggcactgtggaggaactttggaaattgtnacntgctcacatgttgnacatgtgtntcggnangcnncaccttncacctatccaggangcncanggcngattatcaataacaataacagacgacttgcccaagtctggatggatgaattcangaatnatcntctatatnattgctccatgngntacaaaggtcncattatnnatatatatcnncnnnanatggacttanacacnaacntcaatgcnaaccttttanntgcancctncanactntanntnctgancntntantnccacnncnntntanctcanagggagananacaaatnnttntagcnnttcnaannctacatatcccagnntcnaaaagagnntgnctannctggaattntttaatggccannggtctggggngtaaatcanngatcantcnttataactgcctacnctnnacnttcncaacattatgaaccntttgctnnncgaantgnnttcccaanncnttaaatcgngnccctntcaccnaatggcntcaaanatgcccaancnancncttnaaaaacgnnctnccccanactttttggngcanttnttgaccccccactnggaantnatttancatcccccnagtctaccccntttnttggaaacccnngcnaaatncaatntggnccccttnnnnaacttnnacaccccccccncnaaancaantgnatttnnncccccnngctcttnccnccnacnnnt

SEQ ID NO: 5348 - DNA, 1050 bp, Homo sapiens
  misc_feature 10, 16, 17, 18, 19, 20, 21, 22, 25, 26, 36, 37, 38, 41, 44,49, 52, 71, 78, 87, 88, 97, 98, 106, 112, 115, 116, 123,129, 135, 136, 142, 143, 144, 146, 155, 161, 164, 165, 175,182, 184, 186, 187, 188, 189, 191, 193, 201, 203, 206: n = A,T,C or G
  misc_feature 209, 214, 216, 217, 220, 227, 231, 232, 233, 234, 236, 239,242, 246, 248, 250, 252, 256, 258, 261, 262, 268, 270, 275,279, 285, 294, 296, 299, 301, 318, 329, 331, 333, 342, 343,346, 349, 352, 356, 361, 363, 366, 367, 368, 372, 377: n = A,T,C or G
  misc_feature 385, 387, 388, 391, 396, 401, 405, 409, 412, 414, 416, 418,424, 425, 427, 428, 431, 435, 436, 439, 444, 447, 452, 458,459, 460, 461, 467, 468, 470, 472, 477, 479, 482, 485, 497,516, 517, 521, 526, 528, 532, 534, 542, 543, 549, 552: n = A,T,C or G
  misc_feature 553, 555, 557, 562, 566, 571, 575, 580, 587, 593, 602, 608,609, 611, 618, 622, 623, 629, 631, 635, 637, 642, 648, 649,657, 664, 669, 678, 681, 683, 686, 688, 693, 698, 705, 708,712, 727, 728, 729, 732, 733, 749, 757, 760, 763, 766: n = A,T,C or G
  misc_feature 767, 769, 770, 772, 776, 779, 785, 787, 789, 795, 798, 802,810, 813, 822, 823, 829, 835, 836, 838, 839, 851, 853, 856,860, 864, 875, 877, 878, 881, 882, 883, 887, 888, 889, 892,898, 901, 907, 908, 917, 918, 919, 922, 926, 928, 939: n = A,T,C or G
  misc_feature 941, 945, 946, 957, 964, 967, 975, 978, 983, 986, 988, 989,990, 994, 996, 1001, 1002, 1005, 1007, 1008, 1010, 1014,1018, 1020, 1027, 1033, 1034, 1035, 1043, 1044, 1047, 1049: n = A,T,C or G
tgggtggctngggggnnnnnnnggnngtttttcttnnnttngtntgggnggnccttttactcgcccctaanatcaganattggggtnnggggggggnntggctcgntacctntgnnttctctnagaatnagtgtnnttgctnnntngtctggggnatttcnccnntttttttctnggggggntntnnnncntngggggggntntcntgngggcncnntgnttgctancctnnnntngtntcnatgntntncnttgntntcnnactttntnttgtnattncttatncactctctncnttncnatatctcatgttgttgnctttcattttncncnaagttcccnntgntcnatntttnttatncnccnnntttntgctntccttttntnntanagtgncactntctngttnttncncntntttacnnannttncttnntanttttnccnttttntttccnnnngctgtnnantngggtncntcngcnttcttctcccgntctttctcaatcgttcctnncttnttctncnttgngnccctgttnnattttnttnntntnccganctcnttacntccntcctngtaattntccctnctaatcgtntgcgcnntntcccttnattnntctttngngatncnttggnatctcnnttccctangtctatntgctntttgttccntanangcncntattntgtgncctctcncgnttgnggttctctgtttgtnnngcnncctgtcctcttaaatnttgtcctntgnttncanngnncntttntanggtctntngncccttnttnaccnactttgtnatntatccgtcnntcggtnagttcnncnnatgtcgtttttntngcnctantgtncctgcttctcntnntgnnnctcnnntcntcggtntcnctatgnngctatgttnnnttntccntntctttccattncngcgnnacccccttttntctactnttnatcttctnatnacctnttntnnnttcntnttagnnttntnncnatcntctngntgttttnctctcnnncccttctnntgngnc

SEQ ID NO: 5349 - DNA, 1421 bp, Homo sapiens
  misc_feature 1, 5, 16, 22, 60, 69, 74, 75, 76, 77, 79, 80, 88, 98, 107,110, 114, 117, 118, 120, 121, 122, 123, 131, 134, 136, 138,148, 151, 152, 155, 158, 162, 166, 168, 169, 175, 176, 179,180, 194, 197, 200, 202, 203, 204, 212, 213, 215, 220: n = A,T,C or G
  misc_feature 221, 223, 230, 231, 232, 234, 236, 237, 238, 240, 243, 246,256, 257, 258, 259, 260, 261, 263, 266, 267, 268, 269, 272,274, 275, 283, 287, 291, 293, 295, 298, 301, 305, 310, 312,313, 314, 316, 319, 324, 325, 329, 339, 342, 344, 347: n = A,T,C or G
  misc_feature 349, 354, 356, 357, 368, 370, 372, 379, 380, 389, 390, 394,398, 401, 407, 410, 411, 424, 426, 428, 429, 431, 435, 440,441, 442, 445, 451, 453, 455, 458, 466, 469, 475, 476, 483,487, 491, 494, 501, 507, 509, 512, 513, 518, 527, 530: n = A,T,C or G
  misc_feature 531, 532, 533, 534, 535, 536, 544, 545, 549, 553, 554, 558,559, 560, 562, 563, 566, 569, 570, 575, 587, 590, 592, 593,595, 597, 598, 600, 605, 607, 610, 611, 627, 631, 641, 644,654, 655, 656, 661, 677, 678, 679, 680, 696, 703, 714: n = A,T,C or G
  misc_feature 716, 721, 722, 726, 729, 732, 742, 743, 750, 753, 757, 758,770, 777, 778, 787, 795, 796, 801, 805, 811, 812, 816, 819,823, 827, 831, 833, 834, 835, 837, 845, 850, 853, 855, 864,869, 870, 871, 872, 873, 875, 877, 885, 886, 887, 898: n = A,T,C or G
  misc_feature 905, 909, 910, 914, 916, 918, 920, 925, 931, 932, 933, 936,937, 938, 939, 942, 944, 945, 947, 952, 953, 955, 957, 964,966, 975, 983, 989, 991, 993, 994, 998, 999, 1001, 1003,1011, 1018, 1022, 1033, 1038, 1040, 1042, 1045, 1052: n = A,T,C or G
nttgnattgggcggtngagggntgaagggcccctttttcttttttccttaaaatggcttngtggagcanctctnnnntnncctctganacatcagaanatatggggnctncggngcnncnnnntaccaccncantncnatgctagctnccnncgnccncaantctncnngacccnncgnncgcctcttttgttntcngantnnnaacctgtnnancccanntnactctannncntnnngnctntgngcagctggannnnnncnacnnnnaancnngcactagnactnccantnantgnatntctnagacncnnncnctnattcnnttgntctcaagtcnatncntcncnccccncnnccaaccacccncnancacctgnngcccccacnncatncccncancactancanntcctaaccctcancntnncncacncgacnnnctncacatncntntcngcctcctnccncacatnntcctacntttncatnccntcccaanaacttntnctnntcccnacaaacacngcnnnnnnncgctctcnntacncacnncctnnncnntantcnntcganttccccataatnctntnnancnngnttccncnctnnattccctctccctagnactnctctcctccntcnttatcaatcnnncccanccccatcatcccctcnnnncccctcacttccttcntcactcngacactctctntntatcnncacnacntanagctcatatnnccactcncantatnnatcccttcctcnctactcnntatatctcnacacttcnntctcncacntacctnngcgntcncttnctcncacnannntncatttctncactncantntcctattcntcttnnnnncnanatctcacnnnctcttctcgcncctgtcnacannttcncntncncactncctcgnnnatnnnnctncnntntctcnntntnactcatntntcatatacnctatctantatctntncnnctcnntntntctttccncactccntgcnacccctcatcnactcncncntanctcacanntcnctcacnctcancnnccncacctatatcactnccatntctctnctcacgtttacactactcacactcnacntnncatcactcntnnttcnncncntangtcncnnntactntatccactctntctcacatctcnnctacncanacntccncacnatcactcntctacncnctntanctnattaccnntcactctcccctcannaccctcntccgctctnctcatatctccnnngnctcatnttctacatntttcactntatangctcctctcactnnnnnccncactatacgtatatcgaanacaacgtatntnaaacccnactnntatctanactctctccnnctntcccacattntaccttcct

SEQ ID NO: 5350 - DNA, 952 bp, Homo sapiens
  misc_feature 1, 15, 18, 19, 22, 41, 43, 45, 51, 52, 62, 69, 72, 73, 85,86, 93, 96, 106, 107, 110, 113, 122, 123, 124, 125, 131,133, 141, 144, 152, 155, 156, 159, 162, 163, 168, 181, 185,193, 198, 202, 206, 210, 214, 217, 230, 246, 253, 254: n = A,T,C or G
  misc_feature 256, 257, 260, 261, 262, 264, 266, 270, 276, 279, 282, 289,292, 297, 302, 308, 319, 321, 359, 360, 378, 385, 393, 394,396, 398, 403, 405, 409, 416, 417, 419, 422, 444, 450, 454,458, 470, 476, 477, 480, 482, 484, 487, 488, 492, 495: n = A,T,C or G
  misc_feature 509, 517, 518, 519, 521, 526, 532, 533, 539, 542, 545, 554,555, 556, 561, 565, 574, 575, 576, 588, 592, 604, 627, 630,633, 648, 649, 658, 659, 661, 669, 670, 675, 680, 690, 694,701, 709, 711, 716, 719, 722, 726, 735, 738, 739, 742: n = A,T,C or G
  misc_feature 753, 758, 761, 781, 782, 783, 787, 796, 798, 799, 825, 828,829, 831, 835, 837, 843, 847, 849, 853, 863, 865, 866, 869,874, 876, 885, 889, 899, 901, 908, 910, 912, 919, 920, 921,922, 924, 926, 934, 935, 937, 938, 941: n = A,T,C or G
ncttttttctatagngcnnttnttggggtctttctttccananancgtgtnnctcctcctcncctaaanagnnaggctgtggagnncagaccnccnatatgacacnntanatncttaataannnntgattntntgccagangcnctctgcantgnnacngtnnggggngggtgaacacacnctcntgcacggntatcnagancagncttnactnatnctggactacaatnatgtgagataacacanacattanntnnaannnananactntattcnttnttnactagancgntcctncgatnggaatnccctcctcctnangaaactagcatggatgttcacattcaagtgtggggatnnttatcaatttgctatttnataaaanataccaanntntnccctntncaanataattnncntcngatatatggtccatccatttantgaaangctnttcnccctttcaaaangatacnnatnangncanncccngtngccttacttggctnattaaacnnnanatcantcttgnncagatnggngtnttccaccannnttttncccnaagccttannntacctaacctcnctgntcctccaagctnctaccctttccaaccctcacgcnctntcncaaaacgtccctttnnctactctcnntntttcgaanntcccnaattntaccccattncccnttccccnctagcccntnaattntanccntttncctttatcntcnnctncacttttcgtnctccnctnccctcataccactttttctnnnatcnccaccccgncnntcactactcatcagccccctcaactnctnncncatnanattttnaccncntcantccctttctntnnccnctctntnttttctcgnacancctccactcncntctatcngncnttttccnnnncntntctccganncnnttnctcctcccact

SEQ ID NO: 5351 - DNA, 789 bp, Homo sapiens
  misc_feature 1, 18, 23, 51, 53, 56, 61, 64, 71, 176, 182, 194, 220, 232,234, 257, 272, 279, 291, 326, 329, 335, 358, 359, 370, 376,379, 380, 382, 388, 401, 404, 420, 453, 455, 459, 479, 490,512, 521, 529, 550, 565, 566, 569, 572, 575, 581, 588: n = A,T,C or G
  misc_feature 590, 591, 639, 640, 646, 648, 659, 677, 688, 693, 694, 709,714, 720, 721, 723, 725, 726, 727, 731, 736, 744, 745, 750,753, 754, 761, 766, 770, 771, 773, 782, 784, 785, 787, 788: n = A,T,C or G
nagttttttttggtgggnttttncaattccctccttccagccaggatctcntnctntcctnaanaaaaggntgtggcgaattcggcacgaggtgagccccacaggaataaaaaacactgggaaggggtaaccccctcacccccgggagtggcccagggggagagaggctacctgangggaangaagcacaaaanggacccgctgcagactcagggcaaanggaatgccatcngngctgggacctgtgagcactacangaggaaacgcaagcntggtggnactggttccagncacacaggcaaagggcaaaagggttggacactaanccncaaagntacttgggttcctccttcttctnntttgccttttnctgctnctnntncatganctccaagtccctntgnttgcgggcggcagcanaaagcccgtcatttcggcgctttcccttaaccnantcgntctgctttttcatattcttntggcggtcaanctcacgctggttaccgcggttnatggctacngcagcggntccaacctgctccgttacgtnccctttgttctgtcnnacnttncangtcccnccccttntnncaacgtacccacagtccttccttttctccccgccccttcgcgccccgnnagcccngntccccatttgnacaataaaaaagcacctntgattccacgncttcnngccttgaatcccctngtctnttaaanngncnnnaagntcccncaatcctnnaaccnccnncatctgntgaancccnngncctttcccntnngnnt

SEQ ID NO: 5352 - DNA, 1454 bp, Homo sapiens
  misc_feature 8, 9, 15, 16, 17, 23, 28, 31, 45, 46, 52, 74, 91, 98, 99,107, 109, 122, 127, 129, 130, 133, 139, 143, 148, 149, 151,153, 155, 156, 158, 166, 169, 179, 180, 185, 187, 191, 197,198, 199, 203, 204, 205, 214, 215, 220, 221, 228, 232: n = A,T,C or G
  misc_feature 236, 239, 243, 247, 250, 251, 252, 256, 258, 272, 275, 277,279, 280, 286, 287, 288, 289, 309, 313, 317, 322, 324, 326,327, 332, 342, 343, 346, 350, 357, 367, 371, 375, 381, 383,390, 393, 397, 404, 407, 409, 418, 421, 425, 426, 428: n = A,T,C or G
  misc_feature 431, 434, 446, 447, 448, 452, 454, 457, 463, 478, 484, 488,489, 496, 497, 507, 522, 524, 527, 533, 537, 543, 544, 566,569, 572, 573, 574, 577, 580, 591, 601, 602, 606, 607, 611,620, 627, 628, 629, 630, 636, 638, 645, 648, 653, 657: n = A,T,C or G
  misc_feature 658, 664, 667, 687, 694, 699, 705, 707, 712, 715, 716, 724,738, 740, 741, 743, 754, 759, 763, 765, 773, 775, 782, 801,802, 805, 809, 813, 818, 819, 821, 825, 826, 832, 835, 838,842, 844, 845, 851, 862, 864, 871, 874, 876, 878, 882: n = A,T,C or G
  misc_feature 884, 888, 896, 897, 903, 908, 915, 916, 918, 926, 932, 933,938, 950, 951, 954, 964, 990, 991, 993, 995, 999, 1003,1006, 1007, 1008, 1009, 1019, 1022, 1024, 1035, 1038, 1043,1053, 1057, 1068, 1071, 1072, 1073, 1074, 1082, 1095, 1096: n = A,T,C or G
  misc_feature 1098, 1100, 1101, 1126, 1129, 1132, 1136, 1139, 1144, 1147,1149, 1151, 1153, 1155, 1165, 1188, 1189, 1195, 1196, 1200,1213, 1214, 1215, 1217, 1222, 1229, 1234, 1236, 1249, 1258,1262, 1267, 1275, 1278, 1282, 1283, 1294, 1301, 1309: n = A,T,C or G
aggggggnngggggnnntttttnggggnccncccccccttttgtnntggggnaaaaaaaacccccccttttttnggggggggaaaaaaaanggggccnnccgggttngnggggaaagggggntggcngnnggngggggntcgnggggnngngngnngnggtgttgnggngggggggggnngtgtngnggtnggtggnnnaggnnngggaggtgnnggggnngggaccncggngggnggngagngggnggnnntgtngngtggtttttttttncgngngnngggggnnnnaggggagggggacggggggngtgnggtnggcgngntnngtggngggggggggnngtntggntggggcntgggtcgtgngggngcgngtgggngncggcggngantggngttggcngtngngggggtgcncgncgcnngnggnagnggggcgtgggcnnnggcngncgngcacgnggggggcgtggggcngggggncggnngtggtgnngggggcgagngggtggggggggggngnagngggagnaggngggggnnggttgagggagaggggtggggnggnggnnnttntgngggggatgttnggggggcganngcgnngggngggggtggntgtgggnnnngggagngngagtggnggntgggnggtnngggtgnggnggggggtggtgtggtgagcnggcgagnggtgngtgtgngnggggnggnngggggtgngggctgcgtgacgntnngngagagggtggngaggngggngngagtggtnangtgtggngacgtggtgtgtgggtgtnngtntggnttcncgagnngngggnngtgagncgngcntggngnntgtgtngtggagcgtcngngcgtggnggngngnggcngncggnggtgggannatgggngacgnggtggtnngngggtgtgngcgcgnnggtgncggggacgtggnngangggtgagcgncggggggaagggtggtgagttgtganngngngganatgngannnngtgtggtgtngtngngaatgggcgancgnatggngtgcggcgcngtgnggggcgtgtgnggnnnntagggtgnccgaggatggggnngngnnggtgcgggggtgtgggtgtggtggnagngcngacngcnggtgnttngngngngngggctggtcncgtgtggggggacgcggaggtgnngatgcnntgtntgcgtggcggggnnngngcggngcgaggnggcgnanagtggggggtggntggttgtgngggnggtgngggggggnggngggnntgtgcgggggngcggggngcggcgtnggtggtcgggggggggggatggggncgngtggcggggngnnnnggagtgncgacgnngggggcgggnggangggggtnggggtgtgngtgggtgtgggcgcgngcngngggngnggagcgnngggngtcngggnggangggtccg

SEQ ID NO: 5353 - DNA, 895 bp, Homo sapiens
  misc_feature 14, 17, 19, 23, 24, 28, 29, 31, 35, 37, 39, 51, 72, 74, 77,84, 85, 87, 92, 95, 105, 107, 109, 119, 127, 128, 133, 139,140, 150, 151, 153, 158, 160, 166, 169, 171, 172, 178, 180,185, 189, 197, 199, 202, 203, 207, 210, 233, 247, 251: n = A,T,C or G
  misc_feature 255, 261, 276, 278, 301, 322, 327, 330, 336, 337, 345, 358,365, 366, 374, 379, 383, 393, 395, 400, 404, 412, 421, 428,439, 442, 460, 466, 482, 483, 496, 506, 510, 515, 521, 524,528, 540, 552, 562, 572, 575, 581, 596, 599, 603, 605: n = A,T,C or G
  misc_feature 607, 609, 616, 621, 622, 624, 626, 629, 630, 633, 634, 640,641, 643, 644, 645, 648, 655, 657, 659, 661, 662, 667, 668,671, 674, 678, 682, 687, 694, 697, 700, 705, 709, 711, 720,722, 729, 730, 731, 737, 745, 752, 753, 754, 756, 757: n = A,T,C or G
  misc_feature 770, 773, 777, 802, 804, 807, 810, 811, 817, 823, 829, 830,831, 832, 837, 840, 850, 855, 856, 857, 859, 866, 867, 873,874, 875, 887, 888, 890, 892: n = A,T,C or G
tttctaattatcanggngntcgnnactnncnctanananataggccttggngaattcggcacgagaacttcntnaantggtgtnntncaccnttngcaaacaggntntnaagatgtgcnctttgggnntgctntttggnnacatacatgnncnttacngntatctntangnnaactcnanaactntctngaatttgncnacnntgcnatntattgtgtgaagcgctgcactanctcacgtttaccantaanggtnccattnccccatttcattatntnccacttataaggctcaaaagaanttgtccccattccggcccaanacacnctntttagnntgaatggntgaattggcaaancatgaanntcaaaccnattanccgnaactgggcancnatccncaanggccttcntacctggancttgttnaaggtgggaanccnttccttaggttccaaaanttgtancattttacccttggcnnggtcattaatttnattcataacnaagnggtcnattttnttncttnatgaccccatcngtgaaaaaattncctaatccantaaccccaanccntgctcnttaattccaagtccntcngccntnanangaattcnccttnncnanaannctnngatctnntnnnttncaagcangnancnnggccnngcnttngggngaanaaatncccttgnttnaancacanttcnancccaaggtntncaaaaannntcctgnaaatcttntttggcnnnannggtcttttacccntancccnttcccaattgggaatcacttgcaantnganccnngtgccnttagantttggnnnnaaatnggnctaaacctcnttggnnntnttctctnntccgcnnnggacaatccttnncnanacc

SEQ ID NO: 5354 - DNA, 779 bp, Homo sapiens
  misc_feature 5, 6, 7, 8, 9, 10, 11, 20, 32, 37, 40, 43, 45, 67, 69, 70,75, 93, 94, 95, 101, 102, 109, 111, 116, 117, 118, 124,128, 129, 140, 143, 162, 176, 184, 185, 187, 188, 195, 197,199, 205, 209, 210, 214, 215, 216, 219, 221, 226, 228, 229: n = A,T,C or G
  misc_feature 232, 235, 236, 242, 245, 251, 254, 255, 256, 264, 266, 267,271, 275, 279, 284, 292, 299, 308, 311, 328, 339, 342, 346,349, 352, 355, 356, 357, 358, 362, 363, 369, 371, 374, 376,384, 387, 388, 390, 394, 395, 397, 400, 401, 403, 406: n = A,T,C or G
  misc_feature 407, 409, 415, 437, 470, 486, 523, 528, 533, 534, 539, 541,547, 561, 570, 572, 573, 578, 583, 593, 597, 604, 605, 608,610, 620, 623, 625, 629, 631, 641, 645, 646, 650, 659, 670,672, 673, 680, 685, 687, 689, 693, 704, 710, 711, 720: n = A,T,C or G
  misc_feature 721, 725, 732, 743, 752, 762, 769, 772, 776, 777, 778, 779: n = A,T,C or G
tggtnnnnnnnaggttgggnttttcaattttntctanacnccngnctctcgttctttccgcaacaancnngcggntcgaattcggcacgaggnnncccgcnngatcagntnttctnnnactcantaannacttctgggtnacnggatcaaattgaatctgcntaggctgctgtatntggagganncnngttcgcngnantaaaanctgnncatnnngangnctgancnnttnccnnaaaggntangtccantgnnnctgatcancnncaantacncagncaganatccaaanaccagtnatatatgtnccnttgctcaggggtgtggnccccaatttcnatngagntcnacngcnnnnctcnngaactncntcncnacttcttncanntngtcnngnaanncnttnntncatctnagctggcacatgagagtacccntctgctatgccagaagtatgacaccaccaggtnatagttcctacgaccnttaccactgtgactgattgagtggtgtgagaatgagngactnccatnngattncncatttnccatccatctaggngccactctntnngcatngattnctccctggcnaccnaactctnngantnggatgacttntcntnagantngattcttaanatcnngaanttgatgatnctacttatacngnnattttgnccctncngnaaangcattgaagtnggttanntaaaatagnnaacnaccccanttgccaatttnccaaaaccnccaaagcctnaccccgngangggnnnn

SEQ ID NO: 5355 - DNA, 10 bp, Homo sapiens
  misc_feature 1, 2, 3, 4, 5, 6, 7, 8, 9, 10: n = A,T,C or G
nnnnnnnnnn

SEQ ID NO: 5356 - DNA, 755 bp, Homo sapiens; identical to SEQ ID NO: 417
  misc_feature 1, 4, 13, 24, 27, 38, 50, 66, 111, 171, 181, 463, 498, 506,519, 550, 575, 576, 586, 625, 636, 667, 676, 679, 689, 699,717, 727, 745, 747, 751: n = A,T,C or G

SEQ ID NO: 5357 - DNA, 1166 bp, Homo sapiens
  misc_feature 5, 15, 16, 17, 34, 97, 106, 117, 125, 139, 144, 157, 163,165, 168, 176, 191, 194, 196, 200, 201, 204, 207, 208, 215,218, 221, 222, 223, 227, 230, 233, 239, 241, 248, 251, 262,267, 272, 273, 275, 277, 278, 292, 299, 307, 313, 314: n = A,T,C or G
  misc_feature 320, 322, 323, 325, 330, 335, 338, 344, 347, 356, 357, 359,366, 368, 369, 370, 377, 379, 381, 383, 391, 396, 397, 401,402, 406, 415, 416, 422, 425, 426, 427, 429, 431, 432, 435,437, 438, 440, 442, 443, 445, 448, 454, 459, 460, 461: n = A,T,C or G
  misc_feature 463, 466, 479, 486, 492, 501, 503, 510, 515, 522, 525, 526,529, 534, 543, 547, 548, 550, 551, 559, 560, 561, 563, 564,566, 567, 570, 571, 573, 574, 580, 582, 588, 593, 595, 600,602, 607, 613, 615, 620, 621, 624, 626, 627, 628, 633: n = A,T,C or G
  misc_feature 635, 641, 643, 645, 649, 657, 658, 667, 669, 672, 674, 675,678, 684, 686, 691, 692, 698, 699, 700, 701, 710, 717, 733,734, 741, 742, 744, 757, 762, 764, 776, 778, 790, 793, 802,804, 808, 810, 811, 814, 821, 822, 826, 828, 831, 842: n = A,T,C or G
  misc_feature 846, 851, 854, 860, 862, 868, 870, 871, 873, 874, 876, 879,884, 885, 887, 888, 893, 895, 896, 901, 906, 910, 912, 916,924, 925, 929, 932, 937, 947, 950, 952, 954, 958, 960, 961,963, 966, 967, 970, 974, 976, 980, 986, 993, 995, 997: n = A,T,C or G
  misc_feature 1001, 1003, 1009, 1011, 1013, 1016, 1017, 1019, 1026, 1029,1031, 1034, 1035, 1041, 1043, 1047, 1048, 1054, 1057, 1058,1059, 1064, 1067, 1070, 1075, 1076, 1081, 1082, 1083, 1084,1086, 1096, 1097, 1101, 1102, 1114, 1115, 1116, 1117: n = A,T,C or G
ggagnttaccccttnnngaaacccctttatacangctacttgttctttttgcaggatcccatcgattcgaattcggcacgaggctacttgggaggcnagagttttngagaatggccngaacccangaggccgctggatncgggngaagggctgttgnggatantntangatcttgntgaatcccactccangananctannttnatnngaccttntcntannnttantgnttncatatntnactcaanatngcaattggatntattnatgcnncnanntcacttatcacctngatcatntggaaacnaataannatctcnannangatcngtcanttntaatantgnggatcaacnntncctctcntnnngggaatntnancntggtactnacccnntttnntaanaccatcttnnccattnacnnncnanngcnannanannanatntaattnaattnnntntanccaagatccatcnacgttangaattnttccccatngnggaattngcaanaacaatntcnnganctaanaacaattcngccnntnnacaaatcnnntnnanncannanncgccantntaatgntcaantncaaancngcccngcacgnanagatnnatnannnctctnantctctntnanccancccatacnnattcgatancnatnannacntggacntnctctnnatcgtnnnnacgtcatcnctaatancctctcgtcatacgcnntatgacnngncctctaacgcacnaatangngcgatatgatcnanatattaagtctntantagtcgcancnctanannacnatggcgnnatcnanttnaatgtatgcgnccangtaanctncgcgtncncatagntnnanncnctnctccnnannatgancnngtaanatgtntacngnactntctcacgnnattntcntatanagccgcgcanatncnancaantnnantanntcntatnangatnattacntcgcttntncnaccncnaatacncngnatnnanaacatcngcntntgnngtctgngntgannaactcncannnacatntcnatnacacnncgtannnnanctaccagctnntacnntaatgatctcannnnncncacatnanatntatcatntgacntnctaccattnacnnagngaccg

SEQ ID NO: 5358 - DNA, 1185 bp, Homo sapiens
  misc_feature 3, 4, 5, 6, 7, 14, 15, 16, 17, 18, 19, 20, 21, 22, 23, 25,30, 32, 33, 34, 36, 38, 41, 42, 43, 44, 51, 64, 87, 92,105, 106, 114, 115, 116, 117, 118, 119, 120, 121, 122, 123,124, 125, 132, 133, 134, 135, 136, 137, 138, 139, 140, 141: n = A,T,C or G
  misc_feature 142, 149, 155, 156, 157, 158, 159, 160, 161, 162, 163, 164,166, 167, 168, 169, 170, 171, 172, 173, 176, 177, 189, 190,191, 192, 193, 195, 196, 204, 205, 206, 207, 208, 209, 210,216, 217, 218, 219, 220, 221, 232, 233, 236, 237, 238: n = A,T,C or G
  misc_feature 239, 240, 241, 244, 245, 252, 253, 256, 257, 258, 260, 261,278, 279, 280, 283, 285, 286, 295, 296, 298, 299, 300, 301,305, 306, 307, 314, 316, 318, 322, 323, 324, 325, 326, 327,328, 329, 340, 341, 342, 343, 344, 349, 350, 351, 352: n = A,T,C or G
  misc_feature 353, 354, 355, 356, 357, 358, 359, 360, 361, 362, 363, 372,373, 374, 375, 376, 378, 379, 380, 381, 382, 384, 386, 387,388, 389, 390, 391, 392, 393, 394, 395, 400, 401, 402, 403,404, 405, 406, 407, 411, 413, 414, 415, 416, 419, 420: n = A,T,C or G
  misc_feature 421, 424, 427, 428, 429, 431, 432, 433, 437, 438, 439, 440,441, 442, 443, 444, 445, 446, 447, 448, 449, 450, 452, 453,456, 457, 459, 461, 462, 466, 467, 468, 469, 470, 471, 478,479, 480, 481, 485, 489, 492, 493, 499, 500, 504, 506: n = A,T,C or G
  misc_feature 507, 508, 511, 512, 513, 514, 515, 516, 517, 518, 519, 522,523, 524, 526, 527, 540, 547, 556, 563, 564, 565, 569, 573,583, 584, 585, 586, 587, 588, 593, 598, 599, 602, 603, 604,605, 606, 609, 610, 614, 621, 622, 626, 635, 636, 644: n = A,T,C or G
ggnnnnnggggggnnnnnnnnnngnggggngnnngngnggnnnnggttttnggggggggggctnttggttgggaaaaaaaccccccnttttngggggaaaaaaanntgggcccnnnnnnnnnnnnggggggnnnnnnnnnnnggggggngggggnnnnnnnnnngnnnnnnnnccnntggggggggggnnnnnanngggggggnnnnnnncccccnnnnnnggggggggggnnccnnnnnnaannggggggnnccnnncnntttttttttttgggggnnnccnannggggggggnntnnnncccnnnggggganancntttnnnnnnnnggggggggggnnnnnggggnnnnnnnnnnnnnnnggggggggnnnnngnnnnngntnnnnnnnnnnggggnnnnnnnngggngnnnnccnnnttntgnnnannncccnnnnnnnnnnnnnngnntgnntngnnaaannnnnntgggggnnnngggnaacnttnngggggnngggngnnnaannnnnnnnnttnnntnnaaaaagggggggntaggctnggggggggnttaaaannngggngggngggggggggnnnnnntgggncgggnnaannnnnccnntttnggggggnngggnggagggggnngggggggnnntnangggggggggnngnnnnnngnngggggnnnggggggggnnngnngnnngnngggggnaaacggggggggggggggggncgggnnnnnggnnnngggggggggggggngggnannggttgggaccggngggggggggnggngnggggccgggnnnggacnnnggntnnaggngggggcngggnnnggggncngtttgnnanaaaaaaannnaaangtgggggcntntgggacnntgggggggggggggnttncggggggggncccggggcnngggggnnngggggnncnnntggggngggggggntnggggggnnanancgnnngnntngggnaaggggnnggggggggnaaaaaaaanggggggnnngnnnnnnggggggggggaaaannnnggggggggangggggnnnnnggggggggnnnannnnnggggggnnnnncccnnnnnnnnnnggggngggggggnnngnnnnnnnncnngggggnnnnnnnnnngnnnnngnnnnnnnngggggggggnnnnnnnnnttttnngn

SEQ ID NO: 5359 - DNA, 1142 bp, Homo sapiens
  misc_feature 3, 6, 14, 20, 25, 28, 31, 32, 37, 42, 53, 67, 75, 96, 97,106, 107, 110, 111, 120, 127, 133, 143, 144, 145, 146, 154,156, 158, 166, 167, 168, 169, 174, 177, 178, 179, 180, 184,185, 203, 205, 220, 222, 234, 236, 250, 262, 275, 276: n = A,T,C or G
  misc_feature 301, 302, 303, 304, 305, 308, 317, 332, 341, 358, 359, 361,362, 363, 364, 369, 370, 373, 380, 398, 402, 403, 404, 406,419, 435, 438, 448, 451, 452, 473, 474, 476, 480, 499, 513,528, 529, 539, 544, 548, 550, 569, 575, 579, 585, 597: n = A,T,C or G
  misc_feature 599, 601, 603, 605, 606, 619, 624, 626, 629, 631, 634, 637,638, 640, 641, 647, 653, 666, 672, 674, 680, 690, 691, 695,698, 702, 704, 705, 710, 711, 712, 724, 746, 748, 752, 757,758, 761, 762, 763, 765, 766, 774, 775, 776, 791, 793: n = A,T,C or G
  misc_feature 801, 810, 822, 839, 845, 862, 871, 876, 879, 883, 886, 911,914, 916, 918, 927, 936, 940, 941, 959, 967, 973, 974, 975,979, 980, 982, 990, 991, 995, 999, 1000, 1003, 1024, 1025,1031, 1036, 1037, 1052, 1053, 1056, 1060, 1061, 1063: n = A,T,C or G
  misc_feature 1066, 1069, 1070, 1073, 1082, 1085, 1086, 1087, 1090, 1092,1095, 1097, 1104, 1105, 1106, 1118, 1122, 1134: n = A,T,C or G
ccncanggggcccnaacaanagggnccnccnncttcntgggncagggggaaancccctttttggccnaaaaaacngccctttggggggggaaaggnngggccgggnnccnnggggcccanggggggnccccanaaaaaaaacnnnncccccccncntncccccctnnnnccccnccnnnnaaannaaaaaagggggaacccancnaaggggggggccaanangggggggaaaantntaaaagggggggcncccccaaaaccngggggaaaaaaanncccccaaggggggacccaaaaaaannnnnccnaaacccccntggggaacccaatanccccggggnaaaaccccggggaaaanngnnnnaaaannccngggcccnaaaaagggggcccccccnaaannntnccccacaaaaatnaaaaaggggccacccnttncccgggaggnaanntccaaggggggggacaagggnnantttngccggggggaaaaagggantccacccccccccnaggaaatcaaggggnngcggggaaanagganggcntnacccaaaacccccgggggnacgggngccngccaangaaaaagagaangnantntnnaaacccggggganaaagngnaancncgncgnnannggaagngggggngccccccccaaancaaaangncccccnagggggcccnnaacnggnaacncnnggggnnnaaaggggggccnaaaaggccccggggccccaaananccanacccnnagnnngnnaaacaaannnccaaacccctgggcntntggggggnggcaaaacnaaccccccggangggggaaaaaaaaatangggggnaaaaaggaaaccaaaanctggggccngggcnggnaaanggncgtaaccccccgggaaaaccccaancangncngggggaaanaacaaggcnatgnngcccaccggcggccccangccccaancacccnnntagnntnctcccccnngaanaaannacncgcatcccgggaacccaaaanngggaanagccnncgggggccaaggggnncancggnnangcnccnnccncccgggggncannnccnanacntnccgggcnnnaaccccccaaangaanccggggaaaaanaagggccg

SEQ ID NO: 5360 - DNA, 741 bp, Homo sapiens
  misc_feature 7, 12, 17, 18, 19, 24, 26, 30, 32, 34, 47, 48, 63, 64, 67,68, 69, 70, 78, 79, 83, 84, 85, 86, 92, 101, 107, 110, 114,118, 122, 123, 124, 131, 136, 138, 147, 154, 165, 167, 173,186, 218, 222, 224, 227, 229, 233, 239, 243, 248, 249: n = A,T,C or G
  misc_feature 250, 251, 252, 262, 290, 307, 314, 318, 326, 327, 328, 329,337, 349, 354, 362, 363, 370, 375, 378, 392, 395, 403, 405,407, 410, 413, 419, 421, 427, 428, 432, 434, 438, 453, 459,462, 475, 478, 489, 494, 495, 497, 501, 516, 525, 527: n = A,T,C or G
  misc_feature 531, 548, 549, 560, 561, 563, 581, 583, 584, 588, 598, 605,608, 611, 612, 624, 640, 641, 642, 643, 646, 651, 661, 666,668, 671, 681, 685, 686, 694, 699, 701, 704, 708, 717, 720,725, 726, 728, 736, 737: n = A,T,C or G
cacaccncaaangcacnnnaaacnancacnangnccgaaacgacccnnaacgcgcgcgccacnncannnngacgcggnngaannnnccgcgnaaaagacgnagcganaancaanacanagcnnncacaaancaccncncaccccccnccgagtntggaaaccccnangcaaanacccaccccacgnacggcgagggaaacccaaccggggccgcaatntcgncnacncngggnagatancacnaaagnnnnnccaccacttnaattaaacccagcaaaaacaccacacanggacacaggggggggcncaggganggcnacccgcannnnacccacanacaaaccggagncgcgncgccacannacacggngcacnaancaacaccccaaganacnaaagcccncnanggnaanagcccnanaacgannccancnccanacaaccgaacacacnaacgcnacngaacaaaaaccangcnacagagcccancgcanngnaagnaaagcccacacaaanagcacgccngnaacnagaaagcccaacagacnnacaacagaacnnanaagacaaaccccacggcncnncaanagcccacganaccacgnaancgnnacccccaagcanaaagcgagaggaaccnnnncanaaagncgcgaccgcngcggngnganacaaggaaancaannaaaaaaangagancnccncacnagcccaaanaancccgnnanaaccgccnncccg

SEQ ID NO: 5361 - DNA, 753 bp, Homo sapiens
  misc_feature 5, 9, 18, 23, 37, 48, 60, 74, 76, 77, 88, 89, 100, 104, 123,129, 141, 142, 143, 148, 160, 163, 167, 206, 207, 220, 235,289, 295, 330, 336, 338, 354, 381, 382, 393, 399, 405, 451,458, 469, 490, 493, 494, 505, 506, 507, 521, 532: n = A,T,C or G
  misc_feature 534, 535, 541, 543, 552, 554, 569, 572, 588, 589, 596, 597,602, 603, 606, 613, 614, 622, 627, 634, 646, 655, 656, 671,684, 689, 696, 714, 721, 722, 725, 727, 732, 736, 744: n = A,T,C or G
ggcanttgntcttttgcngatcnctcgttcgaggacnctcgagagttntcatgtactagnatggtactggctgncnngcgaatatctnngaccaattatnaaanaaatatgtgtagagtaganataaantggtaactagtnnnttatnagaggggaagtnggntggntttataaattaaatgaacatttatgcggtcggttatttnnacgtaaaaatagntgttatattctaggnaacagaaatttagaaacctatttttctgtagaagaaaggtgtcgctatctgctnttgatntctcagatatttgcttctccttagaatgctatgancagatntntattagaatgaagttntctaaaggctttgattggcatgagctnnattacttattngcttangttaangattagcccaatagacatattatctttatggaccattgcaaatttntctaatntctaaccattnttaaccttttatatatgaatnacnnaggaaaccatnnnattattataaagtntattcctggcncnntggaangncactcaatnangtatttgttaattgnagntaaatgatccccagtnngagtagnnacctnncangtttccnnggggaatnctttntctaccnaccgtggggggnttacctctnnaaagattgttttttnggttcccaacttnaccgnggaaaantaccttgggaaacctggnccccctnnagnanaatcntcgntttgggcnccactgatc

SEQ ID NO: 5362 - DNA, 972 bp, Homo sapiens
  misc_feature 1, 2, 3, 4, 9, 11, 16, 20, 22, 23, 24, 28, 29, 30, 33, 38,40, 41, 42, 47, 48, 49, 54, 56, 58, 59, 62, 64, 67, 69,71, 74, 75, 77, 88, 90, 97, 100, 107, 108, 112, 115, 119,120, 122, 126, 135, 136, 140, 143, 146, 147, 154, 157, 162: n = A,T,C or G
  misc_feature 173, 180, 187, 188, 191, 195, 199, 201, 207, 213, 222, 226,237, 238, 243, 244, 249, 252, 259, 268, 269, 285, 300, 302,312, 313, 321, 330, 332, 335, 336, 338, 340, 343, 345, 364,367, 376, 377, 379, 384, 390, 393, 397, 398, 399, 403: n = A,T,C or G
  misc_feature 410, 423, 426, 432, 435, 439, 447, 448, 452, 454, 460, 467,468, 477, 480, 486, 488, 489, 491, 502, 506, 513, 514, 519,526, 530, 541, 544, 587, 595, 602, 606, 608, 619, 620, 629,646, 648, 656, 662, 666, 674, 680, 690, 691, 694, 698: n = A,T,C or G
  misc_feature 706, 708, 711, 722, 744, 750, 763, 765, 766, 770, 771, 776,778, 786, 787, 792, 808, 830, 837, 845, 849, 851, 859, 862,871, 873, 883, 899, 909, 917, 925, 932, 936, 941, 944, 955,957, 958, 960, 967, 970, 972: n = A,T,C or G
nnnnactananacatncaantnnntcannnacnctcanannnaacannnatacncncnncananatnananatnncntttcaccacananctcactnccntacacannctcnacnactnncnaagnggagggaanntagngantannagagganatngaaangcggcgcacantaatttntaaaggnnggntctntaantncttggntatcgnccctcatgnaggnacccatcgcanncactnngatcnccncacagangttacatanncactgttgcaccagcncagtaactaggtatntnacacctacannactcacangtgcacggntntanngncnacntntaactgctcttcatgcttncanggccctatnnangaaanccaganatnacannncttntactatnacttaccacacanagngaggcnttngctncctaaacnnaatntntatcanacaagcnntccatcaanatntctaantnnangggctaataangaancaagtcnncgtgntgtgtancctnttctccctcancanatacaatacaggagctgatatgcctgggctcaccctgcttaanaacaaggnctcaacnatcngnccatacccctnntattacccnagatgggaaacctctgnanaatgttgncactancctngactctantctctnatatactgcnnctntatngtcaatcncnatntaaaccataanggttcaatagcctataaaaagngcgccngaaattagtatgngnnattnnaggtnanaaactcanntaaangcattcaaatcttcangcctaccatgaccctatttctncccactntaaccaanatgntnactctcanatnggaggacancnccctgcaatnctctcacctccccatncctcaacatnccacccangaaaccanaatgtgntaancctcnttncaacaaaaatngnngnggtaagnaancn

SEQ ID NO: 5363 - DNA, 759 bp, Homo sapiens
  misc_feature 2, 5, 33, 34, 41, 59, 65, 429, 551, 554, 602, 605, 646, 697,703, 705, 733, 748, 758: n = A,T,C or G
tnagntttttttgtgggttttctttttactaanngctgggntatcgttctttccgcagnaacccntcgattcgaattcggcacgaggggaggagaggcgcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtacgtggctacaccactggctgccctcttgaacataaaggagaaaactcggctgcgggcacctnccaacgccaccttggaacatttctacctgaccagtggcaagcagcccaagcaggtggaagtagagcttttgtcccggcagagcgggctctctggccgccaggtagcgcgttggttccgtcgncgncgcaaccaggaccggcccagtctcctcaagaagttcccgagaagccanctngagattcacattttacctgattgcctttattgccggcatgncccgtcattgtggataaaccctggttctatgacatgaagaaagtttggganggatantnccatacacaacactattcctttcccagnatttggtactacttnatttaacttnt

SEQ ID NO: 5364 - DNA, 841 bp, Homo sapiens
  misc_feature 10, 11, 13, 15, 28, 29, 30, 31, 36, 45, 50, 51, 55, 59, 88,105, 114, 116, 120, 122, 123, 134, 135, 138, 144, 145, 146,147, 148, 149, 150, 153, 164, 165, 167, 182, 200, 202, 212,218, 223, 228, 233, 235, 238, 245, 248, 251, 256, 258: n = A,T,C or G
  misc_feature 263, 277, 278, 279, 280, 295, 298, 299, 301, 303, 313, 320,321, 323, 324, 360, 361, 374, 375, 386, 389, 393, 396, 405,407, 408, 429, 434, 439, 444, 455, 469, 472, 473, 482, 483,491, 494, 497, 498, 513, 518, 522, 528, 533, 544, 546: n = A,T,C or G
  misc_feature 548, 550, 565, 566, 568, 571, 575, 580, 581, 588, 611, 612,613, 630, 632, 636, 645, 656, 659, 670, 684, 687, 708, 735,742, 750, 761, 767, 768, 781, 784, 785, 794, 804, 805, 808,814, 832, 833: n = A,T,C or G
gtttttttgnncngnaaacccttggcannnncggancagcggacncggtnntcgnattnggccgagggcattgaaacctccgttcatnatttttcggagttaaanaggcagcantngcgngnntgtacacactnntanacaggnnnnnnnatngacttgacctnntngaatctctaaatcangttccatatggatcgaangnccattatgcnattcanatgcngcccnttctnanggnggtgggnccntcnacccntngtgcncgtgcagaactgannnngacggaccgcctcantcnncncnaacgtgcaanatgtatnnanncaggtgaaggggaacactaaccaagcattgaggtcnnaaaaacagggatnnggtatagtganctncccnganagcaaaagnanntctgctcaccatttcccaggnagctnagaanccgcngattcctgaantcagacacagaatnaannctaccccgnngcaggaanctntcnnttgaaaattttcctnacggngtcnttaccntcttnggcttggggantnantngggcaccaagtaaanntnttntgcncaccnntgggggnaccctttccatctgacccattcnnngctctgtaacttgacangntttnttttccgcnattgggaaagntgnaggggtgctanagccttaaaaatgnaanccccttttttttcttaaaaanaaaaaagtttggtccggcttttattcnattggtngggatggnggggggagganaaccanntaaaggttttttntcnngaatccccnggggagtggnnccncccgantttttttgggttcaaaannctttccct

SEQ ID NO: 5365 - DNA, 938 bp, Homo sapiens
  misc_feature 2, 3, 4, 6, 7, 8, 13, 14, 44, 63, 64, 66, 73, 79, 92, 116,122, 124, 135, 137, 139, 150, 151, 166, 167, 176, 177, 178,182, 183, 200, 202, 207, 208, 210, 216, 222, 224, 225, 227,231, 233, 236, 237, 243, 244, 247, 249, 251, 252, 255: n = A,T,C or G
  misc_feature 260, 264, 282, 290, 300, 302, 303, 318, 329, 340, 341, 344,360, 372, 376, 380, 383, 386, 389, 396, 404, 417, 435, 438,444, 445, 453, 478, 481, 497, 506, 508, 513, 516, 523, 526,528, 537, 548, 553, 561, 567, 568, 579, 582, 590, 591: n = A,T,C or G
  misc_feature 596, 605, 606, 609, 610, 615, 624, 640, 641, 642, 646, 648,661, 662, 663, 664, 673, 682, 684, 685, 687, 691, 692, 698,714, 715, 716, 719, 725, 727, 728, 730, 733, 736, 742, 743,744, 747, 748, 756, 760, 764, 765, 768, 770, 771, 775: n = A,T,C or G
  misc_feature 776, 777, 778, 789, 791, 796, 804, 813, 814, 818, 826, 828,830, 834, 854, 855, 860, 864, 868, 869, 878, 880, 881, 883,888, 889, 890, 897, 900, 906, 907, 908, 918, 919, 926: n = A,T,C or G
gnnncnnnttctnnaagggggggcagggggggtttccctttctnacagcgagtgaggacgtcnnantcgcccnaaacanaatagggcggggnaatgcaccaccagggacactcagncctccnancggcgggcctngngngaagaagccanngggctgggctgatgnnaatggtagnnnacanngatccctgggggcatcncngaccnnancatacnagtggnannancccntnatnnccttgnnaancntnntgnaggangcanttcactgctccaagaacnctggtgcnaacttgacanannggctccatgccctgnagcccgcatgnatttgccggtnncanacagagcacatccatnggggaaatgggnactnatcnatntgnctngaaaagnagatgccncaatcctgcacancccaccactccccatganacntctgcnnggatcttnagggaccccccgtaactggaaaacncgnggccctgtccccactntaatgcacnangcacnccngaggggnggncntctcactgngcccttgctgnccacnacgccctngaccgnncgccacctgangancgaaaccnnagccngcaaccccnngtnncccancaccggcancccatccccaagcaannncctncncccccccctttannnnccaaatcgntcccacctnanntnaccnntcggcnaaagtccaccgttccnnncanagggcntnncnccnganatggcnnnatnnaacacctngaantctnngancnnaacnnnncttccccaaananctttnagcccttngccaccccnncctngggggaancncncctncggctcaaagcctaccttgnnaattncggncaannaggcccccngnntnttccnnncatactngcntccccnnnggggcccatnnccgaccncaaaaggggcct

SEQ ID NO: 5366 - DNA, 1128 bp, Homo sapiens
  misc_feature 15, 21, 24, 39, 41, 48, 51, 56, 67, 74, 82, 84, 85, 92, 95,103, 109, 121, 123, 129, 133, 141, 146, 147, 148, 152, 156,158, 160, 162, 164, 165, 166, 168, 170, 171, 181, 186, 194,197, 199, 201, 205, 216, 218, 219, 225, 231, 235, 245: n = A,T,C or G
  misc_feature 247, 254, 256, 260, 267, 269, 271, 273, 274, 278, 281, 285,292, 293, 294, 297, 299, 300, 305, 308, 310, 312, 319, 323,325, 327, 334, 335, 336, 337, 346, 347, 352, 354, 356, 357,359, 368, 371, 374, 375, 379, 382, 387, 393, 394, 398: n = A,T,C or G
  misc_feature 404, 410, 414, 420, 423, 427, 429, 430, 433, 434, 440, 442,443, 452, 456, 458, 462, 464, 469, 470, 472, 483, 493, 494,498, 504, 507, 511, 515, 516, 518, 522, 537, 552, 555, 559,569, 571, 572, 573, 575, 576, 582, 589, 592, 596, 599: n = A,T,C or G
  misc_feature 604, 613, 619, 622, 630, 637, 647, 648, 649, 655, 657, 666,667, 670, 674, 675, 679, 680, 682, 686, 695, 698, 700, 702,706, 712, 719, 720, 722, 726, 730, 732, 734, 739, 740, 742,744, 745, 750, 756, 761, 764, 769, 770, 773, 778, 788: n = A,T,C or G
  misc_feature 796, 802, 808, 809, 820, 823, 827, 845, 854, 856, 860, 862,871, 873, 881, 883, 885, 886, 888, 889, 891, 895, 906, 909,917, 925, 927, 930, 932, 933, 947, 958, 959, 964, 969, 972,978, 980, 982, 983, 997, 999, 1012, 1013, 1015, 1019: n = A,T,C or G
  misc_feature 1027, 1028, 1029, 1039, 1044, 1051, 1069, 1075, 1077, 1079,1087, 1090, 1094, 1106, 1108, 1116, 1118, 1120, 1121: n = A,T,C or G
gctccacagagcggntttctnacngcaaccggacgccgngnaaccccnggngccgnaaaggaagggnggggcgnagggcgcncnncggccgnccngaacgggncacganacagtttttttncnaacacngacnccgaaaanatgcnnngagngctntncnantnnnancnnagagcgccanacgtngcacaaangcngncngccnagtggcacccntnncgacantccccnagtntggagacggncnaatgacnanaatnggacccngncnanngacnccncacncacaccnnnagngnngacangangngngcctaanaagnanangcccacnnnntgtgccacnntctangngnntncccaggagnccncanncganacnaaaangccctnngggnccaacnggtggnaccngccaanctngggnanncannaaggangnntcggtaaancctngnaggncngcagnnanacgtcacgcgnggcctcactnnacanccctancancgtnccanntngggntacactctccaaacnacatgagtctcctcnccnaaantctcgggggngnnncnnccccantcatacncancccncgnaaatnaatacaccncgctanatnccggcaanatctgcngcgacaagannnagaccncnctacgactnntanccannctannangggncaaaacggngcncncncagnaagacnccggcanntncaanacancncncattnnanannggctnactctnagaanacntcctnnaanctcanctcacccttnccttgctntcacgnggcatnnacactacattnagngggntcacactcttcaaaaggnctccctggncncccntngaaatgcancnactcttcncnanngnntntccnagcaaaccaanagntcaaaccnctaaccananctncnntcccctggcctggncccctttaaanntgganaccantcncctatngncnncggggaaaaacccncntagcccacaaaannangctnggtgaagnnnaatggaaagnctatnctcaagnaaatcccacctatttaanaataancngnccccgganccnaatntggccccttaantnccactccntngnnacccggc

SEQ ID NO: 5367 - DNA, 876 bp, Homo sapiens
  misc_feature 2, 8, 18, 19, 26, 35, 40, 42, 49, 52, 56, 58, 78, 90, 96,104, 108, 115, 116, 119, 120, 135, 136, 142, 145, 148, 159,170, 177, 178, 179, 182, 185, 189, 191, 195, 197, 211, 219,221, 224, 230, 231, 234, 235, 249, 259, 260, 271, 276: n = A,T,C or G
  misc_feature 284, 287, 290, 292, 296, 304, 314, 316, 325, 341, 346, 354,360, 365, 366, 367, 371, 376, 379, 384, 386, 388, 393, 395,397, 399, 405, 406, 409, 417, 421, 425, 431, 432, 434, 437,443, 449, 452, 453, 460, 468, 477, 478, 480, 486, 505: n = A,T,C or G
  misc_feature 506, 509, 510, 518, 526, 527, 529, 534, 535, 536, 546, 547,549, 551, 552, 557, 559, 561, 566, 568, 572, 577, 579, 584,589, 590, 600, 609, 611, 632, 637, 645, 649, 651, 652, 656,665, 694, 705, 713, 714, 722, 727, 729, 732, 746, 754: n = A,T,C or G
  misc_feature 763, 765, 768, 769, 777, 783, 786, 800, 803, 804, 817, 818,822, 823, 829, 830, 837, 845, 846, 849, 850, 852, 855, 860,865, 871: n = A,T,C or G
gnattatnggcctaaatnnttgaagnttggtgatnctgcntnggggatngtngttncnggcaagcccatgtgtgtacnaaagcttctccnactatncgccttgncggncaacaannttnnttgagataaaacaannactttncgnagngtgtcaaatanagctgcggacnagaatgnnnttncanctgncnatgncncctgcatatgctcnaaaagacncnganaggganntgnnttttctcctttgtnccgtgcctcnnacttttagtcnctggnggaagganccnacncnatantgctaaantgcattggcnanttgaaggtnaggtagcaaacgactncctanatgataanggtccngttannnaaancttcngtnggacncnanggtgnantnanggctcnnttnggccttancttnacgngctagnngnacntccganttattnggnncttcatntcaggggnttgctttanngngacagntagaccgaagattggaaanngannttggtggncccattgnncntactnnngttgttccgnnanannctggnangnttgantnggtnggacnantttgnacccnnttggttttgngaccaatcngngcaaacaatggcaaaaatccncttcnttttcttnaaananntaanaattcttanggttcctggggggcctccctctttctgcnccaacctttcnccaattannctttacgntgggntnctnttcaccaaaaaccnttgggganggtcccaancnccnnggggaggncaaaanaancccccattggcccnccnnacctattttgccnnggtnnacgaannattctancttttaannaanncnatnttttnatttnttttcngaacc

SEQ ID NO: 5368 - DNA, 806 bp, Homo sapiens; identical to SEQ ID NO: 689
  misc_feature 4, 22, 42, 78, 79, 83, 90, 97, 105, 106, 112, 113, 117, 121,122, 123, 124, 127, 130, 131, 134, 135, 136, 141, 143, 146,147, 150, 157, 158, 159, 163, 168, 170, 171, 179, 182, 184,192, 193, 195, 196, 202, 224, 228, 257, 258, 268: n = A,T,C or G
  misc_feature 271, 273, 276, 277, 279, 282, 294, 295, 309, 339, 343, 363,370, 371, 382, 398, 405, 406, 410, 411, 412, 416, 421, 424,430, 437, 442, 444, 445, 446, 448, 459, 480, 493, 497, 500,503, 518, 523, 524, 531, 542, 545, 549, 554, 556, 558: n = A,T,C or G
  misc_feature 559, 563, 564, 570, 571, 589, 590, 592, 599, 603, 604, 608,610, 612, 621, 630, 631, 633, 634, 637, 639, 645, 647, 651,653, 654, 673, 692, 706, 711, 723, 729, 730, 746, 749, 754,756, 758, 760, 761, 764, 766, 772, 783, 789, 794, 797: n = A,T,C or G
  misc_feature 798, 805: n = A,T,C or G

SEQ ID NO: 5369 - DNA, 760 bp, Homo sapiens; identical to SEQ ID NO: 687
  misc_feature 3, 4, 33, 484, 529, 576, 608, 661, 705, 715, 744, 753, 759: n = A,T,C or G

SEQ ID NO: 5370 - DNA, 1236 bp, Homo sapiens
  misc_feature 9, 16, 18, 19, 32, 35, 40, 42, 43, 46, 48, 59, 62, 65, 72,75, 86, 90, 95, 97, 98, 101, 104, 106, 110, 111, 112, 113,114, 115, 117, 119, 127, 128, 129, 130, 131, 132, 139, 140,141, 143, 153, 156, 164, 165, 171, 172, 174, 175, 177: n = A,T,C or G
  misc_feature 179, 186, 190, 191, 196, 199, 201, 205, 211, 222, 228, 229,234, 235, 236, 237, 240, 241, 248, 252, 257, 259, 261, 262,267, 269, 270, 271, 276, 278, 279, 284, 285, 287, 288, 291,293, 294, 297, 299, 302, 308, 313, 314, 318, 329, 334: n = A,T,C or G
  misc_feature 344, 345, 347, 348, 353, 357, 360, 373, 374, 379, 382, 387,390, 393, 399, 403, 408, 418, 420, 421, 423, 430, 435, 437,448, 451, 455, 456, 460, 469, 473, 475, 477, 479, 482, 488,495, 497, 498, 502, 505, 506, 507, 513, 514, 520, 522: n = A,T,C or G
  misc_feature 523, 525, 526, 532, 534, 535, 537, 539, 543, 544, 546, 553,555, 557, 560, 564, 566, 568, 569, 573, 577, 582, 585, 587,591, 593, 594, 596, 598, 599, 605, 608, 610, 614, 615, 617,623, 626, 631, 636, 638, 646, 648, 658, 659, 663, 664: n = A,T,C or G
  misc_feature 666, 673, 674, 687, 691, 694, 698, 707, 712, 717, 720, 725,727, 728, 732, 733, 734, 737, 740, 743, 744, 755, 758, 765,776, 777, 782, 783, 785, 786, 787, 788, 798, 801, 802, 803,804, 806, 809, 816, 819, 820, 825, 829, 830, 833, 838: n = A,T,C or G
  misc_feature 842, 844, 846, 851, 853, 855, 860, 861, 865, 867, 868, 871,878, 879, 881, 887, 889, 890, 891, 895, 900, 901, 903, 905,909, 910, 911, 916, 922, 924, 926, 928, 930, 931, 934, 936,939, 941, 942, 943, 954, 957, 958, 959, 960, 963, 965: n = A,T,C or G
tttgttggngtttggntnngggtgggggcttnttnttaangnntgntntaaatcggtgnganagnccctaanatngaatagggttngggnccatncnnttntcntntacnnnnnncncntatgcggnnnnnngcctcannngnacttttttanatnattttttnncctcgnnanngntntactcancgtnntgttntgntnctantccaanatacatggatntgcccnntactnnnnacnntacaggngctngcccngncnngttcnannnattancnnaccanntnntcntnnttncnganagagtnctgcnnttcntgaaatgttancgccnctcgaacacnntnntatcnctanctngttctcttgtctnntcctntanatgantcngancttttnaatngagtncctaatctcnanngntcttttngatcntntggtctttgcntancttnnaacntccttttgnttangnananaanccttcntaaattnanncaanttnnnttcctnnctaagnanngnnccttantnntntncttnnantaccctnancnttnttcnancnnatcnttcnccacngtntntaantnnantnnatttcnaantncctnncntcaacnacntcaantacancntcctctcnanctatcacaanncaanngncactaanncgtactatttctnctanggntccncgctatttnttccnacttnctnccaanannatannntanaanatnntccttctaacnttncggctantctcatctctnncttanntnnnntcagcgacanatnnnncnctncatatanatnnctcangtannaanttctntatntntnccctnananacacnntctntnnaanttcttcnntntcttantnnnatantttcnntntnttannnatacnaactantntncntnnttntnatntnnnatatccacctntannnncantntncnatanntctnattnaatcncnttctacancctannnnntcnnccntttnntattcnctttctgngnaatatatcnatattctnctntannnaatttntttctntcnctctncantataatattttnggggnntntctnatnatntnctctntaatttttncnnnntncnnttannaaaccttggngaaattaatctcntantcatntatnctnnnggnnatgtacacccaanttnggttnannttntnttcttcantnntaannngnn

SEQ ID NO: 5371 - DNA, 752 bp, Homo sapiens; identical to SEQ ID NO: 670
  misc_feature 3, 12, 49, 639, 658, 669, 721, 723, 729, 748, 751: n = A,T,C or G

SEQ ID NO: 5372 - DNA, 752 bp, Homo sapiens; identical to SEQ ID NO: 670
  misc_feature 3, 12, 49, 639, 658, 669, 721, 723, 729, 748, 751: n = A,T,C or G

SEQ ID NO: 5373 - DNA, 1017 bp, Homo sapiens
  misc_feature 2, 26, 28, 35, 36, 37, 46, 47, 65, 69, 73, 80, 84, 85, 90,95, 98, 105, 106, 107, 108, 110, 112, 118, 120, 126, 130,132, 139, 147, 149, 173, 186, 189, 190, 194, 201, 205, 206,209, 210, 211, 212, 213, 219, 227, 229, 231, 236, 241: n = A,T,C or G
  misc_feature 242, 250, 251, 253, 256, 258, 260, 262, 265, 270, 274, 279,280, 282, 292, 298, 304, 305, 314, 319, 320, 322, 337, 339,340, 341, 342, 343, 345, 348, 353, 357, 364, 371, 373, 388,389, 394, 400, 404, 405, 411, 419, 431, 432, 434, 442: n = A,T,C or G
  misc_feature 446, 455, 456, 459, 460, 464, 465, 470, 471, 474, 475, 480,483, 489, 491, 501, 509, 510, 516, 519, 520, 529, 532, 537,545, 547, 549, 555, 560, 570, 575, 578, 581, 582, 587, 589,600, 603, 605, 612, 617, 625, 627, 628, 629, 637, 638: n = A,T,C or G
  misc_feature 643, 645, 653, 656, 657, 661, 664, 666, 672, 683, 691, 697,701, 702, 703, 704, 710, 712, 714, 719, 720, 723, 725, 726,727, 731, 736, 737, 747, 749, 755, 758, 764, 767, 768, 770,776, 777, 778, 779, 786, 788, 789, 795, 799, 800, 809: n = A,T,C or G
  misc_feature 813, 828, 829, 830, 836, 841, 848, 850, 851, 859, 860, 862,867, 869, 870, 873, 879, 880, 882, 883, 886, 892, 893, 898,900, 903, 904, 908, 909, 910, 912, 913, 916, 922, 924, 925,931, 933, 935, 943, 946, 950, 953, 955, 958, 961, 963: n = A,T,C or G
  misc_feature 964, 965, 967, 974, 978, 985, 986, 991, 993, 1001, 1002,1005, 1006, 1007, 1008, 1009: n = A,T,C or G
gntttcgaatgctgggagagccgatngnggctggnnngcgcccaannaagccctttgggaaaganccgngcgngttgggngagnngccanggggnagnaaaggannnngngnggaggngngggggngccncngtttagngacagacncnggggagaaaacgggggcgcgagcncggagagcggggngannatgnaggggancggnnagnnnnnacagcngaaagggncngnaaggnggagnntaaggggnncnggncncnanacncgagngtangggcnngncagagccgcngaaganagcganncgggaggcncgggnngnggggggcatggccgngnnnnngnggnagccnagtnagcgggnagagggnangggcgcggggggagnngacgnggggangccnngcgganggaatagnagggggagggcnngngagggggncggngagggggannccnngcgnnggggnnagnngacgnganacgagngnggccggggancgggaggnngggggnccnnggggccggnacnggganggggaggngngnggggangggangggggggcanccggnacnggnnggggngnggggggcaggnggnangaggcgngaggnccgcgggngnnngggggaanngggangngggggggnccnngggnggngngggagngagaggggganaggggggngagccngggnnnncagggngnanagggnnggngnnnaggnggcgnnggggaggagngngggagnganaaaagnganngncggggnnnncgggggngnnggagancagnngggggggcngcgngaaggaaagggcggnnnagaggngcgcnggggggncnncggggagnncnggacncnnggnggggcnnannganaagggnnggggngnggnnggannngnnggncggggngnncgcggngngngggggggnggngggnacncnggnagngnnngngggggcncagngaggggnnacacncncggggggnnagnnnnncgggcgcg

SEQ ID NO: 5374 - DNA, 810 bp, Homo sapiens
  misc_feature 11, 13, 14, 15, 26, 38, 51, 57, 89, 91, 93, 94, 98, 103,104, 109, 116, 119, 131, 139, 172, 181, 207, 231, 234, 242,277, 283, 326, 334, 355, 360, 361, 383, 422, 450, 500, 572,577, 622, 656, 698, 724, 729, 769, 773, 774, 789, 795: n = A,T,C or G
  misc_feature 801, 806, 807: n = A,T,C or G
ggaaagggggngnnntttctaaaggngcttttcaaatncttggctactcgnctctangtaggatcccatcgatgcggaattgggccacnangnnaggnagggnntgcangctgggngtntcactgatacangcacgcgngtatgcaaaggaaggaagggagcttaatgccangaacagatnttgcagttggtggggtctcaataaangttattttccactgaaaaaaaaanaanaaaaactngggcctctagaactatagtgagtcgtattacgtanatccanacatgataagatacattgatgagtttggacaaaccacaactanaatgcaangaaaaaaatgctttatttgtnaaatnngtgatgctattgctttatttgnaaccattataagctgcaataaacaagttaacaacaacanttgcattcattttatgtttcaggttcanggggaggtgtgggaggtttttaaattcgcggcccgcggcgccaatgcatngggcccggtacccagcttttgttccctttagtgagggttaaattgccgcgcttggcgtaatcatggtcatangctgnttcctgtgtgaaattggttatcccgcttcacaattttcacaccanccattaccgagcccgggaagccataaaagtggtnaaagccctggggggtgcccttaaattgaagtgaagcttaacntccacaatttaaatttgccgtttgcngcttnaacttggccccgtttttccaattcggggaaaaaccttgtncgtnncccaacctgcctttnaattgnaatccnggccnnacc

SEQ ID NO: 5375 - DNA, 814 bp, Homo sapiens
  misc_feature 1, 4, 21, 24, 25, 28, 35, 37, 39, 49, 51, 55, 63, 65, 86,94, 102, 112, 116, 122, 130, 144, 181, 183, 276, 285, 320,369, 397, 405, 445, 471, 480, 488, 513, 517, 527, 528, 538,549, 551, 569, 573, 576, 598, 604, 608, 612, 619, 620: n = A,T,C or G
  misc_feature 634, 637, 644, 658, 667, 670, 674, 676, 679, 682, 683, 684,690, 691, 698, 706, 707, 720, 723, 725, 729, 737, 738, 739,740, 743, 752, 759, 761, 765, 768, 770, 788, 789, 790, 797,801, 807, 808, 813: n = A,T,C or G
ntgngggggtgagggtctacnatnnagnggggctncncntgctctccgnancagnccggcggngncgaattcggcacgagccaagnaatacctnggtaaatnttctaacctnatantgtatncagggttnatggctcatttagnttgagagtgttaagagactggagttttaatccaatangngtgccttttggttctcagatatacatacaagctgtgattgtttagatgtttccatctttttatatatgcatatacatattattattggtgttntttattttnaggaactgaaagaaaatggtgaattgctgcctatnctgagaggagaaaattaataaatcttaaacttggtgcccaactattgtnagaaatatctaattacattgggagcagntcatgatntagtcctcagaaatggactaggaatagaaaattcctgctntctcagatacatgttctgtgtatttncaatgtcgngctaaatnaatgtatgttacattttttttcccnccanaaaaaataannaaaaaactcngagcctcttananctatagcgagtcgtattncggnacnatccagacatgataagataccnttgatnagtntggnccaaccnnacctagaatgcaantgnaaaaaangccttatttcccgnaaattttgngancgcntnttngcnnnaatttnntaacccntttttaannccgccaaattaanccnantttnacccaacnnnnccnaatttggcnattcccntntctnacngnttttccaaggcttccaannnggtcggnaagntctttnngaaant

SEQ ID NO: 5376 - DNA, 782 bp, Homo sapiens
  misc_feature 1, 6, 8, 9, 10, 11, 12, 13, 14, 15, 16, 17, 20, 25, 32, 35,38, 41, 42, 54, 56, 57, 58, 60, 64, 67, 75, 88, 97, 104,106, 112, 115, 116, 122, 143, 161, 163, 168, 170, 181, 182,191, 195, 196, 203, 228, 251, 255, 259, 272, 277, 279: n = A,T,C or G
  misc_feature 282, 284, 298, 309, 318, 323, 326, 330, 340, 343, 345, 351,357, 372, 377, 379, 380, 391, 401, 404, 407, 408, 409, 419,423, 427, 441, 451, 452, 467, 472, 480, 490, 492, 527, 542,544, 545, 554, 558, 561, 570, 571, 572, 575, 576, 577: n = A,T,C or G
  misc_feature 578, 583, 584, 596, 600, 617, 618, 619, 624, 626, 630, 633,641, 657, 669, 670, 671, 676, 683, 685, 693, 695, 698, 708,709, 710, 716, 723, 741, 753, 770, 772, 774, 781, 782: n = A,T,C or G
ngaagngnnnnnnnnnngtnggctntctaatnctngcnaanngctggtctactngnnntntccncantatccctnctacacgaatccngcacgagcnatgatgnanatcganatnnactctngttgatgtatatattttattnacactggaacagctcacncnctcancntcttgcctcannacctggatngatnnccggccncatatgagcaacttcattgcagaantcacctgtaggcctgacagcctnaaanagtnccctttattaganagtantntgncnacttctgatctgtnatctttatgtnaagcatgtntattntgnacancatatacttngantnctctgncctacngcatattctaatgtncctangnntataaattggngtgtccagancanccnnnttaaatttangccngttntattaataattgancctagatctnntctaatcctaaaatnaatcnatgtattncctgacctgntntttattcaatctgtttatgggaaagcatcatgcancctttacaaattatntnntcacctctncacngcnagctttctnnntcnnnnaagtnngggctatctgantatngtccgcatcccttgacnnnctagntntccnttnaattatcnctggatacactgtggngcctagttaaannnccatncctttcnangtggaatngnggnaaagcgcctnnnggggancatggantttcacaaagcctcgaangtcccacgcctngacgaatgcaaattccnangnttgtttnn

SEQ ID NO: 5377 - DNA, 867 bp, Homo sapiens
  misc_feature 1, 7, 8, 9, 16, 18, 19, 20, 21, 23, 24, 39, 66, 77, 78, 82,84, 107, 108, 110, 111, 116, 119, 121, 122, 129, 132, 139,144, 145, 147, 155, 167, 171, 177, 183, 185, 192, 193, 197,213, 214, 218, 221, 230, 231, 234, 242, 250, 252, 253: n = A,T,C or G
  misc_feature 258, 259, 277, 307, 311, 322, 326, 346, 350, 378, 380, 382,389, 401, 410, 417, 425, 429, 432, 441, 446, 447, 448, 456,461, 485, 489, 492, 497, 501, 507, 512, 513, 514, 522, 524,529, 532, 549, 551, 557, 561, 564, 566, 581, 589, 591: n = A,T,C or G
  misc_feature 594, 604, 605, 616, 618, 620, 625, 628, 634, 643, 646, 651,652, 659, 665, 671, 675, 676, 678, 679, 684, 707, 711, 717,720, 728, 731, 733, 740, 741, 747, 749, 756, 773, 775, 787,794, 795, 797, 804, 812, 813, 814, 826, 829, 833, 840: n = A,T,C or G
  misc_feature 841, 843, 847, 849, 854, 856, 860, 863, 864: n = A,T,C or G
nttttcnnngttgggngnnnngnnggggtttctaatgtngctaatggccgtggctactcgttcttnccgcacgcagnncggngnttcgaattcggcacgaggtcctnntnnttttnttngnngctgggnggnaactctntattnnantgtccggnagaaggatgggngtgngaacanggtggncnctgtgcnngctncagctttcactccggnngggntcnatgctgtcnnggnccgcacgnactgccangnncacanncctggcctcccgaggcangcacagcaagtgtgacgggactggaagccntttncacgaccttgnatgngctggtcacgtcacagtcantggntgccactctacaggctgttggggatggntnancaggggnacactgtgcatnactaacagncacctgngtatgtgntgcntanatcccgggnctggnnnaacctccngctgntcccatgcaccacaagactgccantgtnganttgcntgantccttnctgcnnnttttccancnatganaanctcctccctgcggttcncnggaccngtgnaanantcccgaagccccttngcatggcntnggnttgtggaccnncccggcctttnancnggccntcnccctanacggcttgntanccccnnttctacnatcccnggctcnttcnncnntttcnttcataaaccgcctgcgtccttncacngtcggnttnctcggggnccntncctctcnntggggngnttccccnccctcctcaaccctttngnccccctggattntacctanngntcccttnaaattctnnnccaacggccccnctncccnccgcccnngncttncnccgtntnactnacnncct

SEQ ID NO: 5378 - DNA, 1038 bp, Homo sapiens
  misc_feature 1, 8, 15, 18, 19, 20, 24, 25, 27, 29, 40, 41, 44, 46, 56,61, 65, 70, 71, 79, 81, 84, 94, 96, 99, 108, 109, 113, 114,117, 118, 122, 125, 126, 127, 135, 138, 142, 147, 150, 153,158, 160, 166, 169, 175, 176, 178, 180, 194, 195, 197: n = A,T,C or G
  misc_feature 200, 209, 212, 213, 214, 218, 229, 231, 234, 238, 239, 240,246, 248, 249, 253, 255, 258, 274, 282, 284, 285, 290, 295,298, 299, 300, 303, 311, 313, 316, 318, 319, 322, 324, 329,331, 333, 336, 346, 347, 348, 351, 352, 358, 360, 361: n = A,T,C or G
  misc_feature 362, 363, 366, 367, 369, 371, 381, 390, 392, 397, 398, 406,414, 415, 417, 420, 424, 449, 450, 451, 453, 457, 458, 469,475, 481, 488, 494, 503, 504, 506, 507, 512, 515, 516, 517,521, 526, 528, 530, 532, 535, 536, 541, 542, 548, 551: n = A,T,C or G
  misc_feature 558, 562, 571, 579, 581, 584, 597, 606, 609, 622, 623, 627,629, 631, 641, 642, 647, 657, 663, 664, 669, 672, 685, 689,706, 709, 711, 713, 717, 720, 724, 726, 735, 736, 739, 745,746, 747, 750, 752, 756, 757, 768, 771, 772, 782, 793: n = A,T,C or G
  misc_feature 802, 806, 810, 833, 846, 849, 853, 864, 872, 873, 874, 878,896, 906, 907, 912, 916, 920, 922, 924, 927, 934, 937, 938,952, 964, 965, 967, 971, 981, 990, 998, 1001, 1003, 1005,1014, 1018, 1021, 1029, 1030: n = A,T,C or G
nccccttnctgtagnccnnnccanngngnctttctaatcnnggngnggcgctgganatccnaaanagacnngccgggcnanttnggggcgaggngnggngggggctgnnttgnnctnnaaantgnnngtatcagnacnttcnacgcntcngancccgncnccatantangggccnngnanaccctggccaacanntngcnccaccatgnctnnncccnccttgacattntnacnaccnnnctgaancnntccncnctnccctaccctaccaccncgtgctcnanntacangcttnagnnnctncgcctagncntgncnnccntntatcncnanagngactaactcnnnttnnaccagnannnnacnncncnactctgcctnccatcggtnancctanntctactcnacgatacnncnttnaccntcatcacatcattctctccctgatnnntnagtnncccaaactacncgcccnacacgnctgtgcnttggtnccccaaacnncnncatgnccnnnaaantcttncncncnctnngccannccaccnccnaaccctnaccntatttcctntctccctncnaanaaacgttaaaccnccctaaaanatnccccctatccccnnaaancncntaccacctcnncggcncccacccccncctcgnngacanaanatctaccttccgncacnacaaacccatcctccanttncncncacnacnaatntncaactttanntcnaacctnnnccntnctanntcccccttccncanncccccatttncctttcaaaanctcccttancccnaacntctccccctcctaactaatatcntcctcttgcacantcnaccntctaatcatcncaccactnnncatncactccttcaatataccntttctcttcnnaaaanttcncctntncncanattcctntcnnttctaactctctcntctctctccctnnancacntctctctcancggtctatnccacttcnctntncnctactctcntccncanctccaaannccacccct

SEQ ID NO: 5379 - DNA, 932 bp, Homo sapiens
  misc_feature 21, 40, 41, 43, 48, 53, 57, 88, 125, 151, 179, 183, 185,189, 196, 264, 273, 275, 295, 329, 359, 370, 373, 375, 379,388, 395, 397, 400, 407, 431, 437, 441, 445, 449, 450, 462,465, 475, 484, 485, 490, 491, 496, 515, 517, 519, 522: n = A,T,C or G
  misc_feature 524, 529, 530, 535, 541, 552, 561, 562, 571, 572, 574, 576,578, 582, 586, 588, 592, 598, 600, 601, 606, 611, 614, 622,637, 644, 646, 648, 649, 651, 652, 653, 654, 661, 664, 665,682, 684, 688, 689, 698, 699, 715, 720, 727, 729, 732: n = A,T,C or G
  misc_feature 740, 749, 752, 759, 761, 762, 767, 772, 779, 783, 785, 787,796, 798, 799, 804, 805, 806, 814, 818, 819, 823, 826, 827,835, 836, 838, 839, 840, 842, 845, 849, 855, 859, 862, 863,864, 865, 866, 867, 868, 870, 873, 875, 877, 880, 882: n = A,T,C or G
  misc_feature 886, 889, 890, 894, 897, 899, 900, 907, 909, 914, 923, 925,926, 930, 931, 932: n = A,T,C or G
tccccaaaaaaagaatcattnggttttggaaaagaatacnnantcagnaactnttcnggtgtgtggtgaaaatgtcaccgtgtgtggnataccctatctcctggctacaagacctgattgaaaangaacagtgtccttacaccagtggaanatgagtgcatcaaagactttgatgaaanggantntcangagttgnatgagctgcagaagaagttaaatattaacatttccctggaccataagagacctttgattaaagttttngggaattancnttagatgtgatgcaggctanagatgaaattgaggccgatgatcaagagaagatntgattggccaaaagaaccaggaatcccggnccagattcgtnttnantgantttataggnatggcancnttnatggacnaataaacacttcttcatttgtttnttaacnaaantgtncccnnttttgaaactcnttngggatgccanaggggaggnnaaacnntaagncctgtttcccccaaaaccngnantanancggtnngtganaatatntataattggtngtcctttgnnttctcttcnngngngngcanaaananattntttggncnntgcgntgtgngcnccctttcnaaaatcttttgattngcggagngngnnannnnctctaantgnntttccgtccctttgacncngaanntttgtgggnntttgggggccattatnataanttttttntnagntcggtggnaaaaatagntcnccttctngnnaaaanatacnttccttnaggntntnaaaaacccnanntaagnnngcggttanaaanntgtnaannactagagnntnnngnatncttnttgttntatntannnnnnngnttngncnggntnaaanttnngccnctncnnattttantnttatntaatccttntnnggannn

SEQ ID NO: 5380 - DNA, 836 bp, Homo sapiens
  misc_feature 216, 286, 360, 434, 444, 450, 451, 469, 470, 491, 513, 514,524, 533, 546, 553, 596, 622, 627, 635, 639, 650, 662, 670,672, 684, 691, 693, 702, 704, 713, 714, 719, 731, 739, 759,761, 766, 795, 800, 808, 819, 820, 826, 836: n = A,T,C or G
atacactgaccttgcccgctcatctgcgagatgaccctgcaggaataccactatgtccaggagaaggcttccaagctagctgctgcctggcttactcctggccctctacatgaagaagctcggatactgggttcccttcctggagcattacagtggctacagtatctctgagcttcaccccttggtcagacagctgaacaaactgctgactttcanttcttacgatagtctcaaggctgtgtattacaagtattctcacccggtcttctttgaagtcgccaaaatncctgccttggatatgttgaagctggaggagattttgaactgtgattgtgaggctcacggcctggtactctacancagccacagggctaagcatgcatgttaacagggtatatttattctatgttcgaatttgtcttttgatcgctcanattcattttncctttnnttgcttttcccaaactgnnaatggtataaatatctatgtngcttggttttatgaaaggaaannaaattggcanatttgactncaaatttaattanaaaattnatgggttattggttaaaaaaaaaaaaaaaaaaaaaaactcgancccttttaaaactataaagaggtcgnaatanccgggggnggcnggaccatgganaacaaacatttncctgaagntncgggccaaaccncaacgtngnatggcaatngnaaaaaaaannccttnttttgggaaaanttggggangcaaatgcttttattgccancnttttnaaactgccaataaacaagtttaccccccncaatngctttcantttatgttttnnggtccngggggagggn

SEQ ID NO: 5381 - DNA, 1039 bp, Homo sapiens; identical to SEQ ID NO: 5309
  misc_feature 5, 6, 7, 8, 9, 10, 11, 12, 13, 14, 15, 16, 34, 35, 36, 51,55, 69, 84, 88, 95, 100, 102, 109, 110, 112, 116, 117, 118,121, 127, 135, 141, 161, 167, 174, 187, 189, 191, 194, 201,205, 207, 220, 235, 236, 244, 255, 257, 284, 288, 293: n = A,T,C or G
  misc_feature 305, 308, 309, 316, 327, 336, 339, 346, 365, 376, 382, 389,408, 409, 432, 458, 461, 467, 477, 478, 519, 520, 538, 575,583, 610, 650, 651, 656, 657, 661, 685, 689, 707, 710, 722,729, 740, 743, 759, 771, 774, 798, 808, 829, 842, 851: n = A,T,C or G
  misc_feature 853, 862, 866, 870, 876, 896, 902, 904, 907, 911, 931, 933,934, 935, 936, 952, 954, 960, 962, 965, 967, 971, 977, 978,979, 989, 992, 1006, 1014, 1015, 1023, 1024, 1030, 1036,1038: n = A,T,C or G

SEQ ID NO: 5382 - DNA, 743 bp, Homo sapiens; identical to SEQ ID NO: 640
  misc_feature 3, 4, 5, 18, 24, 32, 33, 37, 38, 118, 145, 157, 166, 175,176, 179, 181, 182, 185, 186, 187, 202, 221, 223, 224, 226,228, 229, 236, 239, 245, 247, 255, 256, 258, 267, 269, 271,274, 279, 282, 287, 288, 294, 300, 312, 319, 343, 356: n = A,T,C or G
  misc_feature 366, 368, 390, 412, 419, 422, 428, 429, 435, 454, 456, 457,461, 463, 468, 469, 471, 485, 486, 491, 493, 499, 500, 504,506, 512, 538, 544, 547, 562, 566, 570, 583, 588, 625, 643,646, 658, 659, 665, 677, 699, 706, 708, 709, 713, 727: n = A,T,C or G
  misc_feature 735, 741, 743: n = A,T,C or G

SEQ ID NO: 5383 - DNA, 849 bp, Homo sapiens
  misc_feature 4, 13, 14, 16, 25, 38, 50, 57, 58, 61, 64, 69, 78, 80, 101,112, 116, 117, 119, 120, 121, 123, 124, 125, 129, 132, 138,143, 162, 163, 170, 177, 185, 195, 197, 198, 199, 204, 205,213, 214, 216, 226, 227, 229, 231, 237, 239, 241, 246: n = A,T,C or G
  misc_feature 247, 249, 260, 263, 267, 270, 272, 275, 276, 277, 279, 298,301, 310, 321, 345, 348, 353, 358, 362, 366, 376, 378, 379,382, 389, 393, 399, 402, 403, 406, 407, 412, 416, 428, 430,447, 456, 462, 488, 489, 495, 505, 511, 517, 533, 534: n = A,T,C or G
  misc_feature 544, 549, 552, 560, 571, 572, 573, 574, 580, 581, 593, 597,601, 605, 609, 610, 613, 618, 622, 626, 627, 629, 631, 632,633, 641, 642, 643, 644, 649, 651, 656, 664, 665, 668, 670,680, 681, 683, 689, 690, 691, 695, 698, 699, 707, 710: n = A,T,C or G
  misc_feature 712, 718, 721, 729, 734, 741, 749, 752, 753, 760, 763, 765,766, 767, 780, 790, 795, 801, 805, 806, 809, 815, 822, 836,841, 844: n = A,T,C or G
cccnctattgccnncnacatggggnttttccaccccgntcacgtggtggncgcccanncgnacnagcangagcctacnantcggaacatatcgcctttatngtctttaacanaganntnnntnnntagntcnattcanttatnacccagcagatccttaatnnaggcccntatattncttacctnattagaactntnnncaaanntcaactgnntnaccttaatgnntngnagcacntntnacagnngnacttaaaactntanaatntcntnagnnncngttattctccactgaaggnctntccactgtncaccatttcangcatcatcactatgattctttcancangactntggcncggnttgncactgatctntnnccnaatggcnaacnagctgnatnntcnnttggnctcncttataggaacnancaacactagcctactgnatcatgatntccganaactgaaccatgaacactgccatctnnccatgntacctgcatnaagaanttcacntcactctgaaacatannatgactgacntgganctnactaattnctgagaactgnnnntcaaannacccacttaatngggntcancatnttgnnacncttgnaatntaanntnannnaaagaccnnnnttgantngcccncattttannttngnccataataanngngccacnnncctnaanntcttcaancangnaaaagnttngcaacttnttacnacctctncttccccnctnnatctaanatncnnnatataccacttancccagaatanctacncccaanccanncantcaccnccccacnattttatctcacanttccncantccct

SEQ ID NO: 5384 - DNA, 777 bp, Homo sapiens
  misc_feature 2, 3, 4, 5, 6, 7, 9, 10, 12, 13, 14, 19, 21, 31, 35, 36,45, 50, 76, 78, 81, 371, 523, 595, 609, 617, 641, 652, 761,767: n = A,T,C or G
gnnnnnncnncnnntgggngnttgtgggggntttnnaatgttgcnaaaangcctggctactcgttctttccgcaananccntcggttcgaattcggcacgagggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacanagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtnaaaggcctacaagcccagattgccagctctgggttgaccgtggaggtagatgcccccaaatctcaggacctnccaagatcatggcngacatccnggcccaatatgacgagctggctcngaagaaccganaggagctagacaagtactggtctcagcagatttgaggagagcaccaccagtggttaccacacagtctgctgagggttggagctgctgagacacgcttcacagagcttgngacgtncagtccaatc

SEQ ID NO: 5385 - DNA, 890 bp, Homo sapiens
  misc_feature 2, 8, 23, 24, 26, 61, 84, 162, 334, 341, 360, 412, 420, 442,448, 475, 479, 505, 522, 579, 580, 582, 595, 600, 601, 613,614, 621, 627, 628, 631, 647, 650, 652, 656, 663, 666, 667,671, 681, 682, 703, 705, 708, 709, 716, 732, 733: n = A,T,C or G
  misc_feature 734, 739, 759, 765, 784, 786, 792, 795, 797, 830, 840, 853,860, 868, 874, 876, 885, 889: n = A,T,C or G
anttttancttgaccccttcaannangatgaacataaagctcttacgttcttgaaaggatnaaacacaagaataagatggggtnccagtgaccagctcctctacctggggtcatggaggaccgaagaccctccaaccttgatgcctgtaaggacaggcgctnctgtaagggatcaggtgtaaagaatctggccatagctcctgtacaaagcctctttgtctgaagtacttgggtgctctttgacggcaagagggaacacaacctgtccgtggctgcttggacctcaccacgggggctcaagtggacataacatctatttgacaggccctggcantcaccantggggtgtgtgtggcagtngctgtggggtgtgagaatgactgccaacaggcacttctcaacaaatgacctngctgtttnacattggccctgaaccagggangaaagnagagggaccaattggaagcctttgttnccancatttccttcttaaaaaaggggaganacaattttaaaggcacngttgttatggaatttgggaattaaaagcaggaggcttcaaagggtgggtttcttganntnaaaggaacacaancccgnngggggcttttgnngggttcnacccannagnccttcccttggggcanganancacncaatttngtnncctnattgccatcnnatttatttgcccccttttttnantannttggttncccaagaaattaaatnnntggtnttattaaattcattttgttngctttnttttttggttcgggaaagntntttgcntananaccccccccaaaagaataattgaattgggggtnccccttgcancctatttgatttnttttaangccctgtnaaaaangncttccccancccnt

SEQ ID NO: 5386 - DNA, 770 bp, Homo sapiens
  misc_feature 1, 5, 9, 14, 21, 30, 48, 55, 61, 72, 83, 84, 90, 100, 106,115, 121, 126, 129, 133, 140, 141, 146, 147, 156, 158, 390,392, 397, 400, 404, 413, 420, 423, 432, 438, 445, 517, 554,563, 568, 582, 592, 601, 603, 608, 628, 631, 636, 637: n = A,T,C or G
  misc_feature 643, 666, 668, 673, 675, 683, 685, 687, 691, 701, 706, 708,714, 729, 743, 752, 754, 755, 757, 758, 759, 764, 765: n = A,T,C or G
ngggntccnttttngaaaggnctctctttnaagacccttgctacttgntcttttngcaggnatcccatcgantcgaattcggnncgaggntggccagganggtctnaatcctgancctcangaggnggnggantgagttnnagaanngcctgtcgnanggagatttgggtagaagccctcatgctgagctttgtgtccctggtgatgttggaacattaatgatggaacatggccaaacttcagtcatgatcctgaaaccatggcttcaggatcatgactgacgtcatggtttcttccctgccagaaatgaaggttcagttatgaggcaaccctctagtaaggcattgtaaaagttactggatttggtttaataaaagttgaaataaagtnanataanatnaaanaaaaaactngagcctntanaactatagngagtcntattacntactatccagacatgataagatacattgatgagttttggacaaaccacaactagaaatgcagtgaaaaaaangctttatttgtgaaatattgtgatgcctattgccttnatttgtacncattnttaagctgccatanacaagttatncaaccaccnanttgcnttcatttttatgttttcatngtncatgnnggaggntttgggtaggttttttaatttcncngcctntngctcccantngnattngggccccggntcccnancttttngttccctttacttgngggggtaaatgccnccctttggngnnannnatggnnctacc

SEQ ID NO: 5387 - DNA, 861 bp, Homo sapiens
  misc_feature 2, 4, 6, 8, 9, 10, 11, 16, 17, 19, 23, 29, 32, 36, 37, 38,41, 44, 55, 63, 64, 67, 69, 70, 74, 76, 96, 100, 105, 127,128, 129, 131, 134, 158, 161, 164, 169, 175, 184, 192, 193,194, 201, 215, 217, 218, 230, 239, 250, 257, 261, 263: n = A,T,C or G
  misc_feature 265, 267, 269, 271, 273, 277, 279, 288, 290, 295, 296, 299,300, 302, 305, 308, 309, 317, 323, 325, 335, 336, 339, 349,354, 363, 366, 376, 378, 390, 395, 396, 400, 402, 403, 405,408, 412, 416, 418, 424, 427, 428, 432, 454, 455, 456: n = A,T,C or G
  misc_feature 458, 459, 460, 465, 475, 477, 480, 483, 489, 494, 510, 512,521, 528, 531, 533, 536, 539, 541, 543, 544, 548, 560, 566,574, 577, 580, 581, 594, 604, 611, 613, 615, 616, 624, 631,632, 635, 643, 648, 653, 655, 664, 666, 675, 676, 679: n = A,T,C or G
  misc_feature 681, 684, 688, 689, 691, 702, 703, 710, 718, 722, 724, 725,735, 739, 740, 749, 754, 758, 759, 763, 765, 773, 774, 775,783, 785, 786, 799, 800, 804, 808, 813, 815, 816, 817, 828,829, 833, 845, 848: n = A,T,C or G
tngntntnnnnaaagnngntctnctctanagntgannntgntgntgaacccactntcccgcannaancnngcgngncgaattcggcacgagcctantacngtagncttggagcatcacgattttttnnnangcntgcatcagtatactggaggacctnctngcnctgcnggacanagacgtccnacagaatnnngaaaacngtgctcaggactanannctgaccaacacncgtgcacanaagcaaggaantagggcngganancnantncngnggcntncagctctgncncgcannatnngntanctnntgacttancgtganancaatgaaggnnctnaaccaaagtncccanggggacatnganaaatagcacnangggccttgtatnggacnntacncnntnccnaacntggntncggggntgnnaccntgggaaaggagccttctgcatnnncnnncgccntacccatgancnccnctntaccanggctntgccccctgagccaancncgctgggtntgctgcnaangnaanaancnanntctncagatatggacntaaccntgcaaatntanaanncttgccaatttcnattttgccangatccgncnannccacaatncctcctnnaanagaatccnccacnccccncnagaacctcngnaaaacattnnggncnccncctnngnagctacaattnnctctcancctaggancacncnntcgctatgcncccnncttaccaancctanttcnntcgnancttacccnnntttacccntnnggcatttcccccnnaccnttgnatttnannnatttcccttcnngganatgcaattctcntgngcacccaacaacc

SEQ ID NO: 5388 - DNA, 813 bp, Homo sapiens
  misc_feature 5, 46, 534, 666, 683, 687, 694, 698, 707, 731, 743, 799, 812: n = A,T,C or G
tgtgngtgcttaagcagattgctatgatgcatgtccataaaacagntttctttctgttctattgtggagtttttctggggctggaaaacattcttttgttatttccaaacactgtctataattaccagacatgatataaacacataaggtgccaactggaatttactctagaggggactttccctctcagacttccagtcaactcacacttgtgcaacaaagtgcatgctgtcccctaaatatgcaagcagaactgtgtttctgcctatttggtatctatagtcctctacagtcacttctagagagactaaaccaaatttctaccaacttcacagggcaacaatcaatagttttatctcaatgactcttgtatcttcagaccttaaactgattcagagaccatggggcccacaaacctaatcaagagtaacgttttcattgagtacacatttcagacatgagaatcttcactttccccttttttctcttggtaaaatgttcacaaaatgtgcaggtaacacctgctggttactncagccattcgggcccctaaatctgcagctcttcattttggatctaggtcttgagaatttgggaaatagaaaaatttttatctaaaaatgcaagtcttttgggttatcaaactcagacattgaaaagaaaagngcagttacgcctttctnctcnttgaaanatgnattcatctnttggaactgggtcacttttggccncaagttgatgtntattaaactggatattccacattggacactggatcttatccctaaaccataatganatatgtccaatcnt

SEQ ID NO: 5389 - DNA, 960 bp, Homo sapiens
  misc_feature 13, 22, 24, 29, 30, 45, 46, 47, 50, 53, 60, 69, 74, 77, 78,81, 87, 89, 90, 92, 95, 96, 100, 101, 103, 121, 123, 128,130, 133, 135, 137, 138, 140, 142, 146, 151, 154, 155, 157,158, 159, 163, 169, 178, 182, 194, 198, 200, 207, 209: n = A,T,C or G
  misc_feature 211, 213, 214, 215, 218, 221, 222, 230, 235, 236, 237, 241,244, 247, 248, 256, 277, 287, 302, 305, 311, 313, 318, 323,329, 338, 340, 345, 354, 355, 361, 366, 370, 371, 376, 379,380, 383, 384, 387, 388, 396, 397, 402, 406, 412, 414: n = A,T,C or G
  misc_feature 417, 419, 420, 423, 425, 428, 430, 433, 434, 436, 438, 439,440, 443, 449, 450, 451, 452, 453, 454, 457, 459, 460, 463,465, 466, 468, 472, 478, 484, 485, 491, 497, 498, 500, 503,517, 518, 523, 524, 526, 535, 536, 538, 543, 545, 547: n = A,T,C or G
  misc_feature 553, 555, 558, 559, 563, 565, 567, 569, 578, 580, 583, 584,586, 587, 594, 595, 598, 605, 609, 613, 618, 622, 624, 626,628, 630, 638, 646, 650, 655, 656, 658, 662, 665, 673, 689,697, 699, 707, 723, 738, 745, 746, 766, 768, 774, 779: n = A,T,C or G
  misc_feature 794, 797, 800, 805, 809, 811, 812, 814, 815, 816, 818, 824,830, 831, 841, 842, 872, 896, 907, 921, 925, 940, 946, 949,955: n = A,T,C or G
tgggttttcaggngcccctttnanacggnngcggcctttcgcctnnncgnaanagcccgngcgattcgnagacngcnnganaagtgncnnangtnncttnntnatggtgaggactttatgnanctgangncantncnngncntgantattntcnncnnntggnaagatngcacgtgtnttancctgatgccagntggngntatcccntncncnnnttnttnnttcacggngaacnnnatanatngannagaatggnatcagagaaggatactcactntgctctcacngattagcggcgattngcntgatcncngctgncatgnaacccntatctctgngnttcangcgactgannggtgancaccncccnnctagntgnnacnnatnncactcctnngactntccngcaacntnttntnnctntnagngngtnncngnnnttncaccgnnnnnnccncnnttngnncncatncttttnaccccnnttggcnccacannanctncctttgccataaannctttnntntaccatganngngattncncncttttngnctnnatcncntntnaattcaatncntanncnnttatccnnccntttttcnttgntccnttttnctgngnantngnctgggaanttttggtntccncctanntngaantcngccttaanatcctttgggtggacnttgggcangnttcttctnggggaatccctttttnatggaattggccttnaaggccnnttggtcttccttggcaaccntnggggtnggccntaaaatgggcccctnaanttntttanaatncnncnnnanttactnttttcnncctccaaccnntttacccggttgggctcttaacccccaggntgggaatttcaaaatttttaaggnttccccatttnttggaaaaccttantttngggaccccccatttngggctnccnattttnggaat

SEQ ID NO: 5390 - DNA, 816 bp, Homo sapiens
  misc_feature 2, 5, 58, 84, 98, 173, 226, 235, 257, 294, 344, 345, 352,354, 361, 386, 387, 398, 402, 412, 491, 580, 652, 653, 657,662, 671, 688, 689, 692, 701, 706, 707, 712, 724, 725, 729,734, 735, 736, 743, 752, 764, 766, 771, 774, 782, 789: n = A,T,C or G
  misc_feature 791, 792, 793, 800: n = A,T,C or G
tnttnttggaaaagggcagtgtctctaaacccaggcaaacggtaaatgtggggcatancaagagggccgggtagtggccacttncccatcatgctcgnttctcattttgtgttttttagtagaaaaacacagggtgttcttttgcccagacattaatctttagaatgcctgtnttttctaatgttgggatttctttcacaaccacccaccttaatatttccattgngactcaganaatcagacttcattcgattctntagagaactataaatactgttgtcagtagaagtgaantcttgcttatgtaatcctaattcagaatgtgttctcagaagaggtaggcnnggaccananctgggcnagaccacaggcagaggccaaatccnnccccctgccgntagnagctaatatnagttttacacccacttgttcatgtattttccctggctacttgtgggcagcaatgccagagtcaagtcatcataacaganacagaatggcctggaagctggatttactatttcaacttttacattaaaacttgatgacccctgtgctagacaggcagctcatttctgcnggtaaaattatatttcatcttccaacttttcatttccaaaatttgaacctatattactggaggccccttacnnaagntaaanttttcattnttcttttggggggaaannctncagaaaaanccctnngcccntttaaaaacttnnatgngggtnnnttacccntgtcccacnctggaaggtccntnggggnttngggcaaanccccacnannngtgcccngaaaaaatgctttttt

SEQ ID NO: 5391 - DNA, 785 bp, Homo sapiens
  misc_feature 94, 141, 159, 296, 332, 382, 422, 424, 444, 474, 503, 580,604, 607, 631, 644, 650, 657, 666, 680, 683, 735, 763: n = A,T,C or G
taggagtctgaaggcctcgctgctttctgtgatggctttgcagtaagtgccgcctggcctgcatgcattggctaacaggctgcagaatggcacngaaggactcgctcgagattgtcatggccagagatcataggtcacttnaggtagcaagacccctgncaaactgggcacttggcctatgtactgatttgtgggatggtggcaggggtgtggggtccttcaccctgcctgaattctctttggcttctgtgctctgtatgctgctgtccccaagggctctttcttattatggcagngagtggggattggtcctactttctttctctggaaanggaaagcctccaagactccatgtgcttgggcagcttgagaaggcgttcancaccacgcctagcaggcagaccttgaagcctcacctttantntatctgcaagaggtattcanttcctggcacaagggactaggggcatgtanagtatatgacgaggcaatatggctgtgcnggaccttcatttaacttcaattaatagggaaaaattattatactctatagatcctgaaagggttctaagattaaaancatccttattaaaatcttctaaanaantctggaaagaaacacctaatctanaaaaggcttgttnaaaaanccacagngatgggttnttaagaagcaaacnccncagcatttccatttaagtaaaaactaaccaaggcagcttttatttaagaagngtccggccttctaaccctgcacaagccnatgaggacatatggaaaatttt

SEQ ID NO: 5392 - DNA, 734 bp, Homo sapiens
  misc_feature 2, 19, 22, 71, 79, 91, 92, 106, 110, 116, 119, 125, 147,148, 162, 166, 171, 172, 174, 186, 189, 196, 199, 200, 201,203, 210, 212, 216, 229, 231, 237, 248, 264, 275, 278, 282,290, 293, 299, 300, 303, 304, 308, 311, 316, 320, 326: n = A,T,C or G
  misc_feature 327, 328, 330, 331, 334, 335, 336, 345, 350, 359, 360, 375,377, 380, 381, 385, 393, 400, 401, 408, 420, 424, 427, 449,457, 458, 464, 466, 469, 472, 473, 490, 492, 505, 507, 508,515, 524, 529, 535, 537, 542, 553, 561, 585, 587, 590: n = A,T,C or G
  misc_feature 592, 604, 611, 622, 626, 645, 657, 667, 669, 672, 675, 677,684, 691, 699, 702, 710, 711, 718, 729: n = A,T,C or G
gngcagctcttgttcttanagncaggctacttgttctttttgcaggatcccatcgattcgaattcggcccnagctgtgngggacacattcnnactgcggcaggacntgtntgctgnctnatcacnttgacttgtaatagcattaatnntcaagcgattgatntatnataanngncattctagcatngtncatggcngannncntcctggnanatgntaacggtcttgcnanctgatncctctatctgnactgggtctctggcangggcctgatgnatngtanatactcgntangtatcnnttnngttntcnggggntctntcatgnnngnnatnnnagcacccangaggnactacactnncaagaaaaaatggtngnctnntacngagctgtnaagaacnntggaacntgctatcctgangccnctnaacttcatcatgggatgcctancttgtatnnatgttncnttntgnntaaccccatgatctgantntggacactaagancnntgtcatnggctgaggnggctntgaagngnactcntaattatgacnctgggatntaaacggtgctcacattgtcttgnanggnantttttcaaaaanggatttncgccttttggncccntgggaatttaataggcaanaagttttggccntaattgccananganganancctggantgctaangaacggcnctnttgcctcnnggatggncccctaacttnaaggg

SEQ ID NO: 5393 - DNA, 621 bp, Homo sapiens; identical to SEQ ID NO: 4707
  misc_feature 3, 4, 9, 13, 19, 21, 46, 50, 53, 62, 64, 74, 77, 79, 80,95, 96, 123, 127, 130, 132, 150, 151, 154, 155, 156, 158,165, 183, 188, 193, 194, 203, 206, 210, 211, 227, 232, 233,234, 235, 244, 249, 250, 257, 258, 259, 260, 262, 263, 279: n = A,T,C or G
  misc_feature 283, 285, 309, 319, 344, 355, 370, 375, 380, 391, 397, 435,455, 474, 477, 488, 491, 505, 513, 540, 541, 555, 556, 571,572, 583, 599, 610, 612: n = A,T,C or G

SEQ ID NO: 5394 - DNA, 971 bp, Homo sapiens
  misc_feature 1, 4, 8, 10, 12, 18, 20, 22, 35, 39, 41, 42, 58, 61, 62,67, 91, 101, 104, 112, 135, 148, 168, 169, 178, 182, 192,193, 209, 241, 258, 262, 274, 283, 312, 318, 322, 329, 346,359, 368, 370, 378, 379, 381, 384, 393, 399, 404, 406, 414: n = A,T,C or G
  misc_feature 419, 421, 427, 435, 443, 444, 446, 469, 474, 506, 524, 527,533, 535, 537, 542, 545, 549, 554, 572, 583, 587, 589, 591,593, 594, 596, 597, 600, 610, 612, 615, 616, 617, 619, 621,627, 628, 629, 631, 639, 640, 644, 648, 649, 652, 656: n = A,T,C or G
  misc_feature 660, 661, 666, 671, 674, 677, 679, 682, 687, 688, 689, 704,705, 706, 707, 716, 720, 730, 734, 735, 740, 742, 743, 744,752, 757, 759, 762, 769, 783, 804, 814, 819, 828, 836, 837,845, 850, 852, 855, 861, 862, 865, 870, 872, 874, 877: n = A,T,C or G
  misc_feature 878, 880, 882, 883, 888, 889, 900, 902, 903, 905, 908, 911,912, 913, 915, 916, 919, 925, 927, 929, 930, 932, 936, 938,939, 945, 947, 953, 954, 957, 959, 962, 964, 967, 970: n = A,T,C or G
nccncttntntntagggngntngtgggggttttcnaatntnngctaatgctgggctcntgnnctttntgcaggtatcccatcgattcgagngatgcactgngantacacgcnctaaaaatcgcagtcctggccanaagacgttatggncattgtgagggactgggggnnttggtcctntttnaggggctgtnnggactcaaatcggtgnctggtttcacacatatgtgttggtttgtggtncaacttctttatctganaacnccagtgataaancattgatgntactgaccaatctaaactaccatcttganagagtngcanctgaaantgatgcgataggcgtgncaagtatctgatnacttctttnangcatacgnnanaantgtatgccngttacncttgnangatacctntgctntnacaggntcagtatntatcagtnngnacacaaacacatgaacacattcngatanggcttatttcacacagttgaagttgatgatcntcccctggagtgctctgntanatatgncncngcctntangggnaaaanaaccccacactgcttctntgaccaccccnagcntntntnncnntantaatatttcntncannngngnaacgtnnncnaccgcctnnaatncctnnccntcgnaggnnaaaancccanttnaanancgncattnnnttgcactccccctcnnnnactcaactnaccnacactgggcncaannccctngnnncacaaccnctttntnttntctcacngggaatcggcaatnctgcactttcctatccctggncttaaaaaanattanatctccggnctctatcnnttgtaagntcacnantcntcctcnntancaaancnanacnncnannttttnncaaatccttcntnncnccncannncnnggngcacantntnncngtgncnnaactcntnggggcnnatntntcncnccnctnt

SEQ ID NO: 5395 - DNA, 791 bp, Homo sapiens
  misc_feature 12, 17, 21, 46, 89, 399, 542, 657, 739, 748, 759, 769, 782,791: n = A,T,C or G
tttgaaaacccnttttntttnaatccttttctttcaaatggttctngttctttttgcaggatcccatcgattcgccaatggatgcaggnaaaactgagatgggatttccccacgttgcccaggctggtctcctgagctcaaagcaatccagattgctgggattacagctgtgagccaccgtgcctggctgagatgacttttaaaaaaagacttctctaaagtagaaggaagggtggaattgtatgcacaagaagaaaaaaacctggaagaaaaacatactaaagaggctggagtgcaatggcgcgatcttggctcaccgcaacctccgcctcccgggttcaagtgattctcctgcctcagcctcccaggtagctgggattacaagcatgggccaccacncctggctaattttgtatttttagtagagacggagtttctccatgttggtcaggctggtctcgaactaccgacctcaggtgatccacccacctcggcctcccacagtgctgggattacaagcatgagccaccgcgcccggcctncctgttccagttttctataatctgttcatattatattctgggtatatgtgggtggtgtgattatccatgtggtcttattttcacattctttgcattaactataatgtcttaatgntttaagataaagtttcattctacaaagatgtattgtaccaataacctgggtattcaggttaccaatcttaaaaaaaacttanttcattttnaaaattaaacnttaaaatttnccaattccatttnaacattaan

SEQ ID NO: 5396 - DNA, 761 bp, Homo sapiens
  misc_feature 3, 28, 243, 373, 395, 443, 504, 510, 562, 595, 703, 720,729, 740, 742: n = A,T,C or G
tcnttcagttattcgttcagctccttgntctttttgcaggatccctcgattcgctcagctcttccggaggctgaggcaggagaatcgcttgaacccaggaggcagaggttgcagtgagccgaggttgcgccactgcactccagcctgggtgaccgagtaagactgtctcaaaaaaaaaaaaaaaagaaaagaaattgtcctttggttgccttagttccagagttgaatgaatgtacacattcngtagtggggggggcagaccggataccccttccttgtctggttcctttgaaaaaggacctccacctttcaaaggtacttaaagccatcttttacagattgcttgtaatgtaagggaaaagaagtcattgtnctttgggattggattggagggnaaaatcatcaaccactagcccccttttcaaaatcagcgaagatatttngatgattaagtgattcattgggtatgttctggctactgatgttactgaaatctgcaatcgngtatgntttttaattagttgcttttgtatttgaatttatgacatttcgaagtttctgngcttaactctttttaattaattttctgcacgtngcttttttctctttggttttaattccatacagagtattcaattcttgaaaacacattaaaaataatttgcttgcaaaaaaaaaaaaaaaaaaaaactcgaacctttanaactatagtgagtcgtnttaccgtanatcccagaccntngtaaaattaaaaaaaaaat

SEQ ID NO: 5397 - DNA, 1281 bp, Homo sapiens
  misc_feature 11, 15, 20, 21, 48, 52, 64, 85, 91, 94, 109, 112, 116, 117,118, 119, 143, 155, 167, 172, 191, 197, 201, 204, 214, 215,219, 220, 237, 246, 269, 277, 284, 308, 310, 314, 337, 340,345, 369, 404, 406, 435, 439, 450, 453, 467, 469, 477: n = A,T,C or G
  misc_feature 481, 515, 521, 522, 538, 553, 582, 585, 591, 599, 605, 624,629, 636, 655, 688, 692, 713, 728, 756, 775, 778, 787, 817,855, 861, 870, 874, 878, 890, 900, 911, 921, 929, 935, 962,968, 980, 985, 991, 1028, 1033, 1044, 1058, 1074, 1098: n = A,T,C or G
  misc_feature 1107, 1129, 1137, 1161, 1180, 1187, 1190, 1194, 1200, 1216,1217, 1223, 1228, 1235, 1257, 1267, 1274: n = A,T,C or G
attttttaaantttnggggnnaaaaattttttcttttttttgggtccnaaanattctttccggnccattggcccccttgggcccnaggggnttnccgggaaaccttccnttnaggnnnngggggaaatccccccccggggggnggtttaaccccnggaaaggccctncgggnaaaaattttccgacccccnttaatnaagnttnttttttttcnntttnntttaacaaaattttccnacttggggncccggttccggtttttttaaacnaaaacggntccgggnggaacttgggggaaaaaaaccccntngggnggtttaccccaaactttaaaatnggnccttnggcaagcaacaattccccttttcngccagcttgggcggtaaaaaacgaaaaaggcccgnanccgaatcgcctttccaaacagtggccaancctngaatgggaaanggnccccccctgtaccngnaccataanccgncgggggtggtgggggtaacccccaaccgtgaacngttaanntggcaagcggccctanggcccgttcctttcngtttctttccttccttttttcggcaacgntanccggcntttccccntcaagnatttaaatcgggggctccntttangggttcngaattaagtggctttaacnggcaacctcgaaccccaaaaaacttggatttangggnggaatggggttcaacggtaantgggggccaatcggncccttggaataagaacggggtttttttnggccccttttggaaccggnttngggaaagtncccaacgggtaacctttttaaaataaagtnggggaaccttcctttgggttttcccaaaaaccttgggnaaaccnaaaccaacntttnaaancccccttaatcntttggggggnccttaatttcnttttttgggnaaattttnaaaatnaaaaagggggggaaaatttttttgggnccccgnaaaatttttccnggggncccctnaaatttggggggggtttaaaaaaaaaaaaaaatgggnaaagnccttgggaaanttttttaaaaaccnaaaaaaaaaaaaattnttgaaaaaccggccccggaaaaanttttttttnaaaaaccccaaaaaaaaaattnggtttttnaaaacccgggccctttttaaaacnaaaattttttttccccctngggaaanggncccngggggnaaaaattttttttttnnatttcnccccnttttttnaaaaaaaaaaaagggggggggnccccccccanaaaaaanttttttt

SEQ ID NO: 5398 - DNA, 916 bp, Homo sapiens
  misc_feature 8, 14, 19, 27, 163, 168, 203, 204, 220, 222, 230, 245, 252,261, 262, 265, 268, 270, 293, 302, 308, 310, 315, 339, 366,392, 409, 440, 444, 453, 463, 468, 525, 533, 565, 569, 578,581, 639, 650, 656, 662, 678, 685, 690, 698, 741, 754: n = A,T,C or G
  misc_feature 759, 789, 793, 804, 807, 808, 819, 830, 833, 854, 868, 890,909, 915: n = A,T,C or G
tttgaaancatcanctctngttctttntgcaggatcccatcgattcgcagaaagggaaaatatgaagtgcgtgctggggtttgctatcgtatccacaggcatcacggcagtgctgctcgccttgatttttgttctcagaaagagaataaaattgacagttganctttnccaatcacaaataaagccatcagcagggctccctnnctgctgtaccaccccngngaaaattngccaccctaattttnttctggntcctttggnnggntgncngctgaccctgggaactgaagganctgcccatnttatgnanggcgnccaagtgggaatataacccctttncggcattcgggccatgtggccgtaccnttaatttggcctcaatctggactagngaaattatccttggcgngccaacaaaatgactataacttggggcagtnggtncttggttcntttcaaccanaagtnaaaaattaatcctccggaatcaatcccatccttttccgggctctcttccaattcttntttctttntaaccatcaaaggggaaccatttgtggaaaangggncaatttttnaancctcttggggggggagggatttccgaagaaatcaattgggcaatggttaccattgccnaaaaacgccancttggnaaaagnaaacaaagcaattggntggccantttgntccccaanggtaacccttggttttccccgaatggcctggccttaccttggnttgggatttcttnggggnggtccctttggaaccaaaaaaaaacccctngggnttcccaatttnttnnaaaccccccgnaaattggcccnttntttaccctttaccaaaacctnggggtttttttttnaaaatggggggggggggaaaancccccccaaaaaagggggnaaaaant

SEQ ID NO: 5399 - DNA, 791 bp, Homo sapiens
  misc_feature 2, 13, 23, 24, 524, 588, 641, 645, 650, 656, 687, 699, 705,708, 714, 718, 720, 722, 746, 752, 768, 772, 778, 783, 790: n = A,T,C or G
gngtctccctttntttgacatcnnttggctctcgctctttttgcaggatcccatcgattcgaattcggcacgagacctgagctagggttgcagcagaaattgagttgcagcttgcccttgtccagacctattttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattantttttattattctcttaaaaatcaaagatgatctctatcactttgccacctgtttgatgtgcantggaaactggttaagccagttgttcatacttcgtttacaaattattaagatancttntttanggatanttttggtaccatatttgtgaaaattttttgnaaaatgccttgntaatgnggntttttnaccncncnaagttattttgtttgcaaaacttnaatggnccattttccctttaanaatnggtttncaccntattttnt

SEQ ID NO: 5400 - DNA, 779 bp, Homo sapiens
  misc_feature 3, 6, 7, 27, 44, 52, 53, 54, 64, 67, 73, 87, 101, 102, 107,125, 136, 137, 140, 142, 148, 159, 162, 173, 176, 181, 183,186, 187, 193, 209, 213, 215, 249, 251, 261, 262, 286, 290,304, 315, 318, 323, 324, 333, 334, 337, 346, 353, 369: n = A,T,C or G
  misc_feature 371, 386, 396, 399, 400, 402, 403, 405, 408, 413, 433, 437,445, 452, 456, 462, 464, 470, 488, 503, 514, 528, 556, 565,567, 585, 596, 600, 607, 621, 624, 628, 636, 639, 642, 643,660, 677, 689, 695, 697, 699, 711, 717, 718, 722, 730: n = A,T,C or G
  misc_feature 734, 741, 754, 767, 768, 771: n = A,T,C or G
ttntcnnaaccttcaactcccgtgctnatgcaagatcccatccnattcgaannnggcacgaganacncttaantatacgctacggtntgtgtgtggtgctnnatacncaccatgttacttaatcnctttggtaccnnttncnttttgntggatccaaantgnaaaccgatgtntgntaccngnccnnatggtnttaacactttttaaantgananacattggatcttaaaaccctaagctattgcacancngcatttcacnnccgacgaagcccggtatcccctanacgntggggcactttccntaaattgaagntgncaatnntatgccggnntcnagatataangtgcacncccaaaaacgctttcngncttgtaaactcaacngcatagttangcnngnncntgnccgcnccacatggtgaaacattttncttnaccaagantaaatgnccanggtgcntnttaggnacacttactttctccggnacatccaattaacgntatttgcccgntgctgtgcctgggnagtttttattttatttatttggggttgnaaaagcagnancagagggagctcaatctngtttgaaaccnacgnagtgctnccattgatacgtanatnaatnaaccgccnggnggnntttttcttttttttggncctggaaaatgctgatnccctttgacaanaaaggnanancccccctagccnactaanngtcnccccattntttngggaaanaagggggataaanaacttcccccccnnggnggggagct

SEQ ID NO: 5401 - DNA, 1259 bp, Homo sapiens
  misc_feature 27, 31, 35, 38, 51, 53, 69, 70, 75, 79, 83, 88, 90, 103,114, 117, 120, 123, 128, 130, 146, 160, 163, 165, 167, 172,174, 189, 196, 197, 203, 206, 212, 218, 221, 226, 228, 229,232, 233, 234, 235, 240, 245, 247, 253, 255, 260, 263: n = A,T,C or G
  misc_feature 266, 267, 271, 276, 277, 278, 279, 284, 292, 295, 298, 314,315, 318, 327, 329, 330, 332, 333, 336, 337, 343, 344, 349,359, 360, 367, 370, 373, 374, 379, 383, 384, 389, 391, 393,408, 410, 416, 417, 418, 425, 426, 430, 432, 435, 436: n = A,T,C or G
  misc_feature 437, 439, 448, 451, 452, 453, 455, 456, 460, 466, 468, 475,476, 477, 481, 482, 486, 487, 491, 493, 498, 505, 506, 507,510, 511, 512, 521, 523, 524, 526, 530, 532, 541, 542, 551,555, 564, 571, 575, 579, 581, 595, 596, 601, 602, 607: n = A,T,C or G
  misc_feature 608, 612, 615, 620, 625, 634, 636, 638, 641, 644, 659, 661,672, 676, 677, 683, 685, 692, 693, 695, 697, 698, 700, 701,705, 706, 708, 712, 715, 719, 721, 722, 726, 736, 739, 742,745, 747, 751, 760, 776, 779, 780, 782, 786, 790, 804: n = A,T,C or G
  misc_feature 816, 822, 823, 828, 831, 833, 834, 840, 842, 844, 846, 848,849, 851, 855, 861, 864, 865, 868, 869, 871, 872, 880, 886,887, 888, 893, 896, 899, 901, 902, 903, 918, 923, 924, 925,927, 929, 930, 932, 936, 938, 940, 944, 948, 950, 957: n = A,T,C or G
  misc_feature 962, 965, 966, 967, 969, 970, 975, 981, 982, 984, 985, 987,989, 991, 993, 999, 1002, 1005, 1007, 1011, 1015, 1018,1020, 1021, 1022, 1028, 1033, 1034, 1043, 1045, 1049, 1050,1053, 1055, 1059, 1074, 1076, 1078, 1079, 1083, 1090, 1094: n = A,T,C or G
tttggaaagcccccttggcagggtgcnccanctgntgnacacccgaaggcncntcccagtttgggttannggacncgcngggngggcngnaagggggagagcnaaacggggganagngtnttntttgngnggcaggagcagggaanaggggggggggggnatnangngcggncnaaccggggaggaggnggggggnngcaggncgnacgacngacganagngggcnannagnnnnggccngcagngnagggangnggatnagnggnncggncgtgnnnnggagnggacgcgngcngantggacgatggaggccnnagnccagaggcngnngnnagnnaggggnnatgangcgcgacganngagcacnggngcnnaggcngcgnngccgnangngcggggagaagcggngngagacnnnaggcggnnccangngannngnggaaacagnggnnngnngagngcgggnancggatgnnncggnngganngggnanggggncaggcgnnnagnnnagcgagggngnngngagngnaggagggannaagcgcggngggncaaggacgnggacgangatntagngngggggaggaggganncgcgnnacggnnacgngtncgagnaaaangacgagggntngngcngtngggagcggcgagggncnaataggagaangggnntaaggngngcagacnncnanngnnaggnnangacnaancagngnngtgncatggcaganggncgncangngggncgggggcancagagacgcgatgagnggnnanagancggngacaggggggggangcaaacgcgggngagcannccagncgngnngggggnantngngnncnggtnaggagngannganngnngcatgagnataggnnngaganagngangnnngggggaaagggaccntaacnnngngnngngcgngncnacgnggcngngggggancccanggnnncnnggagncaaggnngnncngnancngggggngcnagntngggngggngtngnnngcgatnagggnncggcccggngncggnngcngnatcngaacggacaggcgcngnannaggngggcgcnagangngntggagngncacngcggngggnancgngngnncangatggcgaggggacgggtcgcgggnctgacgganagaggcngcnacgnnngaggcgtgaaagaantgnnggncgngggacnncnangagcaanggcaggagggcncggcgngcggnngcngnggccg

SEQ ID NO: 5402 - DNA, 807 bp, Homo sapiens
  misc_feature 4, 8, 9, 18, 24, 26, 86, 139, 140, 142, 145, 150, 152, 159,163, 166, 169, 173, 206, 208, 209, 219, 229, 235, 245, 249,252, 260, 262, 276, 279, 281, 289, 293, 300, 304, 307, 309,310, 318, 320, 333, 340, 342, 343, 345, 359, 360, 361: n = A,T,C or G
  misc_feature 370, 376, 383, 392, 398, 406, 418, 425, 434, 435, 438, 439,442, 455, 462, 469, 472, 474, 479, 494, 500, 509, 517, 520,527, 534, 536, 538, 540, 541, 548, 556, 629, 650, 665, 680,691, 692, 694, 705, 761, 764, 799: n = A,T,C or G
gatntaannttcaccttntgactntntgcaggatcccatcgattcgaattcggcacgaggaaagagatctgacctaaccaactttntcttgccttaacttccaaactgcccttagtcattgatggggcatgggccaacnncnatngggananatctttnttcntcntgnaatnatactcccctttccaaaactaaatgtccttgangnnataacggaangcctcccatngggtgnacaaccgggncggnaantgggctcncnctgtggcatagcanaangntccccggncgtngtggtgnacgntcnanntatccgcnanactcgccattgcnctagcgncnncnactttctttttatnnnctaacattntccttncgggaangcggttttnccggcnttaagctnttaaggatgganggggttnggtttccgnnctnnacnctataaaactctnttaactncaacacngtncnccgtngggaccccctcccantaaagnggggactgnttcacagnganggacccnttttttncncncnncctaatngattttcnccccaccttaatacagttaggaaccccttttccttattccatacaagaacttttttttaaaaaaacttgggancctcttatctacgccttgggngggtcacatcttgtnaatccccaacatttnggggaggctanngncgggaaatatnccttaagcttcaagagttcaagaccagcctggggaaacacttggaaaccgcttctntcnctttacaatttcctgatgccgggatttttcttttngcccttct

SEQ ID NO: 5403 - DNA, 1070 bp, Homo sapiens
  misc_feature 9, 12, 13, 31, 40, 216, 234, 247, 248, 255, 274, 332, 344,371, 397, 424, 430, 446, 455, 462, 469, 500, 554, 559, 566,568, 572, 575, 584, 616, 631, 638, 675, 679, 702, 709, 739,747, 761, 773, 774, 777, 795, 819, 843, 878, 886, 900: n = A,T,C or G
  misc_feature 945, 947, 950, 975, 1002, 1006, 1013, 1035, 1054, 1064: n = A,T,C or G
tatctatcntcnncatacaagctacttgcangatccctcnattcgttgaaactgaaagccaacttgaaaatggaggtatggcttataattcagctgtgctgaactgtaagtgattaaatactgtttcatcacatatacacatatatatacttatgtgggtatataggtcctggtctcattgacttaaggattttaagtggtggtattggccatatnctgtgggggggaaagctnagaacctcaatanncttaatnaaataggtggctatcatcngttcatttaactcaagcccagaaacaccaaagaagtcaccctcaatttcttcccgcanccccacaatttnaatctaatcggccattttctttaacanggttcccatttttcccaaaaaatatnaaccaatggaggtcccatcctaatttnctgggnttcttaacaagtccantcaaccccntaaggcnttaaagnccaccttacctttcaagttaggcccctcttncccaatttaagggcctttaagtttcaactttcccaagccccccttccctttccnaagtnggttggnanttcnacnaccaagatncccttggccaaggggtaaggttccaattttangaaaaaaccaattanacctttnaagggcccccctgggtccaaatttggccttcttggcntttnaaaaaaaatttttgggtgggggngggggcnttttcccccaattccaattggccctttaangaaaaatnaaaaaaaatccctnggccttttttcnntantttattttttaaaaaaanccaattgggggcttttttgggggngggccttttttaaccaaccaaaantttttaaagttcccttccccatttaattcccctcnttttttcnttaagccccctggnattccttggaaaaggggccaccccatttccccaaaggttttttantngtnggaaccaaaaaaaccaagccaggtnggaaaaccattgggggggggggtttanttgnaaaaccnccttacccgggagggggaaaancccccaaaaaccccccccntttttttttngggccc

SEQ ID NO: 5404 - DNA, 1321 bp, Homo sapiens
  misc_feature 4, 12, 19, 138, 171, 307, 404, 423, 441, 457, 497, 507, 532,535, 544, 553, 567, 619, 631, 637, 656, 682, 705, 710, 718,725, 744, 749, 761, 771, 826, 863, 871, 900, 914, 957, 964,975, 1006, 1018, 1022, 1033, 1045, 1051, 1055, 1074: n = A,T,C or G
  misc_feature 1080, 1092, 1118, 1128, 1136, 1176, 1210, 1217, 1228, 1238,1241, 1246, 1255, 1259, 1275, 1294, 1309: n = A,T,C or G
acgnaccttcancttccgncttttgcaggatccctcgattcgaattcggcacgagctaatgcactgcacagcatttgcattttgcagatgagtatcatctgggaaaatctgtctcaagatctggccctcccacgggantatgttggaagtaaccaagccttgcccttagangatgcaaccaaaatatttttgggtggatggggtggtgggaaaaaattcttgccaaaaaagaaagggtggatccctgggaaaccaattatttcttctttcaagggggaaagggaagccttggcctggtggttttttngggaaatggtggaaaaagaaccaaaaaaccttatttgaaaagccattggttggaatggaaaaaggtttccttaggaaaaaaaacccattggaaaaantttccaagcccccccttanttgaaaaaattccgccanccttggggttacccanccttggggggaaaaaaaattggaaaaagaaaaaccttttnaaacccttancccatttaaaaaaaaaaatttaggnaanggggggaanccaaggttnccaaaaaaaaaccnttttccaaccaaaggggggggggggggaaaaaaaattcccaaaaggtttttnaaaaaaattttnccaaanaaaggccctttgggggaanttttttaaaggaaattgggaattggnccccccattttttcctttaaagnaaagnaaaaaggnttttttngggccttttttttcctttnccccnaaaattgggccnttcctttaanttggcccccctttttttcctttgggttaaaaaaaaaacccttgggggcccaaaantttttttggggggggaaaaaggcccaatttccaaccnttgggggnaattaaaaaaaattttttaaattttgggnaaaattcctttaanttttccaaaggttcccaaaatttttccccttgggaaggggccnttttttnaaaaaaaaagnccttgggggggaaaaggaaaaaagggttggnaaaaaaccttanttcnttccaattggnaaaagaaaaagnttttanttgncccagaaaaaaaaattccnggggtnggaaaaccttcntttttggccttccttaaaagggcccncccccgttanttaaaaancctttgggaggttttccaaaaccttttcccctgggaattnaccctcccctggaatttttcttaccctggggggnaccaagnaaaaaaaaaanccccttgggnaanggggnccttttttncccnaattaaaaaacccggngggtccaaaatttcccccnttttttttaaaaacncccccccccctt

SEQ ID NO: 5405 - DNA, 1253 bp, Homo sapiens
  misc_feature 5, 19, 20, 27, 40, 41, 58, 99, 100, 125, 154, 215, 228, 237,245, 258, 288, 291, 304, 319, 349, 359, 376, 383, 423, 467,489, 494, 538, 555, 559, 560, 592, 608, 630, 653, 665, 668,687, 696, 700, 720, 757, 765, 769, 779, 789, 794: n = A,T,C or G
  misc_feature 804, 826, 848, 852, 876, 883, 894, 901, 911, 937, 956, 962,967, 979, 995, 1004, 1061, 1073, 1077, 1080, 1085, 1113,1119, 1122, 1127, 1154, 1161, 1167, 1184, 1189, 1205, 1221,1222, 1230, 1252: n = A,T,C or G
ttttntacatacttgcttnntacatcncagcactttgggnncttttctctccgagtcngaccgtgtgtgtgtgtgtgtgcgcgcgcgcggcgttctganncttcggtctttgttccggacccggnctccgccgcagccagcccacatgtcgggngatcaaagaaagcaaaaaagacgggtatggctttccaaggccgcccggcttttcccttccncccgcccaacccncaacttggnaccggccnccccttacccccncccaaaccccccccccaaaattttcccccnccnggcccaacctttnggggggttccccccnaaccccccttttccccccccggggttaaangggggggggncccgtttccaggggggnaaggggnaaaggggaaagcttaaaaaaaaaaagttttgggggggggnccaaaccgggggaagggggggggaaaaagccccaaaaggcaaangaaaaaaaaggaaagggggccnttccnttgggtggggttgggggaaaaaatttttccccccccgggggggngcccaaagattcccccntttnnggccccccccccggcccaaatgcccccccccntttttttttccccaancccccccccgggccgggaaacnttttttttgggggggaaaaattncctttggccggnccntttccccttttgggggggngggttaccngccnccggaccggccccccccggnccggaaaaaaaagaaaccccttttccccccggaaagnccttttcntttnaaaaaggttnggggggtttnccccngggaaattcnttatttaaattccccaaagggnaaccccaaaggggggaaccaangggnaaaaaattcccccccctttttttnttttttncccccaaaaanaaaaccntttttttttnccaaaaaaccccccggcccctttttnttccttttcctggtttaanggggtnccttncggggaaaaccnaaaaaattccgaaagnccttgaacnttcccccccgttttccttggcccaaaaggttccttggggtacccccttggggggggnttttttggtttntttnttnggggnaaaaccttttccccttttggggaaagtngggggnccnttttnaaattggaacccgggaccttttttccntttttgnaagggnaaaaaacttggccaaanttttntttcaaaaaaaacccnaaaaacctttggggtnnaaaaaaangggggggggaaaaaaaaaaaana

SEQ ID NO: 5406 - DNA, 760 bp, Homo sapiens
  misc_feature 10, 14, 16, 17, 20, 23, 106, 110, 150, 152, 181, 194, 222,237, 238, 242, 256, 259, 280, 286, 288, 291, 303, 322, 330,340, 349, 353, 362, 374, 408, 411, 419, 436, 438, 439, 446,460, 461, 472, 476, 483, 522, 534, 552, 555, 567, 569: n = A,T,C or G
  misc_feature 584, 591, 604, 612, 615, 623, 631, 636, 644, 646, 658, 672,677, 686, 689, 692, 702, 715, 749, 759: n = A,T,C or G
tataattaanttgnannccnttnaactcttgttctttttgcaggatcccatcgattcgaattcggcacgaggtgacccttcctgcccttcttgagcagcttgtganccanaagatgtgcctggagagaaagcctcatttggggaagtgcngnattcgaagttctttattttgaaaatgganaacaacccttctnacaaatcctgtctgcccttccccctttncaactagaatatcanntccnctgaacatgaagtnatncacatttcatggaaaactggntgatgntnaanaaatcacttganggcaaactttgtccttcangctgtggntctctgaatngtagagccngcanatcctccantgtatggactgngccttacttgcccattgaatgctttctatacatnaanacttgganctctttacagatgacantnnccagtgnggaagataaaagannagaaaagaccnaaantgcgggnttgccactcttttttgccatcaccgtggggactgcaaangccaatgttggngctggcaaaaagccgaangantaaaggtgctgnantgatgttagctgtgnccactgnggatttttccaanaacatttntanctataaanttcaaagnaaaanaaaaaaananactcgaggcctnttaaaactatattnagtcnttttacctnatncanacttgataanatacattgatgantttgggcaaacccacaactagaaattttcccaanaggggggggna

SEQ ID NO: 5407 - DNA, 890 bp, Homo sapiens
  misc_feature 6, 7, 8, 15, 20, 27, 28, 41, 54, 71, 77, 81, 91, 94, 104,129, 131, 155, 157, 161, 167, 176, 177, 180, 182, 187, 210,225, 229, 238, 241, 262, 286, 290, 313, 316, 334, 343, 352,359, 365, 369, 371, 376, 391, 412, 419, 434, 462, 469: n = A,T,C or G
  misc_feature 477, 480, 485, 489, 493, 519, 524, 534, 535, 546, 549, 556,574, 589, 604, 608, 613, 619, 621, 622, 624, 631, 637, 638,640, 645, 652, 656, 660, 675, 677, 685, 691, 717, 719, 723,724, 727, 733, 734, 737, 745, 757, 759, 768, 776, 781: n = A,T,C or G
  misc_feature 789, 792, 809, 828, 829, 834, 836, 842, 845, 846, 855, 865,868, 886, 890: n = A,T,C or G
tttttnnntttaaantttgnaaaattnnttttttttaccancccctttactccnggtttcctttttttttnggccangggnaatccccccnatnccggaatttnccggaaaattttcccggtttgggcntnggtccggcatatataaaaaccagngngagncccccnactatggannttntnccctngaatataaaaacaacaatccggnggggggaacggaagnagcntggcaattnggnatcgtaataaaaatacggtantcttgaagccccattggatggtcncaangggctggtgtggaagaaccttanttnagcaagaatccctaaaanggggcacanaacctttgnaaagganaaggangttntnttttncaaaaaaaaacccanactttggatgggcaaactttnaaataangggatgaacaatggnccagggcccacccctgggcttaaattancaaaacnttggcctntgnaaagncccngttncccttgggggcttctcttttccttcnatttntggaacccannacttgatgtcnttncaatcgnaactggtttaatggcccnattcctacaaccgcnaaaacttggttcctngaantgtantctgcngnnanaaaaacncctccnnantgaantggccanaaangtantgatcatacacaaananacaccttnaaattntaaccatgaacgcgattatattatgnanaganntcnttcggnnganattatgtnagggagccagantnctcatgctnggaatagngaccnacaaaacntgntcgagggacttattganattaatatggaagatacanngttcntntaccanganntggccacanagaacaatcnatngaccgaaaaatccggggngggn

SEQ ID NO: 5408 - DNA, 791 bp, Homo sapiens; identical to SEQ ID NO: 5395
  misc_feature 12, 17, 21, 46, 89, 399, 542, 657, 739, 748, 759, 769, 782,791: n = A,T,C or G

SEQ ID NO: 5409 - DNA, 761 bp, Homo sapiens
  misc_feature 14, 27, 29, 58, 59, 133, 188, 195, 246, 247, 334, 346, 347,415, 433, 437, 449, 491, 500, 505, 536, 544, 549, 583, 608,673, 677, 686, 688, 735, 741, 745, 746, 754, 755, 756, 758,759, 760: n = A,T,C or G
ttcatttaatcttnccctttggatctntntgcaggatcccatcgattcgtaattatannccctggagttatgcagctaattaaaggtcaaacgcataactttaaagacgccttttcaggaagagattcaagtnttacgcgggtgccactggctttttattatggaatgtatgcatatgctggctggtnttacctnaactatgttactgaagaagtagaaaaccctgaaaaaaccattccccttgcnntatgtatatccatggccattgtcaccattggctatgtgctgacaaatgtgggctactttacgaccattaatgctgaggagctgctgntttcaaatgcanntggcagtgaccttttctgagcggctactgggaaatttctcattagcagatccgatctttgttgccctntcctgcttgggctccatnaacnggggtgtgtgcngctgtctccaggttattctatgttgccgtctctgagagggtnaccttccanaaatnctctccatgattcatgtccgcaagcacactnctctacantggtnttgtttgcaccctttgacaatgataatgctcttntttgggagacctcgacagtcttttnaatttactcaaggttgccaggtggctttttattgggctggcaattgctgggcttgatttatcttngatncaaatgccnanatatgcatcggtccctttcaaaggtgcccctgttcatcccacttttnttttgncttnntttttttnnncnnnt

SEQ ID NO: 5410 - DNA, 787 bp, Homo sapiens
  misc_feature 2, 6, 18, 19, 37, 41, 65, 113, 503, 571, 698, 710, 767, 771,786: n = A,T,C or G
gntttnaaatttcctttnncttctaatcctttgcttncacnttggctcttgttctttttgcaggnatcccatcgattcgccaatggatgcagggaaaactgagatgggatttncccacgttgcccaggctggtctcctgagctcaaagcaatccagattgctgggattacagctgtgagccaccgtgcctggctgagatgacttttaaaaaaagacttctctaaagtagaaggaagggtggaattgtatgcacaagaagaaaaaaacctggaagaaaaacatactaaagaggctggagtgcaatggcgcgatcttggctcaccgcaacctccgcctcccgggttcaagtgattctcctgcctcagcctcccaggtagctgggattacaagcatgggccaccacgcctggctaattttgtatttttagtagagacggagtttctccatgttggtcaggctggtctcgaactaccgacctcaggtgatccacccacctcggcctnccacagtgctgggattacaagcatgagccaccgcgcccggcctccctgttcagttttctataatctgntcatattatattctgggtatatgtgggtggtgtgattatccatgtgggcttattttcacattctttgcattaactataatgtacttaatggttttaagataaagttcattctacaaagatgtatgtncaatacctggtntcaggtaacaatctttaaaaaaaacttaattcattttaaaaataaacattaaaattnccantccaatttaaacatnt

SEQ ID NO: 5411 - DNA, 787 bp, Homo sapiens; identical to SEQ ID NO: 5410
  misc_feature 2, 6, 18, 19, 37, 41, 65, 113, 503, 571, 698, 710, 767, 771,786: n = A,T,C or G

SEQ ID NO: 5412 - DNA, 762 bp, Homo sapiens
  misc_feature 97, 187, 226, 275, 444, 470, 495, 497, 507, 551, 600, 605,723, 734: n = A,T,C or G
tttaaaccttctaatcctttacaactacttgttctttttgcaggatcccatcgattcgaattcggcacgaggaaggacaaaaatatggctatctgantagatgcagaagaggcatttgacaaaatctaaaatattaagtaaagaagattatattagtccattctgacattactataaagaactgtangagagcagccccagtgcttatagataaaactcccatctncctaggacagagcacctggggggaatgggcggctctgggtgcagcttcngcagacttaaatgttcctgcctgccagctcttgaagagagcagcagatcccccagcacagcgctcgagctctgctaagggatggactgcctcctcaagtgggtccctgaccctcatgcctcctgactgggagacacctcccagcaagggttgacagacacctcatacangaagagctccgggtggcatctgccangtgcccctctgggacgaacttccanangaaggaacangtagcaatctttgctgttctgcagcctccgctggtgatacctangcaaacagggtctggagtggacctccagcaaactagagcagaccttcancagangggcctgactgttagaaggaaaactaatgaacagaaaggaatagcatcaacatcaacaaaaaggatgtccaccaagagaccccatcctaaggtcacccaacatcaaagaacaaagatngagaaaatccncgaagtttgaaaagggggaaaaggggga

SEQ ID NO: 5413 - DNA, 785 bp, Homo sapiens
  misc_feature 3, 4, 5, 8, 9, 31, 42, 109, 418, 471, 571, 601, 606, 653,670, 677, 703, 709, 717, 718, 745, 748, 760, 769, 773, 783,784: n = A,T,C or G
ttnnnttnnattccctttttgaactcggttncttgttctctntgcaggatcccatcgattcgttcgagtgcaagctccccatctttcgaaagtttccatggcaatacanctaactgaagaactaaaagccagtgatgtacttgccaggtttctcagccaagaaagtggggttgcccagactctcaagaaaggagaagtttttttgtatgaaattggaggaaatattggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcanttgtacccaagtatttaaaaatgactctcttaagccttaaaaagtcatagatntgtgctgctgccagaattatattaattattattaatggtattattagaaaaaaaatttctggagtgagaagtaaaaaggcttaattaggttgtgggccantttcatatgctctggtgaaatgtgtcccanatgtnacatagttttttttttaatatgtggaaatgtcttctcttcccattcntttctccctaaaaatcntatattnctggaaatataatgcctctttttaanctcttnttaccttnntaacattttaccccttttcccagttanggnttgcttttttgnccaaaaagnatanccaaattccnnc

SEQ ID NO: 5414 - DNA, 986 bp, Homo sapiens
  misc_feature 4, 5, 6, 12, 14, 15, 16, 17, 27, 30, 40, 58, 60, 65, 88,90, 98, 116, 125, 126, 133, 155, 156, 179, 183, 204, 216,220, 232, 240, 274, 292, 346, 374, 414, 417, 418, 423, 455,471, 540, 629, 672, 684, 744, 816, 881, 886, 889, 895, 897: n = A,T,C or G
  misc_feature 901, 911, 913, 915, 916, 919, 926, 933, 936, 937, 942, 945,947, 948, 951, 952, 955, 958, 962, 964, 967, 968, 969, 970,971, 981, 982: n = A,T,C or G
ccgnnntttttngnnnntttttgcaanttnttggaaaaancccccttttttaccaaanancctcncctttgggtttgctttttttttngnccaggggnaatcccccccatgccggnatttaccgnnaaatttnccgggggcccaccggaaggggnnaaaatggggggccccaaaaaagntttnatttaaaattttgggggtccntttttccaaagnaatntttttttttccnatttaatnggggggaccaaagggaaaaaacctggcacccccnaccggaaaatttttattnaaaaaaaatcccccatgggttgggggaaaaaaagggaaatttggaatcccccanaaaatccaaatggttaacctttccaaanaaaaaaatgggtaagaaaaaacttttattaaaagggaagnaannatggnggctttattcttcttcggatggaaaactccantatttttgggtggtanactctatttaaacaatttcggtcataaacacaaagacaaaccatggggtcaaaatgtgtcctttgcttntaaattctgccttcatttacttgaatgacctcagtgcttaggcagtggcctgtgttttagacctggtgatgacagctcccctcacctangagctgagcaccccggccatcttggtgaccacagaaccaaggncacaggcttcanctggtacgccctggggcaggggagaaaattgtgcttgcattcccaagtctgctccacctnctggtgaaggtctgtcgggcctggtcctgtccttggagccaccagcatcctcagacaaagaatctagacggngttgccaatttattaacagcaaataaccaattaaaatggagactattaaatactttattttcccncttanctnaaaaancnaaantttcccccgncnannggnggggcanaccttanagnnccacnaantnnggnngcnggngggnanggnnnnnaaaaaaaatnntcct

SEQ ID NO: 5415 - DNA, 804 bp, Homo sapiens
  misc_feature 6, 15, 20, 23, 34, 62, 104, 134, 144, 149, 203, 232, 272,313, 342, 353, 374, 387, 415, 418, 425, 430, 449, 469, 495,502, 511, 515, 534, 540, 554, 568, 587, 601, 603, 604, 610,702, 712, 765, 798: n = A,T,C or G
ccgttnatttcgaantttgnaanccctttacaanactacttgtgtgcttgttgtggcagggnaatcccatacggatttcggggaaattcaaaaaaacccaaagnttaccccaggaaaattaatgggtggttttntctttaaagnggtanaaaaattgggaaggggaaacctgggtgggaaaaaaaaaattaaggaaaaagggnggaggggggggtaaaaatccaattttccnttaaaatccttaaaatttaaccccttaaaagccattaagnaataccttggggttaaaataatcctttggggtattaatggntttttttcctggggtcttttggtttttangtctggcatgngattggttttaaccatccttntattagctctctnaatgctgcctatggttatatttccatgntcntatattntactnccatgtaatatatattatncatattacctatattgaaanggaaatgcttatatattcatgtcaangtaatgntatcctctnctgntatgattattatttgcctnaacatnttgattgatttatntaaccctgtgctanattgggaactacttctctnctatagaccttaanannaacatngctttatcaagattttattcagtgatattttaaatgattctgcctgtaggcttgccagacaaattagtgtccaataatctaatgaatgttgnaagtcatgtnggattatgaattccattattttactaatttacttgaaaaacatgattcaaaanattgtttttgttgtttgggttaaaaaaaaaatntaaacc

SEQ ID NO: 5416 - DNA, 793 bp, Homo sapiens
  misc_feature 14, 18, 43, 107, 110, 223, 243, 262, 305, 329, 431, 446,472, 541, 578, 597, 601, 610, 641, 644, 662, 667, 668, 670,676, 679, 688, 689, 692, 706, 714, 726, 727, 748, 751, 757,760, 762, 773, 784, 788, 790: n = A,T,C or G
gtgaatccttttcnaatngcttggctactcgctctttctgcangatcccatcgattcgaattcggcacgagggcagctagagtcaggaaaatgaccctcatatgctnttnatctttgtttcagttgtctgtcagggttgaattaagaagctactggtttattcccaattgttgatgcctttaggtatgttggaatctttttttttgcctaggaggggccagtngaaaatctgtgactcaagangcagtgaacagaatactgntttctggggaaaaattggttggctacttgatgttaattatggnacagtaacaggaaaaggttgtgtntgtgtttttaagtaatgtctttattctgcttttttgctgctataagagttttctgaaatttatattttaaacttttcatgcactttactgtttctagtctcnaaatgtgatattttnaatcaacaagaaattttccattatgngaatgaaattttaaaagacaatagcctatatttgtgtctcactaatatataaagtataggtcaaatttnaattatttaattagttttaaatatctcaatttgtctnctctttcaaacctgacatnttcngctggtttnttaagtcctaaaatgatgcattttacctttnggncaatttcaattgcctaantttcnntnccatangtnaaattaaanncanggcttattattaangggtaatnattttcccccannaggggtaaatttttaatgggngancaaagngtngntggggattgangtcttttcatnccangnggg

SEQ ID NO: 5417 - DNA, 756 bp, Homo sapiens
  misc_feature 2, 3, 7, 13, 18, 310, 332, 599, 617, 689, 699, 725, 755: n = A,T,C or G
annatcncttttnattcnatcagctacttgttctttttgcaggatcccatcgattcgaattcggcacgaggtattcttcttctactggagaaggtaccgaaaaagaatttgatcctctgattgcctagggttttgagacatgagaaataatgtctttgatctggttttgagaaattattgcatattttattttaagtgcttgctgcctctgcctttccccttttgctcctcaaatatataaagtaagtagcctgcctacaggaggactgttaaaaatcatatcactagattaaatagaattaaaaaaganacaggaagattgaagatgtagnttaatatatgtatcattaataatagaataaatacaagaacataatgggtgagaaatttatttcttaataaaaatttctgagactagacctttcaacatttagttatacatactttaataaaaatctatcatagtaaatttataatttttggttgagtatgtgaataatccttctgcgcattattggcctgttataaatctttcaatgaattgtgggttggagttaaattcatattgtgctgaatttacaaaatttaacagtttgctntaaacgttttaaaaattntctaacttagcaccaaatccccccatacctttgtgtgtgtgtgtgtgtgtgtgtgtgtgtatgcctgtgganaaaaagtccngagatcttatttctcatttaaaaaangttagcaaaaaaaaaaaatttttttttttnc

SEQ ID NO: 5418 - DNA, 801 bp, Homo sapiens
  misc_feature 5, 7, 9, 14, 87, 89, 94, 152, 195, 224, 226, 246, 278, 319,328, 338, 340, 362, 368, 377, 394, 405, 416, 444, 450, 467,475, 479, 485, 499, 505, 575, 585, 602, 620, 631, 668, 689,706, 714, 721, 730, 733, 756, 791, 795, 801: n = A,T,C or G
atatncntnataancctttcaactacttgttctttttgcaggatcccatcgattcgcaagagcaagggtggagggggacagattgtntngtccnttaaatgtgtgttgacacacatgggcttcgggttagctggcctgacatggagatagantgccaatgttcccaagcccacagaattatggaggcctcacccncagtattcacagctctcaactggcctttnanaatggaaaccttttctgccntggatatggcgcttcttctgggagaggagcanagccacagagaggtaggaagttgaggcatagcaaagggaangcttcagancttaagcccngntcatctcatatgtgttttctangcctgnggctgaaangaagaggagtggggcancctgggacggnaactgcctctntgggctccccactcccatggaggggctncataanctttgctcctgggctgnatcttganaagngggcanggtcttcccaccantggcanggtgtgcagttgtggtcccaagccttggagggaatggggaatgggctggcaccctgctcaaggaaagcanaagcacacangtgccccaacaggggancttcattgcccccaatanttttaaaaaangcaacccatcacttaaggcttgggtgcccttttcggnaaaaactaccaaacttggaancccctcccggctttaangcccaacnaattttnccctggggnacnttcccttgggaccccccaagggntttcctttaaccaggccaaaaaaaaaaaaaaaaancccncccccn

SEQ ID NO: 5419 - DNA, 895 bp, Homo sapiens
  misc_feature 2, 5, 9, 11, 125, 134, 143, 160, 163, 172, 175, 176, 184,188, 189, 190, 191, 193, 198, 205, 212, 214, 215, 219, 221,222, 228, 232, 239, 241, 244, 247, 254, 255, 257, 258, 261,268, 274, 275, 279, 295, 297, 301, 305, 311, 316, 327: n = A,T,C or G
  misc_feature 332, 339, 341, 342, 344, 345, 352, 353, 354, 355, 358, 366,369, 377, 378, 396, 398, 401, 412, 420, 424, 427, 442, 450,454, 457, 466, 479, 498, 503, 504, 514, 526, 537, 560, 561,576, 585, 609, 616, 624, 625, 640, 641, 667, 673, 682: n = A,T,C or G
  misc_feature 692, 695, 707, 708, 726, 744, 754, 773, 804, 812, 818, 846,847, 861, 864, 873, 892, 894, 895: n = A,T,C or G
cnttnttcnanttatccttcaactcttgttctttttgcaggatcccatcgattcgcagaggctgaggtgggaggatctcttgagcccaggaggttgaggctgcaatgagttgtgattgcaccagngtactctancctagacancagaggaataacctgtntcncacgataangannttcatcanttannnntnataanaattctntcagtgncnngaangnngacacngganctccctnancanganggacatnncnncanggccatnttacgnntcangtgccatacataaagngnatgntggnttgagnttacnaccacactacngaaanatttgcnannanncttatgnnnnatnctttaatnttntccatgtnntgcttccacgcattcagncnatngtgtgggtctnttaaatgnctgnctnatttcttactcaaanggattacnctanatncaacaattntttgaaatggggngcttaatcgattttaatgngaggnnattttacctnatggtcttgganggccacctggnttccttaaagtggccttttgatnnttttaaattccaaanttaggcccntttttaaaataaggtcccaatggnaaaaaantttccttnnaacttttaaacgttnnccttaatttttcttaaagcccccctnaatttnttcaccccngaaggggaanggnaaaatttggggnnggcccattttttattttnggggaaacctggccaagngggatttaanatcgggggggaatcccccncctttttgggaccctggagccaattttggcntttaaccnaaggtntttatccgccccacttttctccaaaaannttaccccccaccangtnttcccaaancctgggggttttttttttntnn

SEQ ID NO: 5420 - DNA, 719 bp, Homo sapiens
  misc_feature 5, 6, 14, 50, 52, 59, 65, 68, 69, 79, 82, 86, 91, 101, 102,111, 129, 138, 152, 153, 177, 184, 193, 201, 228, 237, 243,264, 274, 280, 281, 282, 285, 292, 307, 317, 319, 325, 328,348, 369, 380, 381, 396, 444, 460, 491, 494, 521, 533: n = A,T,C or G
  misc_feature 536, 540, 543, 544, 551, 553, 568, 579, 584, 594, 614, 643,647, 649, 651, 664, 665, 670, 682, 691, 709, 714, 715, 717: n = A,T,C or G
tatcnnttattctntaacccttgttctttttgcaggatccctcgattcgntnatgtatnaactantcnnatatgttttntancatncttantatccttgcnngcattatgnggattcagggtcaacttntcagactgngagcctgagagttnntctctaagaggctccacacctttnttgtctnttagatcgnggccaaantgagatgaaaactaactcttgagaaanaaaaaccancatgcnttaactgatacaccgtgttgncttgttcatncacagnnnatncagcgantaccaacatccacgntatgaaatgncnccctangtntcttattctagcaactgccnggcaccacaaccatggtaacnttggggagacnnaggtctttcgcttanaggatgacacgccaagtttaacgacgcagttcctctggaaagatgacntgtgaataacagaccncaagggttgcctctcgacccagcctgttcangantcacaagctctttaatgtcatgtaacnttccatatcatnttngagnggnncctgtgngncacaccctgtgaagngtgtatatgcntcctncagtgctggntgcttaattcttctgcattnaaatgtcctgaccatcttgaaaacatcantgananantcctgtgcatgannggatnctaagggctatntatgatgcntttttaaactcaatgggngtttnncnaa

SEQ ID NO: 5421 - DNA, 726 bp, Homo sapiens
  misc_feature 22, 37, 90, 98, 296, 313, 344, 375, 403, 406, 427, 474, 523,557, 563, 570, 574, 600, 617, 627, 628, 640, 641, 671, 677,682, 684, 693, 710, 717: n = A,T,C or G
gagcccagaatgaacatgcggnccccccaagttatcntgtgatcccagggtttcaagatagacttttgagtttttcacagtctgtcttanctcagcangataacttgggacttcagaaacagttggatctacaaagagaagttctgcattatagccagaaagcccaggaaaaattgcttgtacagagacaaacagcattgcagcagcagatacagaaacatgaagagactttgaaggatttctttaaagacagtcagataagtaagcccacagttgaaaatgatttaaaaacccanaagatggggcagctcanagactggtttcctaatacacaagacctagcnggaaatgatcaagaaaatattaggcatgcanataggaacaactctgatgataatcattnggnttcagaagatactagtgccangctaagttggtgagcatctgggagaaagatctggggagaagatcctncaaagccacctgtagcaaaagtcaaatgtggtttggaccttaaaacccngcattgaacttaagtgcttttccaaggaagttanaagttnccagcanattnggcaggaactttctataccttaggtnaaacccagggtattttntggaagaacnnagtcccccttgnnaagtcttcaattatatccccagtaaccaanggtttnttttngngaaccccantggccccttgatcccgnttcaaantggcttttc

SEQ ID NO: 5422 - DNA, 1071 bp, Homo sapiens
  misc_feature 6, 10, 15, 22, 23, 32, 44, 47, 50, 60, 100, 102, 109, 110,137, 145, 164, 169, 184, 216, 217, 218, 240, 254, 332, 368,402, 406, 434, 466, 582, 589, 708, 877, 887, 923, 958, 970,985, 1001, 1025, 1038, 1071: n = A,T,C or G
tttttnaaanaattncccaatnntttttggtnaaaatttttccnccnaanttttccaagnaacccttaaccttttgggtttttgccttttttttttgggncnaaggggnnaatcccccccaattcccgggaattttncccggccnttccttgggtttggggggnaaggnaatttgggggggggnaaggggggggggggggcccccttaatgggccnnntttcaaattgggcccttttttnctttgggttaaagnttgggcccaaaaaaacccccccctttaaaaacccccattgggttggcccccaagcccaaccttaaagcctttaaggtngggaaggaatccttaaacaaaggaatccaatccggncccttccggccccttcaattttaaagtcaaaaanggcnttcaaacctttcttggctttccacaaangtcaatctttttttggttcacttcttctggtnaaaataaatcaaactcacgccctcaaagttcttgttgtgggaagtttgagggtgacaaatatttcaacaagaaatttgatgcccatatgggaaaatcccaagctagctttttgtancaagttncaaaaatcaaatatttcaaaacagaatgagaagcttactatcgtggtgggaagtacaaggctttggtgttaaacaatcctgagatggaatttcatctcttcctaaattagaagctgcanaagacctagtcaaagtctgaacccttatgagctttcgtttcctcagctgtaagtggaactaataacactgaatttgatgaagttggttatgaaggattaaattggacaaaatgggaagtgtgtagcatctatggcacatagatgtaaaattaaataaagaatgggacanggtgctattnaaaaatatttaccttggcccggggtggcaatgggcntcatgcctgtaaatcccaaaccagttttggggaanggcccaaaggcngggtgggaatcaacnttgaggggcccaaggnaagttcaaagaaccagctttgggnccacccattgggntggaaaaccttcaaaattccccttttccccttn

SEQ ID NO: 5423 - DNA, 1052 bp, Homo sapiens
  misc_feature 2, 156, 171, 184, 188, 210, 244, 293, 430, 442, 443, 508,530, 556, 563, 577, 589, 594, 600, 608, 614, 618, 622, 633,662, 705, 729, 762, 796, 800, 811, 816, 845, 867, 925, 931,938, 949, 958, 961, 1021, 1026, 1038, 1039, 1042, 1046: n = A,T,C or G
  misc_feature 1047: n = A,T,C or G
tnttcatcagctcttgttttatgcggaccctcgattcgaattcggcacgaggctttatgtatcattaaatttttctcatagttcagaaaaaatgtgccaaagggaaactattggctcctccttcaaaaacagtcttaattaactttcattatttanccggattaaaactanccagaagcagggntcanggggaaaattaaaatggatatnggacccctaaattgtatcattctgagttgattgngtgggttattcattctggaaacatgttgatacttacagtcaaccactgntttttgataagtgatattgattaaggttgaatcttctttgtaaataagtatttacccagttagcaaaagtctgtgttttcaagaattaccagtgagcaccaagagggtgttcattaaaaatgggggaaattgaagtncccacttccggnnaagaaagttggctttaaaaccttggaccacttggtttggaacaatttttgggggccttgggaatnaaaaaacccccctggttggggnggggggggttccttggttggccttgntggccanttttggccaagggnaattggggttgnaaagnccaaancccggttncccccnttcnttcnaattggttggnaaccaaacccccccaaccaaaggttttantttgccccccggggaaatgggttttggcccccaaggaaattgnccccccccctttaaaggggggggnaaccaaagaaaagttccaaaaaccccccccccnaaaccttggaaaggggaacccccaccttgggttncccnttaaccaaggnaaagntccaaggggaaaaaaataatttgggtaangggggaaggaaaaaaaaaaaanttaaacccaacccaacccaaaggggcccttggtgggttaaatgggtttaaaattaggnatgganaaattanttgggaaatantggtattanttnaaatgggtttaaaaaaattggtaccctttgaatcaaaaggtacctttttttattaaaacnttggnccctttttttannggnaaannttttt

SEQ ID NO: 5424 - DNA, 761 bp, Homo sapiens
  misc_feature 7, 22, 219, 489, 518, 536, 565, 595, 625, 673, 691, 723,730, 738, 741, 748: n = A,T,C or G
ttaatanatccttgtattggcngatccatcgattcgggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctatcangataacccattcaggtttctttactcgatctagatcatgtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcntaggcttctttcagtctttatgtcacctnaggagacttatttgagangaaccttctgtacttgaagttgatttganatatgtaagaattgatgatgtatttgcaancattaatgtgaataaattgaatttaatggntgaatactttcaggcattcacttaataaagacactggttaaccactgntatgctcaatcatacccnctaaaaggtacaaatggcctttttacctaatnctaattnaaaaattnccngactggnggtaaaaaaaaaa

SEQ ID NO: 5425 - DNA, 780 bp, Homo sapiens
  misc_feature 1, 4, 5, 6, 7, 9, 13, 16, 17, 20, 25, 36, 66, 120, 123, 136,274, 289, 321, 380, 395, 403, 412, 418, 428, 479, 499, 538,544, 551, 568, 570, 571, 581, 605, 612, 619, 633, 648, 656,662, 673, 678, 683, 692, 710, 713, 777, 778, 779: n = A,T,C or G
nttnnnnantacnatnncangcctntgtactgcgangatcccatcgattcgaattcggcacgaggnaaagccatctttgcattgatcctcatccgcctttttgctcgccgcagccgcctncgncgcgcgccttctncgccgccgcggactccggcagctttatcgccagagtccctgaactctcgctttctttttaatcccctgcatcggatcaccggcgtgccccaccatgtcagacgcagccgtagacaccagctccgaaatcaccaccaangacttaaaggagaanaaggaagttgtggaagaggcagaaaatggaanagacgcccctgctaacgggaatgctaatgaggaaaatggggagcaggacgctgacaatnacgtagacgaagaanaggaaganggtggggangaagangaggaggaanaagaaggtgatggtgaggaagaggatggagatgaagatgatgaagctgagncagctaccggcaagccggcngctgaagatgatgaggatgacgatgtcgataccaataancagacnaccgacnaggatgactagacagcntnnaacgaaaagntaaactaaaaaaaaaagccgcttnacctatncaccctncactgccgtctcanaatctaaaccttggncccctttnaataanaaaaggcccgnccggncaacngtgggccantgccaccccgaagatganacncgcttttcaacacccaacccaaaccttgaggaatttggaacaaggggatggaaaaaagaacccnnnt

SEQ ID NO: 5426 - DNA, 756 bp, Homo sapiens
  misc_feature 3, 10, 21, 22, 27, 98, 192, 628, 698, 747, 748, 756: n = A,T,C or G
aanaatcctncctcccgtttnnattcntatacaagctacttgttctttttgcaggatcccatcgattcgaattcggcacgaggccttgagggaattanacagattttctgttttgaatagccaacacatgtttgaagtactagctgccatgaatcaccgatctcttatactcctggatgaatgcagtaaggnggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttccctggctncttttaatcagcttctgcaaaaagacatcatcagtgagctgctgacatcagatgacatgaagaatgcttncaagctgcatcttttggatactgtctaaaacttgatgataccttggggnncccctttn

SEQ ID NO: 5427 - DNA, 751 bp, Homo sapiens
  misc_feature 4, 33, 126, 127, 307, 325, 551, 572, 585, 590, 718: n = A,T,C or G
cttnttacatctctctcgttttattcgataccnctacttgttctttttgcaggatcccatcgattcgaattcggcacgaggagaacctaacaaatgaatgtggtgggtaaggaagagaaagaagtnnagatgaaatttccactctgctggggaaactaggtagatagatgatcatgaagaatctgaggaagagcagaagtcgtacaggtaagaatgaatgcattcattaatttattcagcaaaactgcctgaagaataccatgtgcagcactgcgggacaaaacagggcttgcattcccaggctgtnctcttgtgaggacaacangaaggaagttgagaaacacacaagaacaatgctaagatggggaaactccatacgctgcgggagcacatacagacaaagtccaggtagggctcccggagaaagtgacatttctagtgattcttcaagtatgagatagtcatccacgcaaagagatggtagaaaagtgttttaagcaaaacaacaaaatgtgcataggctcagaggcctatctgattttctatggcangctgggctttcatcggcaganaggatggtcttantgaangaagctttgttggttttgttttcgtttcgtttgtttaaatggtcatacaaagtttttattggctaccttgcttcaagaaaaactgggccaatgatgaggtgatcatttctattaatagtttcattacngtcctgtgtcattggggttaacccaaaaaaatt

SEQ ID NO: 5428 - DNA, 757 bp, Homo sapiens
  misc_feature 5, 7, 8, 10, 25, 30, 41, 43, 44, 54, 87, 95, 148, 188, 200,212, 234, 245, 256, 273, 278, 279, 280, 283, 305, 319, 345,385, 401, 407, 419, 460, 492, 496, 501, 523, 552, 554, 558,561, 576, 577, 579, 583, 612, 622, 631, 648, 649, 677: n = A,T,C or G
  misc_feature 692, 704, 713, 715, 725, 743: n = A,T,C or G
aggancnntnaactcctgccagtanagaanacaagctactngnnctttttgcangatcccatcgattcgaattcggcacgaggtttngccttgtnggccagactagttttgaattcctagcttcaagtgatccacctgcctcgacctnaccatcctagattgtaaaccttgaaattttctagagctgnctcccagtgacnttaacttactgngtggatctgccttgctgccctnacttttcatantctcaccccgncctcaccacttccttgncttcnnntgnactggcttgtgtttacaacatnggattaacagctgnaaggtcagcaatgaattcccaaatangcattcagcacctattttcagcccttcttaatttttctgngacattcgtacctttntaaagntcttttcttggntctgatgacctgagatatcttgattttcctacctcattggnatcctcaactttcttcctctggctttgccatnttgntcctntctcctcgtattcattgggggncccatctgccctctgggaaagttcaacananggtntcnatacctactccgcgnntncaanggcccgcctaatgaatataaatgctccanggcaccaaancacaattcntttacaatgcaatccanncccttctcctgacttttcttggcaattntactaacctaactcntggttggcttcnaaaactggntnaaaatggaanctacctgctaccccaaantggggaaagggccc

SEQ ID NO: 5429 - DNA, 825 bp, Homo sapiens
  misc_feature 7, 8, 13, 16, 17, 30, 36, 39, 41, 49, 59, 63, 65, 70, 72,75, 85, 93, 99, 108, 121, 129, 132, 141, 147, 149, 150,155, 156, 158, 162, 179, 180, 183, 201, 218, 219, 242, 243,250, 251, 256, 258, 262, 263, 265, 270, 273, 274, 280, 293: n = A,T,C or G
  misc_feature 297, 298, 300, 305, 306, 308, 315, 328, 336, 337, 341, 342,346, 347, 348, 355, 359, 371, 382, 387, 388, 389, 394, 402,410, 411, 418, 420, 424, 425, 430, 431, 433, 443, 449, 450,451, 455, 459, 464, 481, 486, 487, 489, 491, 492, 493: n = A,T,C or G
  misc_feature 495, 499, 509, 520, 530, 536, 549, 550, 552, 554, 573, 575,577, 589, 592, 596, 602, 605, 608, 615, 617, 618, 623, 625,630, 632, 643, 645, 646, 650, 662, 674, 678, 679, 685, 687,688, 693, 703, 713, 724, 728, 729, 755, 757, 769, 776: n = A,T,C or G
  misc_feature 777, 779, 805, 806, 814, 816, 825: n = A,T,C or G
ttatccnntaccnaannaacccttgcaaanccgcgnccngncggagacnctagaggacncccngntaccnanttnaatgggcacnatagggancctttnaccgatgangtgggcgccggtntacacccnatntactgtgantatatngnnttgtnncncggnggcatcacagcattctnntcnactatttcggggccaaantgagacgtggaactgannccctcttactacaacacaacttnnattcacnncatcnangtcnntngccanagnngagggngcatgaaacactnatcnnangattnncnatatganaccacgcggtaangtttctgnngctnngacnnnacaggcnctcnttcaagtgcttncaccagcagtngaagnnnggtgncccgcctnctccgggnnggtgacnantccnncaatnngnacacgggttncctgtnnntacnagancactnacttcatgccagaaccngcatnnangnnntnatgncgactctgtnccttgttcacnatgtactaanggcttnttttacttgtcgnngncncgtgggaacaatagtcttnantntaggggataccnttngtgnaaatancanccnatcccananntgaancntaacntntccgggccttnannccantccgggttaatnagcggaatttgntggnngcactntnnccccncacctagttncaacgagganctacccggggnttanncccaggcctttcccagggctgaattncnaaggggggcttntggtaanncnaagggaggttttccaaaacttcgatnngggggggngnaaccccccn

SEQ ID NO: 5430 - DNA, 1546 bp, Homo sapiens
  misc_feature 5, 11, 15, 18, 23, 28, 33, 52, 57, 66, 67, 70, 72, 78, 84,88, 95, 96, 101, 102, 111, 112, 115, 124, 126, 127, 128,133, 135, 137, 138, 140, 142, 148, 151, 155, 157, 160, 165,170, 171, 173, 176, 183, 184, 185, 189, 201, 210, 211: n = A,T,C or G
  misc_feature 216, 219, 227, 239, 240, 241, 253, 254, 255, 257, 262, 267,269, 270, 277, 282, 286, 290, 294, 297, 299, 306, 307, 309,312, 313, 317, 318, 321, 324, 326, 329, 335, 336, 339, 340,341, 349, 351, 356, 357, 360, 367, 368, 369, 370, 373: n = A,T,C or G
  misc_feature 374, 375, 376, 377, 378, 379, 381, 382, 383, 387, 397, 399,402, 403, 407, 409, 412, 413, 415, 416, 417, 418, 421, 423,424, 426, 429, 432, 436, 437, 438, 440, 442, 443, 445, 451,455, 458, 459, 464, 465, 468, 469, 473, 474, 480, 482: n = A,T,C or G
  misc_feature 483, 488, 491, 494, 498, 499, 501, 504, 508, 512, 513, 518,519, 520, 521, 524, 530, 531, 539, 544, 546, 547, 549, 551,552, 557, 559, 563, 565, 566, 567, 568, 571, 575, 580, 583,584, 585, 586, 587, 589, 594, 595, 598, 606, 610, 612: n = A,T,C or G
  misc_feature 614, 615, 619, 629, 630, 632, 633, 634, 636, 638, 643, 653,659, 661, 663, 665, 669, 673, 676, 681, 686, 687, 688, 690,691, 692, 694, 697, 698, 701, 704, 707, 708, 710, 717, 718,720, 721, 723, 732, 736, 738, 739, 750, 755, 758, 759: n = A,T,C or G
  misc_feature 761, 768, 775, 778, 779, 789, 790, 796, 799, 803, 805, 806,808, 812, 813, 818, 823, 824, 825, 830, 831, 834, 838, 839,851, 856, 858, 861, 869, 875, 877, 884, 886, 887, 888, 889,893, 902, 905, 906, 909, 913, 918, 919, 920, 925, 929: n = A,T,C or G
ttttngggggnaatncanacggnggganaacancccctttttttgggggganaaaanccccccgcnnatntntagcgncagcanctcnacagtanngggtnngagcacatnnatncgagggagngnnnttgantntnncncnctacgnagntacntnagnacagngcacnntnagntttgtgnnnccgnttttttttatgncataagccnnccgcnganatacaatntggcgcagacgnnnaggtgcggcggnnnanagtgnccagnannaggcgcnggggngcancagncgcnagnancgcccanncnccnnctannagnganancgnatcggnncgnnnagaggcantngtcanncgncgcgagnnnnagnnnnnnntnnncgangccgacgaananagnnaggngnccnncnnnnagngnngnagncanaaannnantnncncaaaanaggnagnnagagnntgnnatanntgcgcncnngtgantanccnaagnncnacntccncggnncccgnnnngancaggcnncagaaggngcccnanncntnnataananactncnnnnctnacanaaggnacnnnnncngcacnntgngagaagangccncngnnaggnacacccgganngnnnananaaagnccgggagcanccaacngnantncacntcgnccncgagnatgannngnnncngcnnatntcnccnncnaacagcnntnncngactgaagngtcngnnagccgataatngaacngcnncntactgcnagccgantgnnccccgcgatnncgctanatncgtntnnangcgnntcagngcgcnnnctcgnncgnactnnccatcacgcgcntacantnatnaccgcgangcgcgnangcgccangnnnngcanacacgacancgnngtncacncgcgnnngcgangganccgncncgatnganacgagagctacangagtatagcgacgtcatancgngagnganatgacgantgactntagngcgnacnncnnnngngctncgacncgacactntgagncatcctngannncgnnagcgantcntcgtganacanacgcgcnantncncacgngagannaganggcangcacgcnatcgncgcagctacgancgnngatgagnnntnggangcgacgcncgcntgcagcgcangngacggncntgntgngcgtngtgcncnantangaancncagcgttanancgngatgaagganntatagacagnaccnactggcgacnaagcaaagcangatagactgtgacgcatgacagacggtngagggtnngatcgnncacagcacgcgcggccacanacgtacnnnantagcatcaganncnacagaacncgacagannacagacanacttgcatngngngacgananaatantcncnccacgcacagancagacgagtacgcatgagcgtngngcnngtgannnananatgnagaggcanacnnagntntnnanaancgctgtnannntacncagcgnnngcaganngngcgcncacngnngcnnt

SEQ ID NO: 5431 - DNA, 1003 bp, Homo sapiens
  misc_feature 17, 18, 19, 20, 21, 23, 31, 33, 44, 45, 51, 52, 63, 72, 75,80, 86, 89, 94, 96, 97, 99, 100, 122, 129, 130, 132, 136,147, 152, 156, 175, 176, 180, 183, 185, 186, 191, 196, 197,213, 214, 221, 229, 231, 234, 240, 244, 245, 248, 252: n = A,T,C or G
  misc_feature 257, 269, 277, 281, 282, 284, 289, 298, 299, 301, 317, 320,321, 322, 327, 338, 339, 347, 350, 355, 358, 360, 373, 378,397, 398, 403, 411, 434, 447, 460, 463, 474, 488, 493, 498,513, 518, 531, 533, 536, 539, 544, 549, 556, 563, 583: n = A,T,C or G
  misc_feature 595, 597, 604, 612, 620, 623, 627, 634, 636, 639, 642, 644,654, 660, 662, 664, 665, 670, 681, 682, 687, 693, 696, 698,711, 715, 725, 730, 745, 746, 751, 756, 776, 797, 798, 799,802, 811, 828, 833, 836, 844, 845, 856, 858, 859, 877: n = A,T,C or G
  misc_feature 882, 885, 890, 897, 907, 909, 911, 917, 925, 934, 935, 938,948, 955, 965, 967, 971, 973, 974, 976, 991, 1002: n = A,T,C or G
tttttttgaaacctttnnnnntngaataccnanacaaactctgnntgtctnngcgggatcccntcaagtccnatncggcncgagcncanctttntnnanntgtcgcgtctgagcccatgagncacgacnncnttcnccggcgcctgnattgncatntctcccaaatacgtggctnntccncantnngaatnatcgnnatttttagtgccagannattggcnataatgtncnccntgaganaaannctnctgncatgngaaaccatcttnatacttgncgtnncnaaatncattgtganntntgaaggggaacgggcnctnnnaaagngatgaatttcnnataacttnacnggttnatnangaatgattttgcncacanccggaaaatcaccccactnntttgnttcaagantgggcccctaacgggaggggtantagaggcaaaccntctttgcgggctnttntatttcctttnttcaaacaccaatntttgntgaanaataacagtgttttnaattnaattaccaccgcntncantgngattntttgncccattncaaaggntgggtcaattcccctaaaanaattgggaaaanantaatttnccatttcntttttccnttnaaangaaaccntnccntgnanttaaaaaaanattctntntnnttccncaaattttttnnttttnaaaccnctnancggctaaccaggnccgnttttcggtgnccctntttattgttggccanntaaanccccnttttaaaaaaattggccttnaaaaaatccttaccatttttnnnaancctaaaaanggattaaactttcaaanccgtnaantaaatttnngggggttcatntnnctttgaactccccctgcntcccntanaattngaattgncacattggtngnanccaaantatggatntttcaagannaanactgggcttncaaatgncttttttcancnaatnanntnatattgccattttgnggccccccccnt

SEQ ID NO: 5432 - DNA, 997 bp, Homo sapiens
  misc_feature 5, 6, 12, 25, 31, 33, 188, 453, 552, 578, 615, 663, 667,672, 688, 691, 732, 784, 787, 811, 815, 845, 852, 857, 870,879, 919, 926, 962, 969, 995: n = A,T,C or G
taganncctctnctcttgaagcccntcccancnactcgaattcggcacgagcaaaaaaaaggcttttccctgatttccagaatgtactgggtggtgtccatctggtcttgggatggtgtaagcataaggatttattgaatgaaagtatgaaagtgtggtttttatttgaaagtcaaatatttggcagntggtgttcatttattctataaactttcaaaacagatgacaagttttaaggaaatgggggccctaataccaaatttggttgaattaaatgaaattcccaagattcttttctaacctttttcttttttaaaagacaggggtctcacttctggttgccccaggctgggaagtcccaatgggtgccaatccttgggcaagactttgccctgctaagttttcccttaaggctaaatggttaaattaagtggggtttttgtggaaatttcntaagaagccccatttaaagaagggtaagttttttttgggaattaaacctggttttttccattcttacctttaatggaagcctggacctggtaagtttcnattcccacctttaatggaaacctggnaacctggttttttccaatcccctccttttaatggaanccctggaacctgggtaaattggggggaaaaaaaatggggtgggtggtnggtncaaanaaaaaaggtttttaanggnaatttggggaaaagaaaaaattttccgggccttggtggccntttttccccaagggttaaaccttaaaaaaacccaaaaagaaaacctgggttnggnccctttggggtggccccctttggntttngggaaaattcctttttcccaagaaatccantggaatncaagnaagaaaaaaaatnggggtggcntaccaccttccaacaattttttaaaaaaaaatggaccacntggaccnccccctggaccattaaaccttccctttaaaatttancctaatngggggaaaaatttttttccccccttngg

SEQ ID NO: 5433 - DNA, 945 bp, Homo sapiens
  misc_feature 4, 8, 24, 34, 37, 84, 86, 99, 102, 105, 109, 121, 125, 129,133, 134, 142, 143, 150, 151, 154, 155, 158, 177, 178, 179,183, 192, 196, 202, 209, 225, 227, 230, 238, 252, 267, 277,278, 284, 285, 288, 297, 307, 312, 317, 323, 326, 327: n = A,T,C or G
  misc_feature 330, 342, 348, 353, 360, 372, 390, 393, 408, 409, 420, 427,446, 468, 471, 497, 510, 523, 527, 528, 530, 539, 544, 551,557, 559, 561, 568, 570, 576, 583, 584, 594, 596, 606, 619,621, 623, 625, 626, 635, 643, 649, 652, 655, 662, 663: n = A,T,C or G
  misc_feature 683, 686, 691, 705, 706, 709, 710, 721, 745, 749, 754, 764,766, 768, 789, 793, 797, 801, 802, 811, 813, 815, 828, 835,836, 849, 856, 858, 863, 868, 872, 887, 888, 892, 900, 917,929, 936, 939: n = A,T,C or G
ttcnatancaaagccttaacctcnggtttttttnttnaaaaggcccccggtaatccccccaattcgggaatttttccggcatancnaccttgcgttganggnganagcnaagtcgggtttnggtngggnaccnntgcatggnntaggcannagnntanggcaaatcattatccgttnnncaanttgggacgncgcncccccnaaaattngggtttaaccactttngngtnggggcccntttccaaaggtggntttcccgaagggccncttttttaanngggaannttnggaaaaccntttttttttngggancaaanacttanaanngcncgggggctttancccccntggtnataggcnttttggaccctncaagatgttcaacgtgantcntgccaaaggtttggnnacttggtgcangggaaanaaattgaaccggccaatgnggatgccttgcactgaagaagnacntcaattgctttggagtctggagaaantgcattattattngctacaaggtaancatnngnatggactgntcatngctgtgnatcgtntntnataatancngagccnaatgaannacacttctantngttgtactgnaataatagggttnangntnntagggcagnttgtgtcncaatcnccntangggatcnnatggtaatgatggtatctgnaancctgncatactgctttaannttnngggggaaaacnggctgagtacttgaagtgtaatgnttcnttacntccagtagcnananactggtatcattcagtttttntcantagnttcnncaaggtaangnanaatgtttttaagnaaaaatnnggcttttttgttnggggggnanaaaantttcnaagnaactcggtgcctacnnaaangtgcattnttttgtggaaaaacaantttttgccccgngaaaaancantttttt

SEQ ID NO: 5434 - DNA, 754 bp, Homo sapiens
  misc_feature 20, 25, 614, 669, 684, 711, 729, 742, 750: n = A,T,C or G
aatcatctctaccgtttgantgccngatccctcgattcgaattcggcacgagggccaggctggtctcgaacacctgacctcaggtgatccaccctccttggcctcccaaagtgctgggattacaggcatgagccactgtgccctgcctgtaatttttatttaatttttccggtgatggcatgagtgaatgtccacatttaaagttattttggttcacacatggcctttgtttattatttatgagaaaaaattatagaaataatttaagggtggtacagaaatgcaaatctagaggacttaaaatgtacatgaaaactccatttgatatgacaaataatttacaggtcaaatattttaatatttatatatataatagatgccagttagcacaattgacaagttctcttttacagaaaaggccccaaaatgtcttctactgatgccagatcagttgattatctagggatagatatctgaaataagctaggccaatttgattttctcactcaggaattattttattgactaattttattagttcattcagtcagcaagtatttattgaaggcctgttacatgtttggttgctagagatcaatgatggaaaaattcanataaagtttctgcttcaaacaaagaaattaaattggctagacatgggaaaatagntggccttcccaagangggaaggttctatacatttagtgctgntaaggcctataagaactncctctggattttntccccccnttgc

SEQ ID NO: 5435 - DNA, 1389 bp, Homo sapiens
  misc_feature 4, 5, 10, 14, 15, 22, 25, 37, 47, 50, 51, 54, 57, 64, 70,71, 94, 106, 111, 123, 145, 187, 195, 228, 237, 245, 249,253, 263, 264, 297, 303, 308, 312, 335, 339, 340, 358, 438,446, 448, 464, 467, 468, 471, 488, 491, 497, 507, 510: n = A,T,C or G
  misc_feature 522, 530, 534, 535, 547, 571, 583, 604, 615, 618, 631, 634,636, 641, 644, 654, 679, 683, 704, 723, 731, 754, 793, 794,805, 816, 819, 827, 852, 857, 862, 866, 878, 879, 886, 890,902, 905, 909, 927, 930, 933, 935, 936, 944, 953, 956: n = A,T,C or G
  misc_feature 957, 960, 968, 977, 984, 995, 997, 1000, 1011, 1015, 1016,1023, 1027, 1031, 1064, 1074, 1086, 1113, 1116, 1123, 1138,1189, 1212, 1221, 1229, 1232, 1243, 1245, 1246, 1253, 1255,1262, 1271, 1273, 1282, 1287, 1294, 1300, 1304, 1315: n = A,T,C or G
  misc_feature 1322, 1329, 1330, 1343, 1344, 1351, 1359, 1360, 1367, 1378,1387: n = A,T,C or G
cttnncttgntttnngccatcntcntccgtgtgcgtngccgctgccnttnnatnccnctgtgtncacaannctgttgtgtctttacactgctcnagtgaatcggtnccgtncttggatcgggnggacctccttgggagatcaatncccccgtccttcctacactttgcttctgtgaggaaaagaatnccaacctntccagcccttttaaggttcccttcatgaccttnaaccctaanccccccanaaanaaanaaccaatttnnttcaacccgggaatttttttgaaaaaaaattcnccgggnggtantttngggaaattttgaacccaaaaccngaanngggaattttaattttttntttttgaaaaaaaaaaatgggggttccccatttaggggtttcccaacccccccaattgggttccccccttttttcccttnggggggananaaagggaaagggaacnccnnggnaaaggtttttggggaanggncccaancccagggganaangggggggggttnccctctangggnnatttccttgggnccaaaaaacccccccccattggtncccttttggggnaaaaaaaaaggggtaaagggngggcccaaacnaangggggtttggccnttntntattnccnttcccaaaanggtttttaaaaaccttttttccaanaaancccccttttcccggggccccntttcttttttaaaaggggntttttccnaaaaaaatttggaatttttttgnttttccccttgggtccccttggggggttcccccctttannccccggcaccnttttgggcccnttngggggggnaaccctttaaccaaggcccaaaggnccccntttcntttnttttaacccaannggggggntttncccctttaaaanccntttnaaaaaccccctttggaanttnggngnnaaaaaaanaaccccccnttnnttncctttaanccccccccntttaaanccagggtcccntnccnttaaccttttngggnncctttancctngggnttaaaccctttttcgggaattccaaattggggnaaaaaggtgnggggggggcccntttggcccccaactttttgggaattanggnaaaacanttttttcgtaaaagnaaggcccaactttgccttaaattttttttttggaaaaaaaaagggaagggntttttgggaaaattaaattgggnttaaaaaanaaataacnaantttgggcaaancnngggggancnttttttnaaaagtttncnttttccccnttttncccccanttccgnaaangggaaagaagnaaatttnccgggtnntttatttccccannccccccntttttttnnggggggnaaaaaaaaatnttttttccntt

SEQ ID NO: 5436 - DNA, 955 bp, Homo sapiens
  misc_feature 19, 26, 46, 57, 63, 76, 92, 98, 103, 110, 112, 149, 154,166, 274, 280, 306, 369, 397, 427, 440, 557, 652, 808, 844,855, 881, 883, 891, 924, 935, 941, 942: n = A,T,C or G
actttgatattattaaaanccctttnccccgatttttctaaatggnccacgggaatncccccnattccggaatttncggggtgggaaccctnggcccnagccnttacccnangttgggtttttccccggaaaaaaaatgggaagggggnttgtntgtaatggtgtntcccccaatttttggccaaagaaagcccaagggggaacaaagccaaggttccaattccccccccaattaaagcccccccttccttggaaaaggggaaagggggggaangggggnaatttgccttttaaaaaaaagccaangggcccaagtttttcttggttccaaagttttctttgaaccgttggggccaaaggtggcccaanttggcaaaacttttggttgcccgggaanggaagtctttaaaggaaagtgcctggtcantaaattcaataangggtccaagaaccaaacaatcttggaatgaaatgaacccacctggaaatgtgttgtggctgacccacaaggaaggtgaatcctcttgcttggggtgcttatggtgtcaggttgcttncttccacatctctcatttgcttaaagcagctacaaaaggatccaaagactcatgagactaaaaatcattctgaggacaaagagacaaagatctgnctgtggtcacactgtgaggcttgcttacactgatgttctctatgggaggtcactgaagacattcagccccacacgagaagatcagagcaacttggaaaccccaaagggagacacaccctttaacacttgccgtgctgtgcttgtgccctgtccttnaaggaaggaaaagaccctatctcctctgggttttgntggcttgacanttgcaacttgatcatgcctttgactncntcatcttnttaacaagaaggaaagaacttgttttttattcnaaacccttttnaatttnnggggggggttccc

SEQ ID NO: 5437 - DNA, 780 bp, Homo sapiens
  misc_feature 1, 2, 13, 15, 16, 18, 19, 22, 23, 33, 42, 46, 54, 58, 59,89, 113, 128, 137, 139, 151, 152, 159, 161, 169, 170, 186,209, 338, 367, 376, 383, 404, 428, 436, 441, 465, 474, 529,550, 563, 599, 611, 632, 675, 696, 710, 714, 732, 734: n = A,T,C or G
  misc_feature 737, 753, 756, 766, 772: n = A,T,C or G
nnaaaaccccttngnngnnacnncttttgaatnccctttgcnactngctctttntgcnnggatcccatcgattcgctaacaagcgattntaaaccacctatgagtatctcttntagggctttcttaantacatgttngnatatactgtatnntagccanantaattttnnatctgatcaggtagtngctaaaattagaaaaaaacaaantagatgcttaaagaatttgcatccatttttgagtctaaatcttttaaaatatactgagatccacatctagtgaaatgtcagtgtcaaaatattatagattatagctaaaatccagattaatactcattnggggttttttatagtggaacttcatagtnatacaaaangcagatngtcttcctgtctccgctgctnccacagtaggtattgaaactggtnaaatcagntcttngatagtgtgtgtatataagaaaanatagatacncacattcttttttctcagtcaacacattgattgaacactctggcaaagatgctgnggtggatgaggttggagttcnaaagaagaagcanagcgctggcctgccttgaaagaaccgaagtctttcncattcacttctntagaaagctgccaagacagangcagaaagaaatggatgataggtctgctaagcacacttctggntctcttagaacttagaagtgnttctaagagaacanaagnctaacgagaaacagttcntngtngaatcaacaatctttnggntggaaccccnttggcntttttttt

SEQ ID NO: 5438 - DNA, 902 bp, Homo sapiens
  misc_feature 50, 52, 54, 57, 67, 72, 76, 84, 89, 126, 144, 150, 175, 185,199, 212, 219, 243, 294, 300, 336, 351, 361, 381, 387, 409,421, 429, 464, 469, 481, 488, 491, 540, 542, 549, 566, 569,573, 593, 617, 619, 620, 627, 642, 651, 657, 660: n = A,T,C or G
  misc_feature 661, 702, 707, 717, 729, 732, 738, 741, 747, 749, 755, 757,786, 790, 800, 811, 832, 841, 844, 861, 878, 894, 895: n = A,T,C or G
cttttttccaaaaacccccttaccttggtttttttttaaatggtcccggnantnccnccattgcgcnatttnccgnaaaatttncgggnccaccggaaggaaaattagcccatgggaagcccggtnccaggaaaaaaccagggnccaggnaatttccaaaaaatccctggtttantccccaaagnaatggcccaaggtngggtttaatggtnacctccntaaagcccttccaagtttttccantccaatccttgggaataataacaatattggggtaccttaatccttaacaangggggntggtggaataacctataaccttaattaatggtattntgaggggcattagcnaaagcatttnggcacatactagtgcccaanggtgtnctcatttgctgtgctacatggntacccctttctntccctganaaatctcaggatttgggcacactgcactactcatntaacntaaaataaacanaggccgnccngtggctcactctgtatccacacttgggatgtgacgcgcgatcacaaggnangagatcnagacatctactatctgnganaccngtcttctaaaaatcaaaaantaccggccggtggcggcacctgtntnncactctntggagactgaggcangagaatggngtgacnccnnaggcggacttgcagtgagccgagataagtgctactgcagtncgggnctgggtgaangagcaaagactncgncttcanaanttaaantnagtcanancccaaaattaagcaaggttggacccccanttanttaaaaaaanttcccgggttnaaaatttgggaaagccttttnccaagttcnttnttaaatccccaatttantttaaagcccccccttngggggttttaaaaaanncccaaag

SEQ ID NO: 5439 - DNA, 891 bp, Homo sapiens
  misc_feature 3, 4, 10, 14, 26, 27, 35, 44, 62, 77, 84, 98, 115, 133, 136,157, 165, 167, 177, 179, 180, 183, 186, 192, 197, 213, 223,230, 231, 232, 238, 249, 264, 266, 275, 294, 296, 300, 307,322, 330, 348, 350, 363, 373, 374, 382, 425, 443: n = A,T,C or G
  misc_feature 459, 461, 462, 467, 479, 497, 539, 540, 541, 564, 576, 598,599, 604, 612, 613, 618, 621, 623, 641, 645, 647, 654, 674,679, 682, 684, 688, 692, 694, 698, 705, 722, 730, 736, 743,766, 775, 792, 816, 827, 837, 843, 883: n = A,T,C or G
ccnntttttnttgnattttttcccannttcccccntttaccttngggtttttcttttttttnggccaaggggtaatnccccccnattccggaattttnccggcaaattttcggtngccaaccggaaagcgaanttncttagacgtggggaaaaaagnccctttgncntacccccccnanntanagnggggtnggggnccaaaccaaagtcaangggggtaccnactttgnnnaacctngcctgggaatngaaacccgggtttcntnggttttccnattccccccattttcccgntntttnatttttnaatcggaaaatttgntaaaaacncggcggtggtatttaccngnccctttttttcantcggattttnnaaaaaaanaagaggagtggcaaaggaaacccctttctacacataactgaangccaccagtgattcagtnccagagaggaggggcntnncatanttatattcatcnatgcagcaggattttcgngtaaaaaaatcgttatcaggctacacacatggaggaggctgnnntcgcatggtgaaataccacactngatatccactgnatcttgacctactcggccgacnngcatnaggtatanntgtcnctntntttttctttcctttgatntttncngtgtcgnttagaacaaagctcaatctntcatntangntcantgcntngtcncaatttnagtttaacttgttgccntgatcttnccaggnttaagcnaatttttgggcctttagccctcncaaattacnctttggactacacggcntttaacccagccttgccctgggcntgaattcctgngatccttttnggtaanaaaaatggggggtttccaaccatttttgggtttttttttngggggggg

SEQ ID NO: 5440 - DNA, 828 bp, Homo sapiens
  misc_feature 3, 4, 5, 6, 13, 14, 16, 17, 18, 20, 21, 24, 27, 28, 32, 34,35, 36, 39, 42, 44, 45, 47, 48, 49, 51, 53, 54, 55, 56,60, 61, 62, 63, 68, 71, 80, 102, 104, 105, 111, 113, 116,118, 119, 132, 133, 137, 144, 146, 148, 153, 167, 168, 169: n = A,T,C or G
  misc_feature 172, 178, 179, 186, 187, 197, 200, 201, 202, 207, 212, 215,221, 232, 234, 240, 245, 247, 248, 253, 265, 269, 276, 282,295, 299, 303, 310, 313, 314, 317, 320, 323, 327, 332, 337,351, 353, 355, 364, 365, 368, 369, 373, 375, 376, 384: n = A,T,C or G
  misc_feature 388, 392, 405, 406, 409, 411, 413, 414, 430, 433, 437, 445,456, 458, 466, 470, 471, 474, 479, 506, 517, 522, 524, 529,534, 546, 550, 554, 558, 569, 570, 575, 586, 605, 613, 618,635, 650, 653, 669, 670, 671, 672, 674, 684, 687, 688: n = A,T,C or G
  misc_feature 695, 702, 705, 706, 709, 720, 723, 724, 747, 749, 767, 779,787, 801, 805, 806, 822, 825, 826: n = A,T,C or G
cannnncgtcgannannnannccnaannaaanannnatnaangnncnnnanannnncacnnnntcatngtnaccttgaanccttcaactcttgcgtctcgangnnccaagnancgnannggaacgagccaanntttnacgggcnancntgcancccacccaagacannnatnggcaanngggcaanncaacggagtncannnaactnaaacnggntgccanagataccggcntntgccanagaantnngctgngcaattgatganaaantatgagnagcccncctcgatcggganggcnacangggccgnaannggnctnacnctgngcagngcatnatgagcggcaaaangngnagcttgaanncannatananngatactcnagcnggangccgggagtgaannacncnanngctatataacctaacnttnaacnagatgggncaacaatgccnanaacagggncacnntangaaangttggggacgcccccatccgggaccangacacatgagntactncntcaangacanagatcaacacangggngaanacancacacactgcnntaacngaagcatgaanggaaatgtggcctttcacnaaaagcgnacaanggattgctagattgaanacaaccttaaccctnctntagcacttggcgattnnnntntacgggaaanggnncgcaaangaggctnctnntgngaaaaaaaggnccnntctcagggaaactttttccccgngnaacccccagcattgtggnccgggcaccccnagggttanttcctacaaaagtnccgnnggcccccccccccccnccnnct

SEQ ID NO: 5441 - DNA, 1395 bp, Homo sapiens
  misc_feature 11, 12, 19, 20, 30, 31, 32, 38, 45, 47, 48, 52, 53, 54, 69,74, 89, 92, 109, 114, 117, 118, 120, 124, 127, 129, 135,139, 142, 143, 144, 145, 146, 147, 149, 156, 158, 159, 163,164, 165, 168, 169, 170, 171, 175, 178, 187, 188, 192: n = A,T,C or G
  misc_feature 197, 204, 208, 209, 211, 214, 215, 218, 220, 221, 226, 229,231, 237, 239, 243, 247, 249, 251, 252, 254, 256, 261, 263,266, 267, 272, 274, 275, 276, 278, 281, 282, 287, 289, 299,300, 301, 303, 308, 314, 315, 318, 319, 320, 321, 322: n = A,T,C or G
  misc_feature 324, 326, 327, 333, 336, 337, 340, 341, 342, 344, 345, 351,355, 357, 362, 370, 376, 380, 384, 386, 387, 388, 397, 406,414, 416, 418, 420, 421, 430, 433, 439, 440, 442, 443, 449,451, 452, 455, 460, 465, 466, 471, 475, 476, 484, 487: n = A,T,C or G
  misc_feature 496, 501, 502, 504, 510, 513, 518, 525, 526, 527, 528, 529,535, 536, 537, 540, 543, 549, 552, 553, 556, 558, 559, 562,565, 566, 567, 571, 574, 575, 580, 589, 590, 591, 593, 602,603, 609, 610, 618, 620, 622, 624, 625, 629, 638, 640: n = A,T,C or G
  misc_feature 641, 646, 650, 652, 663, 665, 670, 671, 673, 676, 677, 678,684, 686, 689, 692, 693, 695, 698, 699, 703, 704, 705, 706,708, 712, 715, 717, 724, 725, 726, 732, 733, 736, 742, 743,746, 750, 753, 756, 757, 758, 762, 766, 767, 768, 769: n = A,T,C or G
  misc_feature 770, 771, 777, 779, 780, 783, 784, 787, 789, 791, 799, 802,804, 807, 808, 813, 817, 818, 822, 824, 827, 833, 835, 838,840, 842, 848, 851, 855, 858, 864, 867, 870, 872, 876, 881,883, 886, 892, 895, 900, 902, 904, 906, 909, 910, 911: n = A,T,C or G
acccccaaccnncgccccnncccccaagcnnnacgccncggcgcnanngcgnnnacggggcacgcggcngcctntgaacgcttggaacnccncctcgacgcgcgggccngcacnaanngnccgngcngnccccgncgcnggnnnnnnangcctttncnncccnnnacnnnncacnccngaaagcccnncccnccgcnaccgagnaccnncnccnnccncnnccganccncncgcgcncngggncggnantnncngnggccnanacnnaccgncnnncncgnncaccncngaccaaggcnnncnccacnagaccnnagnnnnncncnnaccccncannccnnncnncatacngccncnatgcnacccaccnccccanccancagncnnngacctcccnaacgccccnctcaacgncnancnncacgcgacnacngccgcnnanncgctcnannccngccanccacnnaccancgcnncagccgcncgncagcccggnccacnncnagcacnacnggctngcaccannnnncacctnnncgnacnccaacngcnnctncnngcnctnnnccangcnncacgnacgacccannncnccagagcgnnacccanncagcacgncngnannatcncgccccgcncnngcgcnctananacgcgcgcaananaggcnncnccnnncacaancngcngannangtnnagcnnnngnctgnacnanacacacnnnaccacnnccnccatgnncanacangcngcnnntctnatcnnnnnngccatntnncannaancntncacccccnagngnagnncaaanatgnngcancnccntcccgngntanancncggacnacncagncancatacngancgncnccanggagncnccntccganccncgaangncncncannnccgnccanncnntnncacaacgnacacgacnangnncgcagcaccncggcggccangcnngacggccanancnancagcgcaccacnanaccacaggngnncnnncaacgnncacaacnnngcanaaccannnacccctangacannacgggncancggngncgancnnnccngcancgctacgancancgcgnantgcgcccacgacganacacgnacannnnannnngngngctccngacanncnccgcccacacnctncgcncccccncncccagcagntcgnntcnccaccgcagacgcncanagctacctcnnncngnntnnncccnnnccgcacanccctannnctacnangnacgnntcgcnnaacantcgcancnccancctncncnnaccacnatgngatntccgcgantgcacanncnnnngngccncntngcanntagacaccangcaganncngtncnnancgcngccnccg

SEQ ID NO: 5442 - DNA, 1053 bp, Homo sapiens
  misc_feature 4, 11, 22, 23, 24, 25, 26, 28, 33, 38, 45, 47, 54, 55, 56,61, 62, 69, 73, 76, 91, 93, 94, 102, 107, 110, 130, 132,135, 145, 155, 161, 168, 172, 173, 178, 180, 189, 199, 200,205, 214, 215, 221, 224, 227, 229, 234, 236, 241, 242: n = A,T,C or G
  misc_feature 244, 248, 254, 258, 271, 282, 283, 286, 287, 288, 293, 299,300, 302, 303, 305, 309, 311, 313, 314, 321, 323, 328, 331,333, 336, 337, 340, 341, 346, 347, 356, 357, 358, 361, 365,366, 371, 373, 375, 376, 382, 384, 389, 397, 398, 404: n = A,T,C or G
  misc_feature 407, 415, 416, 417, 418, 419, 431, 432, 439, 440, 450, 451,452, 455, 458, 460, 461, 466, 468, 476, 477, 478, 480, 481,482, 483, 484, 485, 488, 494, 496, 500, 505, 508, 514, 522,523, 534, 535, 537, 539, 541, 542, 552, 554, 560, 564: n = A,T,C or G
  misc_feature 570, 572, 578, 579, 581, 582, 585, 586, 589, 593, 594, 595,598, 600, 603, 608, 620, 623, 625, 629, 630, 635, 640, 641,650, 658, 665, 669, 674, 676, 680, 683, 691, 694, 697, 699,703, 714, 715, 717, 721, 722, 725, 728, 746, 751, 756: n = A,T,C or G
  misc_feature 761, 765, 766, 768, 780, 788, 791, 793, 794, 795, 799, 800,808, 811, 813, 831, 832, 835, 837, 841, 842, 844, 848, 852,855, 856, 857, 860, 861, 863, 864, 867, 872, 875, 876, 879,880, 890, 897, 904, 905, 909, 913, 914, 916, 917, 919: n = A,T,C or G
  misc_feature 928, 932, 934, 943, 946, 947, 950, 954, 959, 965, 967, 969,970, 975, 980, 982, 988, 1000, 1011, 1023, 1024, 1028, 1031,1033, 1037, 1040, 1045, 1050, 1051: n = A,T,C or G
gtgncctcccntccttttcaannnnntnggaantctcnctcgctntntcgtgcnnncgccnntgtgatngcangantactgagatgggatncnncccacgtngcccnttnctggtctcctgagctcaaancnggncagattgttnggattacagntgtgancctcccntccnngctgnanatggacttnttaaaaaagnnctctnttaaagtannaagganggntgnanttgantncccannangacnaaaacngggntgaaaaaccatcntaaaaggctgnnatnnnatggnagctanntnngntccncngnnaccttcngnccccnggnanctnntgnnttctnnatcctccannnctntcanntagcncngnnattttnancattnttccaccnntcgctngcntaatttcnnnnnttatgatttttnntcaccgnngtctctttcnnntcnctntnntgccngnctctcctnnncnnnnnngtnccctantntgtntaccncancatctngttctacnntcaacatttgnntntngnnattaacattncngtctgntcancttcgntncttcanntnntannctnttgnnncgnantcngttanttcttactctcncgngnctannttgtntgatnnttatcgatntcacctcnatacacntatnaagancnctcncgnaatactanctnctnanatanctgatcacgcnngncctnntgnttntaatactcaacgtcaccnttatngcgcnataanttcnnancttattgacagnacattatnatnannnatannttatactngantnatctagctcgcctcacanntanancacnntncgancgtnttnnnctnntnnatnatctntcnntcnntattatctcnatcccgnctatatnnattntttnngnnancttcatacnctcnanactctcatnacnnctnctcncttcnaatgcntncnngcttntgatntngctcanaatcaccatctnattatctcatntccgttctcctnntacnatntntatntcnttagncctgnncc

SEQ ID NO: 5443 - DNA, 1053 bp, Homo sapiens; identical to SEQ ID NO: 5442
  misc_feature 4, 11, 22, 23, 24, 25, 26, 28, 33, 38, 45, 47, 54, 55, 56,61, 62, 69, 73, 76, 91, 93, 94, 102, 107, 110, 130, 132,135, 145, 155, 161, 168, 172, 173, 178, 180, 189, 199, 200,205, 214, 215, 221, 224, 227, 229, 234, 236, 241, 242: n = A,T,C or G
  misc_feature 244, 248, 254, 258, 271, 282, 283, 286, 287, 288, 293, 299,300, 302, 303, 305, 309, 311, 313, 314, 321, 323, 328, 331,333, 336, 337, 340, 341, 346, 347, 356, 357, 358, 361, 365,366, 371, 373, 375, 376, 382, 384, 389, 397, 398, 404: n = A,T,C or G
  misc_feature 407, 415, 416, 417, 418, 419, 431, 432, 439, 440, 450, 451,452, 455, 458, 460, 461, 466, 468, 476, 477, 478, 480, 481,482, 483, 484, 485, 488, 494, 496, 500, 505, 508, 514, 522,523, 534, 535, 537, 539, 541, 542, 552, 554, 560, 564: n = A,T,C or G
  misc_feature 570, 572, 578, 579, 581, 582, 585, 586, 589, 593, 594, 595,598, 600, 603, 608, 620, 623, 625, 629, 630, 635, 640, 641,650, 658, 665, 669, 674, 676, 680, 683, 691, 694, 697, 699,703, 714, 715, 717, 721, 722, 725, 728, 746, 751, 756: n = A,T,C or G
  misc_feature 761, 765, 766, 768, 780, 788, 791, 793, 794, 795, 799, 800,808, 811, 813, 831, 832, 835, 837, 841, 842, 844, 848, 852,855, 856, 857, 860, 861, 863, 864, 867, 872, 875, 876, 879,880, 890, 897, 904, 905, 909, 913, 914, 916, 917, 919: n = A,T,C or G
  misc_feature 928, 932, 934, 943, 946, 947, 950, 954, 959, 965, 967, 969,970, 975, 980, 982, 988, 1000, 1011, 1023, 1024, 1028, 1031,1033, 1037, 1040, 1045, 1050, 1051: n = A,T,C or G

SEQ ID NO: 5444 - DNA, 1020 bp, Homo sapiens
  misc_feature 2, 14, 20, 21, 24, 31, 32, 34, 36, 44, 56, 69, 74, 75, 76,90, 99, 107, 109, 126, 129, 138, 158, 161, 172, 183, 193,196, 207, 211, 231, 246, 273, 283, 294, 307, 314, 320, 329,337, 338, 341, 352, 366, 367, 371, 372, 379, 380, 383: n = A,T,C or G
  misc_feature 386, 388, 392, 398, 400, 403, 405, 408, 429, 433, 436, 442,443, 447, 452, 456, 457, 461, 467, 469, 470, 471, 473, 474,476, 478, 479, 483, 486, 487, 489, 490, 491, 494, 500, 502,503, 504, 506, 511, 513, 514, 516, 517, 519, 525, 528: n = A,T,C or G
  misc_feature 531, 535, 546, 548, 558, 560, 564, 566, 569, 572, 577, 580,581, 585, 586, 602, 604, 607, 611, 612, 613, 615, 617, 625,632, 634, 640, 645, 649, 651, 654, 668, 670, 672, 675, 679,680, 681, 684, 691, 692, 696, 708, 715, 716, 723, 726: n = A,T,C or G
  misc_feature 730, 735, 739, 742, 749, 754, 767, 769, 770, 773, 777, 786,788, 791, 795, 796, 798, 799, 800, 807, 809, 810, 811, 813,815, 818, 824, 826, 827, 837, 839, 840, 845, 852, 856, 859,861, 867, 868, 869, 874, 876, 878, 879, 884, 886, 894: n = A,T,C or G
  misc_feature 896, 897, 899, 900, 903, 906, 909, 912, 914, 916, 917, 921,926, 927, 931, 942, 943, 944, 945, 949, 957, 958, 962, 964,965, 968, 982, 989, 990, 999, 1000, 1004, 1005, 1013: n = A,T,C or G
tntaatccttcttnctattnnttnggaatcnnantngctctatngcgcttgggccnatggatgccgganaactnnnatgggatttttccnacgttgccnattctggncncctgagctcaaagcaangcnggattgctnggattacagctgtgagccancgngcctggctganatgacttttanaaaaagactnctntaaagtagaangaanggtggaattgtatgcacaanaagaaaaaaacctgnaagaaaaacatactaaagaggctggantgcaatggcncgatcttggcncaccgaaacctcngtctccngggctnaagtgattntcctgccnnagnctcccaggtangctgggattcaacnnatgnnccaccannccnggntnattntgaatngntantntcngacctgttcctctccatagantggntcncggaanntctnccatnttcnntganctacangnnntnncnannctantanntnnntcnctctantnnngntactntnnanntnatcatnttnaantggntctctatctcnanttcactaatngncctngnacnatnattancgnnaccnnctataaaatacacatncntgnttcnnntnanatacaatnacatccntngtgagncactnactnanacngtgatctctcgcantntntcnatcnnnccnccatatnnccanggcacatctatntcagatnnaactcanctngtantattnaganacnctcgacncactntctgttatacttntnncantctntaatagagntnttncganncnnncttctgntnnncnanacnacattntnntgttacatcntnnatatngcctctnattntancntcgtannncattntncnnttctncnctcattancnntnntancantcntcncncnntatntaaanncgtncacacagtgcnnnntatncaccgaanntacntnnacnttatcacataatcnctgagtnnatatactcnngttnntctattcnctatccc

SEQ ID NO: 5445 - DNA, 1081 bp, Homo sapiens
  misc_feature 3, 22, 67, 81, 125, 127, 138, 139, 141, 145, 146, 150, 152,156, 157, 160, 161, 167, 184, 188, 189, 200, 208, 215, 216,217, 224, 227, 228, 229, 230, 237, 261, 274, 281, 285, 288,296, 318, 319, 324, 336, 351, 354, 366, 367, 371, 380: n = A,T,C or G
  misc_feature 382, 390, 391, 408, 415, 422, 454, 457, 459, 468, 474, 489,490, 494, 502, 508, 523, 524, 531, 544, 556, 558, 580, 584,593, 597, 609, 616, 619, 631, 645, 652, 685, 690, 695, 709,723, 728, 735, 740, 757, 784, 785, 792, 799, 810, 817: n = A,T,C or G
  misc_feature 821, 825, 830, 832, 834, 844, 845, 869, 871, 885, 890, 899,918, 955, 964, 977, 981, 991, 993, 998, 1003, 1004, 1027,1030, 1033, 1047, 1053, 1057, 1062, 1066, 1067, 1073: n = A,T,C or G
ttnaaccttcaccaccggtcangatccctcgattcgcagaacccaagagcaaaagcagccttcactnactgtcccatgaancaaaaattggatcttttctaagcaacagaaactttaggatggcnangacaaaagctnngncttnntccntntganntannatatgnaatggagattctttctnatgnngatcccattcngttagccntaaaaannncatacgngcnnnncggaatnggaccttagcaaaccaaatgcggnaaagcctgatggncgaattngaangangccactgnccccttaaaaaattgagcctcnnccttnccctgggcgggnaaacccccttccttnttnaaccgcttcttnntagntcaaaaagngnggtaaatnncccgggtttcttatagnatcttgntaacctntatcctttgtttgaacaacttttcatcccctnttntntccccgggnaaaagncttcttaaaaatggnngggnccttttcnttttantggatttttccaatnnttaaacngcttttaatcggnttccctaaggananccccggaaaaaaaaaatttgantttngggggaagnaagnatttccaacggnaaagaanccntttcccttgggnggccaaaatatttnatggacncttttttattttcccccccttttgttaaaaggnctttnggaantggacccccttctnccacctttaaaaanacctnggggctnggtcntttgcccaaaccataanaagttgggaatagctatggcccgggtnntttaaancccttgnggaaaaaaaangggtttngccntttnttttncncnccgtaatttnnaaagggggggggtttttttttctncntttttaaaccaaanggggncccaatttnggggaacctgggaaacccngggtttcccccattttttttttttttttttttttaancaattaaanaaaattcccacantttntttttttggngnaaaanggttnnttgggaacccccccttttattanggnggngggcccctttgggnaaaaanattnttttntttnngggcgnaaaaaaaa

SEQ ID NO: 5446 - DNA, 1046 bp, Homo sapiens
  misc_feature 4, 12, 16, 17, 30, 38, 43, 61, 74, 77, 90, 97, 111, 130,134, 153, 163, 173, 180, 195, 204, 215, 216, 217, 222, 223,232, 235, 239, 260, 265, 272, 281, 288, 307, 315, 318, 324,325, 332, 343, 351, 360, 363, 371, 381, 406, 418, 424: n = A,T,C or G
  misc_feature 443, 447, 471, 475, 484, 486, 489, 492, 496, 498, 507, 514,520, 526, 534, 535, 539, 541, 548, 562, 569, 575, 581, 582,591, 599, 605, 609, 639, 642, 645, 671, 686, 688, 694, 698,705, 707, 713, 721, 743, 747, 772, 781, 788, 831, 839: n = A,T,C or G
  misc_feature 842, 852, 859, 864, 912, 916, 922, 935, 940, 941, 953, 956,968, 982, 1000, 1014, 1033, 1044: n = A,T,C or G
cgtntttaaacncttnnactcccgtgcttnatgccganccacncgtacttaactggcgcgngatgtgtgctttngtnaggcatcactttncccaagnatttcatgttcatngtaaagaggaaaaatacanattnctctataatgtctccactnattggctaantcgccacttntcatctntgtgggaaatgccangttttgaantcaagccttcnnnaattnngaacatttnttncaangtttattccccaattgcgggnggaanatccctnacctggctnaaaaatnaaatttctttaacccattnggaaattngcntaaggnnccaaaanaatttttggcnctggcctntcttttaanggncccttttncccaaaaaanggaaatttggcccaaatttcttggngggacccctggnccaacncctttccccttggaaaccnaagncccccggggacccattggcctttnaaanaaaatgggnanttnggncccnanaaaaaaacnccccctngggggnaaaaantttaaaanngggntnggccccntttaaaaccaaagnggttggnaaaaantaaggnncccttaccntaattttnaacagnttancccttttttggtcctgggaaccaaattggnggnatnaaaggcggaaaataaatttgggaatncccccaccccaattntngggaanagtnatttggncntttttnaaacaatngggaaaaaatctttaaggtccnaatnacccctgggggccttggaaagtttnttcaaaaanggatttnccaaaaccctaacccttcccccaaaaaaaaaggggattccaangggtttanttnccctcaaatncaggtancctgncccttaaattattattaaaagccaccctttcccggaagaatccaaatnccgnaaccanagtttaaaaaaanccaanngaagccttgggncanggccagttttanaagaaaatggcccnaacaacccccggttttgnaaaaaagaggaccnggggttttttttttttttnaaaaaaaaaangg

SEQ ID NO: 5447 - DNA, 891 bp, Homo sapiens
  misc_feature 9, 11, 13, 28, 219, 314, 350, 359, 369, 373, 422, 460, 527,552, 568, 579, 603, 624, 629, 647, 651, 653, 659, 665, 697,726, 734, 741, 764, 807, 848, 887, 891: n = A,T,C or G
ttcatcctntntngcttttgtgcagatncctcgattcgtgagtgtgtaactcctaaattagaacactttggtatctctgaatatactatgtgtttaaatgaagattacacaatgggacttaaaaatgcgagggaataataaaagtgaggaggcccttagatacagaatccaggctcaatggataaatgtttttggcccctcccacccccatcatccagnagttgggaaaaaaagtgatgccgaatatacccaactcttccttttggtaccctaccatttctggtacctcctgggttttggaaaaattcccatcntaccaaaggaaacaggcattagccttttgggtattnccccaaaanttacccccanttanttcaaaaaaaccaaaaataggtttcaattcaaaaatgggaattttgggnaaagtttggaaagaatccggtacctttcggtttggggntttttaaaaattccaagaaccaccattgccttttggaggaaatttttaaaccaggaattcccctttnttttcaacccttaccggaattttcntttctttaatggaagnaaattctggcntcaagaaacaacccttaccacccnttccaagaaaggttaaccttnaaaantttcccagaaaagaatanttcntnccagcntttttntcaaaaaataccaacctccaaaccttagcttncttccaatagccaatttaaagccgtgccnccccagtnaaaaggntccttaaacatggacagaacatncgagatgtcagcaacaaagaaactgaaattccgtggatctatncacacagaactggaaaaaaaaaaaaaaaactcggcctctanactatagggggtccgattacgtaaattcccccccagggnaaan

SEQ ID NO: 5448 - DNA, 877 bp, Homo sapiens
  misc_feature 4, 7, 12, 21, 28, 33, 43, 47, 50, 51, 54, 55, 56, 61, 64,66, 69, 70, 74, 77, 80, 94, 96, 98, 105, 111, 112, 113,121, 123, 126, 137, 139, 149, 151, 156, 160, 161, 163, 167,168, 180, 185, 186, 203, 208, 211, 212, 215, 217, 245, 249: n = A,T,C or G
  misc_feature 257, 268, 277, 278, 284, 286, 293, 300, 314, 320, 350, 365,385, 390, 394, 397, 399, 400, 404, 405, 410, 435, 442, 459,463, 469, 484, 485, 490, 502, 510, 511, 512, 513, 521, 523,526, 527, 529, 532, 533, 535, 539, 541, 566, 573, 578: n = A,T,C or G
  misc_feature 585, 589, 595, 597, 604, 609, 610, 611, 624, 629, 635, 636,646, 654, 657, 678, 682, 683, 686, 687, 699, 712, 715, 744,753, 758, 759, 764, 765, 769, 785, 788, 790, 793, 796, 800,802, 809, 814, 821, 822, 823, 826, 838, 841, 843, 844: n = A,T,C or G
  misc_feature 866, 868, 869, 871, 872, 873: n = A,T,C or G
tcgnttngactnttgaatttngaagccntgcgngaaccctcangacncanncgnnncgagnggnantgnncccnatnctnagatttttctgggngnantgcatgnggtctnnnaaggcggntnctngaagaaccctngnttgaattacnanagagngccnngnattnnaagcccaatatntggcnngcggtgtccattaattntatanccnngcnanacagatgacactgttttaaggaaatggngccnaacccaanccgggtggaangaatgaatnncaagantnggtctancgggganttttttaaagacanggtctnactctgttgcccatgctggagaccaatggngcaatcttggcaganttggctgatagttatccttnggctnccgnaantnncggnnaccgngaaccccatagccgttaagaaggtnaggcctntggaatgaaaccgtttnccancaaacnaaaagagctgactgnnaaacncatcccactaantggaaccnnnnccggcttntnaanncntcnntnattnancctggacctggccctagggggaaanaaaaagntgccngttggcnaaanggaggntnccttttntttgnnnaaacaaaggattnccggnttgaannccttgtcccncagatgtntcntaaaggacccccataaaaccngggnncgnnccaaggggaggnccccgttgggatnttnggaggattccttttccccaataaaaactnttacccagnttggnngagcnnggcngccaacccctccccgnttnantcnttnaaancnctctctngaacncccctcnnnatntgctcccatttnaangnncctaatggggtttttttttttntnnannnccct

SEQ ID NO: 5449 - DNA, 854 bp, Homo sapiens
  misc_feature 1, 2, 7, 15, 21, 23, 24, 27, 28, 59, 65, 73, 78, 82, 86,87, 93, 94, 101, 106, 109, 112, 115, 119, 121, 124, 128,135, 139, 142, 148, 152, 153, 155, 158, 160, 169, 172, 173,186, 187, 190, 197, 205, 208, 215, 219, 221, 222, 237, 241: n = A,T,C or G
  misc_feature 244, 248, 252, 254, 260, 268, 273, 279, 294, 295, 297, 308,319, 321, 329, 332, 333, 334, 335, 337, 338, 345, 347, 357,362, 371, 373, 374, 402, 411, 412, 413, 415, 423, 429, 430,432, 438, 440, 441, 442, 443, 446, 451, 458, 472, 473: n = A,T,C or G
  misc_feature 478, 479, 481, 486, 494, 503, 511, 516, 531, 540, 549, 564,566, 573, 578, 580, 590, 591, 598, 611, 612, 614, 623, 628,638, 643, 646, 655, 656, 669, 685, 697, 700, 707, 713, 722,734, 736, 740, 762, 764, 770, 785, 814, 834, 835, 836: n = A,T,C or G
  misc_feature 837, 846, 852: n = A,T,C or G
nnatcantttatcangctttntnntcnntttgcaggatcccatcgattcgcatctggcncgaggngccataanctcantttnaaanngaattnnttttaantgganganatnctntcgntnganttcnggctttntganggngacggntagnnantcnanacacacttnctnnacattaatggganncgngcctganctcggganctnccaaaangttngnntttcctacgaatgancacnccntggnctgngnggaatncgggcganttagngctgcnatggtgacattattnntnctatataacantattgctggcntncctaccgnagnnnntnnaccctgnantgtggcactnccctncatatccananntcctccgactgtatatgccttccgtgcngcatacaannnangcctatancttaanngnaaccanannnntgnggaanggatgantccaatacatgtgnncattnntncatgngtgttccnacatgtggncttcgaanctcangctttggaaaccagngtttcacgngacaatganacctttccatgcttntntgccccncaatntncctcaatttnnttataancaaaaaatttttnntntattttcanaaggnggtccagtanttttnttnacatggganngactttaaaattncctaagcaaggggaanccatcttttaangancattaantttctntgggggganaatccaaaccanancttngaaccttttttcaatgaacttntngcaacnttattttttgagcanccaatttttttcgtttgaaattcccaaanacaaattgtgttttagaggnnnnaaaaaatcncttccnct

SEQ ID NO: 5450 - DNA, 1401 bp, Homo sapiens
  misc_feature 16, 17, 27, 34, 48, 57, 71, 74, 88, 90, 92, 106, 117, 122,124, 125, 133, 142, 162, 169, 175, 187, 189, 195, 251, 270,286, 296, 321, 332, 364, 388, 431, 445, 457, 482, 488, 500,501, 506, 511, 523, 529, 544, 545, 567, 593, 605, 614: n = A,T,C or G
  misc_feature 631, 639, 669, 672, 684, 704, 721, 730, 734, 739, 755, 788,795, 803, 804, 814, 852, 867, 871, 912, 924, 928, 932, 947,948, 954, 971, 982, 997, 1006, 1016, 1030, 1053, 1058, 1060,1084, 1107, 1116, 1135, 1142, 1180, 1190, 1247, 1266: n = A,T,C or G
  misc_feature 1334, 1346, 1353, 1354, 1360, 1369, 1398, 1399, 1401: n = A,T,C or G
ccttttgaaatttttnnaaaatttccntttaccncgggtttttttttnaatgggccncgggaatccccccnatncgggaattttccgncntncccttcttgggaanaggaaaaaatnaaatntnngagtttantggcccacnataaggggaatccaaagttngccaaangtttanatggcctgggtntngttgcntcccaactggaacctgggggtttcccaaggggggaaccccccgggaagaaccctancccaaacttgaattttaanaagaatggaagaaagngggggtttanctggggtcaagaatggaaacaaatncctttccactnaatgggcggtggaaatgggcccttttaaccanggaagaatgcctttggcaggcaanggaaggaattggccaagaatggtcccttggcttccacaagtantccattgggcaggncaaaatggaacnatggtcggaatgaaataatggtttncccccnaaaaatcattanntagtngaacnttttttgggttnggaaanccttccttggggccnntaaattaaaagaaaaaaatggnaaagaatgaatggtaacaagaattanttgttcaaaccngggaccttncttcaaagccaagtaantttaagtnggaaagttcctcggaatttggaaaaaaaanccntttaaaaaaggnaaccaaattttttcccaggnaaaaatttgggaaaatnaccttggtnaagnaaaantttccttggattttcnttttttaaaacaaagttaaggcccaaggggggnaaaaaantgggtttnnaaaaccttanccaagggggttgggaacccaaaaaaaaaaaaaaattanccccccccaaggggnttgnaaaaaacccaacctttggggccttttttttgggggttaaanggaaaaaatttngggngggncccaagggttcccanntttttnaaaaaaaaaagggtccnaaaaaaaaaanttttttttttttttngggaaaccntttttttttntttttttttttttnaaaaaaagggccccccaaaaaanggggnanccccaatttaagcttttttttttnaaaggtttttttttaaaaaaggncccccaccntttaaaaggggttaaagcnaaattantttttttaagggggggggggaaaaaattaagggtttcnaaaaaaaaantttttttaacctttgggttttggaaaaaaaaaaaaacccaaggctttgggcctttanttggttgggcccttttttntttttaaccccccttgggttttccttgggttttccccaaaattttttttggccttgggggaatttttnggggaaaccaanttaaagnnccccantttttcccnttttttttgggggggggaaaaaaaaaaannan

SEQ ID NO: 5451 - DNA, 788 bp, Homo sapiens
  misc_feature 1, 3, 4, 5, 6, 7, 8, 13, 17, 26, 30, 55, 222, 229, 679, 684,696, 719, 759, 764, 769, 771, 774, 777, 782, 788: n = A,T,C or G
ngnnnnnntttcnaaancccttttcnaatnccttggctatttgatctccttgcangatcccatcgattcgaattcggcacgagaccctctctggccacatggaggcagtttcctcagttctgtggtcagatgctgaagaaatctgcagtgcatcttgggaccatacaattagagtgtgggatgttgagtctggcagtcttaagtcaactttgacaggaaatnaagtgtntaattgtatttcctattctccactttgtaaacgtttagcatctggaagcacagataggcatatcagactgtgggatccccgaactaaagatggttctttggtgtcgctgtccctaacgtcacatactggttgggtgacatcagtaaaatggtctcctacccatgaacagcagctgatttcaggatctttagataacattgttaagctgtgggatacaagaagttgtaaggctcctctctatgatctggctgctcatgaagacaaagttctgagtgtagactggacagacacagggctacttctgagtggaggagcagacaataaattgtattcctcagatattcacctaccactttccatgttggggcatgaaagtgaacaataatttgctatagagattatttctgtaaaatgaaattggtagagaaccatgaaattacatagatgcanatgcngaaagccagccntttgaagttatataatgttttcncccttataacagcttaacgtattactttttcttatttggnttatnataananagntgngttantaaaan

SEQ ID NO: 5452 - DNA, 793 bp, Homo sapiens
  misc_feature 3, 6, 22, 23, 33, 37, 38, 44, 45, 52, 57, 60, 61, 79, 91,114, 119, 127, 130, 132, 135, 138, 139, 140, 154, 156, 161,187, 189, 195, 201, 212, 228, 237, 249, 262, 265, 281, 283,293, 298, 301, 330, 350, 361, 365, 381, 401, 407, 421: n = A,T,C or G
  misc_feature 430, 437, 447, 450, 451, 457, 474, 478, 481, 496, 497, 498,510, 514, 527, 528, 553, 564, 568, 574, 577, 579, 586, 591,595, 598, 602, 603, 609, 613, 619, 625, 631, 637, 645, 647,652, 663, 667, 673, 677, 683, 685, 687, 689, 690, 692: n = A,T,C or G
  misc_feature 694, 698, 704, 705, 706, 707, 709, 710, 711, 713, 715, 717,719, 721, 732, 738, 741, 742, 745, 749, 751, 757, 760, 761,766, 772, 777, 781, 783, 786, 790, 791: n = A,T,C or G
tgntcncctagggaaaccctanngaaaagcccnccanntttggnnaaaactncgctncanntgacgtccacacaccctnctcgggtagagntcattttgtggcaacggaatgcnccggncaaacagnagngnatnttnnnggcacagaaggccngngccantttcatggacacctggctggacctcngnggaagngaactncgataagatgngtgcgttcactgcagnacctcacantgataccgtccnctctaatggaacngancctccccacatgcacncnccactcaaanggagnttnaaaggctgggttcaggttacaggggcgtnttcttcaccgtctgaatgcnggaagacagantacnagctccagaggagcgngggcgggagacggagctganatgcgngatgtctaggaaancgtcctcgnattcctnagcgcgggcngcnngactgntcgcggcccttgcctgncttncangagcgcttcaacttnnnccaacacacccncggnctgatgttccctnnctccggcggcctgcacaccccaacnatgcctgactngganggctcnccntnccacacngaccntganttngggnncaagtnacancctgtnccaaantaccgnttaatnccaaaagngnacccntgaaaaggaancggnccgggncctntagccngngntnnancngganccgggnnnncnnngngnangntngaaagggttcncccgancgnnttntcgncncctcgnatnnatgcntccccnggcantagncnacntcanncg

SEQ ID NO: 5453 - DNA, 1104 bp, Homo sapiens
  misc_feature 1, 2, 4, 10, 15, 16, 17, 147, 162, 245, 322, 514, 533, 540,562, 570, 581, 589, 590, 611, 631, 633, 654, 657, 673, 727,765, 825, 829, 830, 837, 841, 870, 886, 893, 897, 912, 922,944, 951, 955, 961, 967, 988, 1001, 1016, 1046, 1063: n = A,T,C or G
  misc_feature 1067, 1074, 1078: n = A,T,C or G
nncnaaaacnctttnnnctcccgttctttttgcaggatcccatcgattcgaattcggcacgaggaaaagggacagcgtggataaaaaggttttttaaaaacatgggatggttaaaggctggtttttgctttgggaagaaagaacttnggggaactgggggancaggtcttttaagaatatttaatttggaaaaatgcctgggccacctggtcctaatcctgggaatccccaaggggctttggaanctaagggaattttgaagggaaagttcaccaaggggaaagccaagaatttccaagtcctggaccaattttatttccantgccaaaggtttttttttgggtgcctggtaagttattattgaatggaaaaagaatggtaaaaagccttgaaattaaaaggccatttaattttcctgccccctaagaagtttggtttccaccagccccctaaattccaagggccattaatgggaataatggttaaaaaccaaatggaacctggtaaacccgtnggtttattacgaatggttnaaagganccaaaaaattttaaaaaaaaangggggggntttttttaaanaaaaaaanngaagggccattaaaagggaanccccctccaaattggccaanangaattttggaaggggacccanttnaattttttttaatttnttggaagcccttttaaaaaaaagaatggaaattaaggggtggtttccttccaanggaaagggtaagggggaatccttgggccttggaaaaanggggaaaattaaattcctggaggccaaaaaggggtaattgaaaaaccaagccccttaatngccnntttaagnaagnaaaaaaaaagggttcccttttttaaattnaaaggggcaatttttnggggggntttngggggggggaaaaancccttttggnaaaaaaaaaagggaaaaaattnggggggnaaancccttnggggtncccacccaacccaaggggggncccccttttgggngggttgggccccccnaaaaacccttaaaaagggggggggtttttnggggaaaaaaaaaaatnaaanaaatttngggnaaaggggccccaaaaaaaaaaaaaat

SEQ ID NO: 5454 - DNA, 785 bp, Homo sapiens
  misc_feature 3, 23, 32, 54, 56, 60, 61, 63, 69, 75, 85, 86, 88, 90, 100,112, 117, 121, 126, 127, 128, 139, 143, 154, 161, 175, 177,188, 205, 212, 215, 231, 234, 235, 236, 237, 240, 249, 255,262, 266, 267, 269, 270, 276, 285, 286, 289, 291, 294: n = A,T,C or G
  misc_feature 296, 299, 302, 305, 309, 318, 319, 320, 322, 328, 331, 332,336, 338, 358, 365, 369, 372, 376, 383, 396, 404, 405, 411,412, 423, 427, 428, 429, 452, 460, 480, 481, 482, 496, 501,507, 509, 513, 521, 525, 526, 529, 544, 547, 549, 552: n = A,T,C or G
  misc_feature 557, 569, 571, 576, 580, 581, 585, 588, 594, 600, 601, 616,628, 633, 649, 651, 656, 662, 664, 667, 672, 679, 686, 704,708, 715, 722, 728, 730, 740, 752, 756, 759, 767, 770, 773,780, 781, 784, 785: n = A,T,C or G
ggnctttgaaacccttgtttacntgccctttntgcaggatcccatcgattcgantncggnncnagctanacctcntatgagggtnncntncagggctacngtgattacatgnatgtntatnctggnnngtagccgctantganttgatatctgncaggttnactcctagatgtcngnaaccgcgtganatctgccgcccgacctnagcatgnatntgagcgtctatcacanctnnnnganactgggatncacatntatgganttgnncnngacaanatgatatanntgntntcntntantcngantaantctaatttnnngntatgtntannggancntcatacctgtacaagacgcncatagcntgantgnctangctgctnaccacatgtaggnattgaaannggttannttagaccatgnacannntgtgcctatacttaaaagatctnttgactanatgctgctccttgtagtacnnnacccctgatctggncaccnctggtnanttantgctgttngccnnatnaggtacggtagtttnganangancatanctggcgctacgncnggccnttanntganccnccatanacatcnnctattattgataccngcccttaggatnaggcngtgtcaaatggatgancnaccantaggcnanttntggtntcgtacnacttggnaacgcccttagagtaatnaaangggaagntgaaacnggggcntngggaaattanacatcgttggcntgangcntaggcttnctnatntttgganngann

SEQ ID NO: 5455 - DNA, 818 bp, Homo sapiens
  misc_feature 4, 7, 16, 457, 481, 492, 502, 504, 510, 515, 521, 533, 540,544, 547, 560, 564, 567, 569, 583, 589, 594, 598, 599, 606,607, 611, 620, 623, 626, 634, 649, 652, 685, 688, 691, 713,718, 740, 741, 757, 766, 768, 779, 785, 787, 789, 805: n = A,T,C or G
  misc_feature 807, 809, 812, 816, 818: n = A,T,C or G
gatnttnttttcaaancgctaggctactcgttctttttgcaggatcccatcgattcgaattcggcacgaggaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttaganacagtgccaagaatgacaaagatntttaaaaaaanagaaagaaangnaaaaanaaaancccctnacttttaaaagnaaaattncctnacnaggattttttaantatnagntnattcttttacccanttttcnttttnctannttccctnngatnttttccaanctnaanggctgggnatttttaaacttcantancttgttgaaagaccaaaaggtggttttttgganttnagnaaattttttggaaaatctggcntaatncttaaatttggtaaaaaatttnnggaaaattccttaaanaaataaatntncttattaaaanaaaaantngngccttttagaactttngngngcntttncn

SEQ ID NO: 5456 - DNA, 817 bp, Homo sapiens
  misc_feature 8, 15, 19, 21, 30, 32, 58, 61, 63, 75, 90, 109, 110, 126,129, 133, 151, 165, 171, 175, 184, 188, 189, 191, 192, 195,201, 206, 209, 229, 230, 231, 236, 244, 248, 251, 260, 261,263, 266, 289, 294, 314, 347, 368, 374, 379, 415, 416: n = A,T,C or G
  misc_feature 429, 430, 456, 468, 476, 485, 508, 511, 513, 520, 543, 548,549, 558, 572, 583, 595, 617, 623, 638, 644, 664, 675, 684,696, 699, 709, 715, 722, 735, 738, 741, 764, 768, 781, 784,799, 800, 802, 816: n = A,T,C or G
ttcaaatngcttggntctngntctttctgnangatcccatcgattcgaattgtgactnatncnaggataaatgtnatatgcgtatgattntgatatgactttgatgagnntcttcagggaaaattnctnaaantgaaattgctggattaangggtaaatgcatgnatagtnttgntagacaggnccanncnnctnccttanaggtngtncccttttgtgttcctgccannnatatntgagagtncacngantatgtggtnnanctntataatgcttgtccatctgatanggaanaaatcgagtatgccttaatntgcccttcttttattatgaatcagattttaatnttttgcctctagaactatagntgagtngtatnacgtagatccagacatgataagatacattgatgagnntggacaaaccacnnctagaatgcaccgaaaaaaatgctcnatttgtgaaatntgtgatgntattgcttnatttgtgaccattataagctgcnatntncaagtgnacaacaacaattgcattcattcnatggnntcaggttcngggggactgtgtgnggatggttttntaattcgacggncacctgtgccaaatgcattggngccccngggaccccagctttntggatnccttttacatggaggggttnaatttggcccnccttgggcngttaatcacttnggnccataagccnggtttnactggtngttgaaaatcggntanttnccgtttcaccaaatttccccacngggnattttctagccgnggnagccttcaaaatggnnanagcccttggggggnc

SEQ ID NO: 5457 - DNA, 770 bp, Homo sapiens
  misc_feature 5, 6, 7, 8, 9, 10, 11, 14, 15, 16, 17, 18, 19, 23, 27, 34,39, 47, 467, 619, 657, 667, 669, 705, 715, 723, 727: n = A,T,C or G
gtttnnnnnnnttnnnnnnttcnaatngcttggntactngttctttntgcaggatcccatcgattcgctcaggcttggggggaagaacaagctacttgggagttaatggatgatagctgctgtggccatttttcttaagagttagactggggagatgggtttggaaagtaaaatgcaaatggtgggtagtggtattaggtggtgatgcccaaggcgtgctgtagaaacctgcagggtgaagcccataacttttgttacgggaatggggtaactgaatcctaaactagctaggggagatagggatggaaagagcagatgtggaggttggggagaagggagtgacaggagatatatccagttccagagggaatagggagagctgtgtggctaagatttaactgtttggacatttaatttggggaaattgttttccagccaagtgaataaataatactggacttcaagtncaagcttcatacaggaagtgaagttttggtgtggagatagctgcatagtcagggaacactctaaattaaaaatagggaggccgggcatggtggctcatgcctgtaatcccagcactttgggaggccgggcagatcatgggatcaggagttcnaagagcacccttgaccagcatatttgaaaccccatctnacttgaaatncnaaaagattacccggcgtggtggtgcacgcctgtatnccacttctcnggagctgngcangaaaattgcttggccccggaggcgtggtgcattaacccagttc

SEQ ID NO: 5458 - DNA, 1253 bp, Homo sapiens
  misc_feature 5, 13, 19, 24, 38, 49, 53, 82, 89, 93, 99, 101, 111, 112,113, 123, 126, 128, 132, 133, 134, 153, 165, 167, 168, 195,215, 217, 225, 231, 233, 235, 236, 245, 259, 264, 271, 279,281, 283, 285, 291, 293, 295, 296, 312, 327, 338, 353: n = A,T,C or G
  misc_feature 360, 366, 374, 391, 400, 403, 412, 426, 439, 442, 447, 452,458, 460, 471, 473, 474, 483, 487, 488, 489, 490, 492, 493,502, 509, 511, 513, 523, 526, 527, 532, 533, 534, 536, 538,539, 541, 542, 544, 545, 555, 556, 565, 577, 587, 590: n = A,T,C or G
  misc_feature 594, 598, 602, 603, 604, 607, 608, 609, 615, 617, 633, 634,651, 656, 657, 658, 661, 662, 665, 667, 673, 679, 680, 686,688, 699, 709, 710, 723, 726, 735, 745, 750, 762, 772, 779,785, 789, 791, 794, 798, 802, 803, 806, 807, 811, 814: n = A,T,C or G
  misc_feature 817, 822, 827, 832, 834, 838, 839, 843, 851, 864, 866, 868,874, 882, 884, 891, 894, 899, 904, 905, 908, 910, 913, 921,922, 927, 937, 943, 945, 951, 966, 969, 970, 975, 977, 981,984, 986, 996, 1006, 1011, 1017, 1023, 1024, 1038: n = A,T,C or G
  misc_feature 1057, 1064, 1076, 1083, 1088, 1093, 1101, 1104, 1112, 1114,1128, 1135, 1137, 1145, 1149, 1158, 1162, 1167, 1173, 1179,1180, 1185, 1186, 1195, 1196, 1203, 1207, 1208, 1218, 1223,1236, 1237, 1246, 1248: n = A,T,C or G
ccccnagttttcnaaaaanccccncagttttggaaaangcccctttgtnctanacagggccatcccccaatcgcatttccgnaaaaagngcgncgcagnanggacttgggnnncgcctggacnccngnatannntcgggcaacacactgtcgnggagagtttttntnncagggccgggtttaattacagcctcangggtacggaggggaaaaacnangggggaanattggnanannccgccaaangggattttgggggnaaagnaattaancccaccanangntntactcngncnnaccggggccaaatgcnaggaaatggggaaanacctttccgtnggggcaagcccgggnaaccatngagcgngggaccanttatggggcggggacgnaaacctacnggnccaaacaanggccacctgcttanggaaactagggancgnttaanaagancgcgananaagcccgttcncnnaacctttgnttgnnnnannaatgggccntgggggncntncaacacgggnggnntaaannngnannanngnntttaaacaanncccctcaangggttaacccgnaaccaacctntgncacngggnctannnccnnnaaaaanancccacacagcgatacnncggggagaaaaaatttntaaannnttnnaananccaatngccatnnaaaacncnttgcccaaacngggaaaaaanngcccccggaaatntancaaccccangtagccccanaattnccccaacggagngggccccaantatctgntagggnaatngnggnattnggcnnttnnaaanggnaanatacnaccgntttgngnggcnncaanatgggggngaattgcaaaagngnantttggncaaaaaancnaaaaaancgnccctnttttnnacnancanggggaaanncctcnagggcaaccnataccnancctggnataagaaagtccctnggnnacctnanaagnggngntccccccganaaaaaaaacnaaggnggttancgcaannccaattcccccggnggatattggaaaaaaaccnggggaanaaaaaaaaaaangggaagngcttntccangggggggnaancaattggntnaaaaaaccctttcncctttanangaaaaccnttcntcaaaaaancttntaaanaaaaanccaatnnttatnncccgcgaannccaaagnggtnntcaaaatacngggancattaaaccgcgnnattatcccntnaaaaa

SEQ ID NO: 5459 - DNA, 757 bp, Homo sapiens
  misc_feature 8, 11, 557, 588, 615, 636, 673, 722, 731, 748, 753, 756: n = A,T,C or G
ttcaaacnctnggctcttgttctttttgcaggatccctcgattcgaattcggcacgaggcgcaatgcgagcggctggcgtagggttggtggactgtcactgccacctctccgccccggactttgaccgcgatttggatgatgtgttggagaaagccaagaagccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttcttccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctganaaagtactgctgcatgcatttgatggtcggncatctgtaaccatggaaggagtaaganctgggtacttcttcttaattnccccttctatcataagaaagtggacagcagaaacttntgaacaattgcctttaacttctatatgcttagaaacagattcacctgcnctaggaccngaaaaacaaggtaccgnatganccnt

SEQ ID NO: 5460 - DNA, 1351 bp, Homo sapiens
  misc_feature 3, 11, 14, 26, 27, 30, 36, 51, 53, 72, 73, 74, 82, 85, 86,91, 98, 99, 100, 101, 103, 105, 109, 112, 117, 118, 120,126, 127, 128, 129, 130, 131, 132, 135, 136, 137, 138, 142,144, 145, 146, 147, 149, 150, 152, 154, 156, 163, 164: n = A,T,C or G
  misc_feature 165, 166, 167, 168, 170, 176, 181, 182, 183, 185, 186, 190,193, 194, 196, 197, 198, 208, 209, 211, 212, 213, 214, 215,218, 219, 222, 230, 233, 234, 237, 244, 249, 251, 252, 265,266, 267, 274, 275, 278, 285, 290, 293, 295, 297, 298: n = A,T,C or G
  misc_feature 303, 304, 306, 307, 310, 311, 315, 318, 319, 321, 324, 326,328, 329, 335, 344, 353, 355, 360, 365, 376, 377, 388, 391,392, 403, 416, 419, 420, 422, 423, 440, 444, 448, 450, 453,458, 459, 462, 463, 464, 465, 466, 469, 470, 473, 478: n = A,T,C or G
  misc_feature 479, 482, 483, 487, 491, 495, 498, 499, 503, 505, 508, 509,519, 521, 523, 527, 529, 532, 537, 539, 541, 542, 543, 544,548, 552, 554, 555, 557, 563, 567, 573, 574, 577, 579, 581,583, 585, 587, 592, 593, 605, 607, 610, 613, 619, 623: n = A,T,C or G
  misc_feature 632, 635, 640, 642, 643, 647, 653, 655, 656, 658, 685, 686,688, 691, 694, 700, 703, 704, 706, 723, 726, 730, 732, 745,746, 750, 753, 755, 760, 762, 765, 769, 784, 786, 789, 790,808, 810, 817, 830, 832, 851, 865, 867, 874, 878, 881: n = A,T,C or G
  misc_feature 887, 888, 890, 893, 894, 910, 912, 917, 919, 922, 924, 928,933, 934, 946, 951, 958, 959, 964, 965, 966, 972, 973, 974,981, 982, 984, 1010, 1012, 1014, 1021, 1028, 1029, 1030,1031, 1038, 1048, 1051, 1052, 1059, 1060, 1063, 1067: n = A,T,C or G
ccntttttttngcnaaaaaaaattcnnccntttttngggtttttaaaaaanancccccccatttttttcatnnntttttttnggnncagtnaaaaaannnnanantttnttnagggnnanataaannnnnnntannnngaangnnnntnntntntnaaagtannnnnngntttttntgaannnannaganagnngnnntttttttttnntnnnnntannagntttttttntgnnggnatcatantattntnncaaggaggggtannntattttnnaangatgaantttgnatntnanngcatnnannaannaaanttnntnatntngnnataatnaaagaattnaataattanangatanatacntaaaaaaaganncgagagcattnttnntgggatttttnatcatctcaaatnagnnannatatctatgaatgatanttanttangnttnataanntannnnnaanngtnttatnnaannatantgtnattnganntgananaanngatctgccangnangatntnatnaaatntntnnnngaanacantnncnaggcgnaatnatattnntantnantntntnattannaatagaaaaatntnatnatnatatanattnattatacantantatgntnnaaantatatnanntntttatactctactatatgaattattcnnanganatnaattanagnntngaataaatatatatatntanaatntnatttaatctgtannagantananacttncnaancatntctatgatatatgananagnntatattctgtacttaatngnatattanatatgataaatananagatatatataatattatnacatacgtgtatananttatatntatntgnagtacnngngannaatgattacttatatnantattnanatncnatanatatnnagggtatagtcntgtanaatgtgnnatcannngagtcnnnataatanntntatctgttatgttgttatatatttgntngnatatatnctactannnnataaggntataatttgngannagatgtnnaantttnatctcanagacatcnacatgcanatnangttgaanantgttttntatatctcatangtantctcntatngatntntagctattatntagaananntanatatatntnctctntatgtnnaatgactcataantctatnatgtnngtacaactnnctntgtatanagngatgnctcatanattacncnntantncngatatatatagnnnatttntatattnatactctantanntgatnganatattntatnnacnnanatagactactatantaataanatna

SEQ ID NO: 5461 - DNA, 805 bp, Homo sapiens
  misc_feature 8, 20, 36, 326, 374, 387, 432, 481, 501, 517, 582, 587, 591,598, 615, 631, 718, 724, 730, 746, 753, 759, 779, 787, 793,797, 801: n = A,T,C or G
ttctaatnccattctaaatnccagttccaagccttngtgcaggatccctcgattcgaattcggccgagaagatgcaggtgaacaggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtagganctgcacgatctgggaacctcacgtttatggtgggaggagtttaagatnaatttgctgctgnccaaaaatttgctggggtgcatgggctccaacgtggtgttctgtngagctgtttggactgggcaagcggcaaaagatctgcaacaacatgctgnttagctattagtattgattnggaactgcttgaactntgaaatcttgggaatcaggttaagggcttgacccaaaactactggcttaaaatcctaaatatganctcangacngtgtttngtcaaattgacacttantaatcctgtcctggantgatgggattggccttcccctcggctaataactatcagggtggattttggaaccacccctcatgggtaaaggatctggggattggcncaaganttttgntaccagcacaaaagangccccantccttnttggcaatcttgggcccatnagatcttncaggtngatntgtnccct

SEQ ID NO: 5462 - DNA, 772 bp, Homo sapiens
  misc_feature 3, 8, 12, 14, 24, 335, 568, 579, 614, 620, 627, 672, 708,711, 712, 716, 724, 745, 764: n = A,T,C or G
ccntttcnaatncnagttatcgcntttttgcaggatcccatcgattcgtgttgctgcattctaagcttaacctcctggtctcatggcagtgacttgagcttttgattcatagaagaaagccagaggttctgcttgttcttgtctgccagccctcgtcgttctttctcctctgcctctcacctctaccccaaatacctctgttcttagtctcaaggggagaataacatcagggagcccctcatcttccccagaaggacttctcgttcctcatgtagttaactccattgattttcctatcttggtgctgatagctctctaagggtagggcacacctncccacagccaccctcctcttcagagagcccccagccagcagcaggcccctctgcctgcactcctcaggcttgcccctcgctgcctcagtgaggcactagtgccactgccgtggcccaccgggccatagctcaagctgcagcagaaatgcctctcagtggccaacatgatgaaacccctgtctctactaaaaatacaaaaattagctgggcatggtggcgggtgcctgtaattncagctactcangaggctgaagcaggagaaccacttgaacccaggangcggangttgcantgagcccgagcttgtgctattgcacttgcaccggggtgacaaganggaaatttgtctcaaaaaaaaaaaaaaaaaaaactnganncctntagaactntagtgagtcggatttacgtanatccagacttgattagatncattgtta

SEQ ID NO: 5463 - DNA, 612 bp, Homo sapiens
  misc_feature 2, 3, 6, 9, 10, 14, 21, 38, 41, 60, 65, 72, 77, 79, 81, 87,89, 90, 92, 94, 98, 100, 107, 112, 115, 116, 120, 122, 131,133, 138, 141, 145, 147, 152, 153, 158, 159, 164, 166, 169,176, 177, 187, 189, 192, 198, 200, 206, 221, 233, 238: n = A,T,C or G
  misc_feature 240, 246, 249, 252, 253, 254, 256, 267, 274, 279, 283, 290,291, 294, 315, 316, 323, 342, 358, 364, 368, 374, 383, 384,394, 395, 416, 418, 443, 449, 451, 459, 467, 473, 476, 479,494, 498, 499, 512, 516, 517, 518, 519, 521, 522, 525: n = A,T,C or G
  misc_feature 537, 542, 546, 557, 558, 561, 584, 588, 589, 601, 610: n = A,T,C or G
cnnagntcnnattnggttaangccctttctcgcaggangancccatcgattcgaattganctctnggctccngctgngnanagctancnngntntttnanacagccnagcangcnnggtngnatcaccaancntgggnccntacnanggcannatttnnggccngntgnatttggnnaaaagattgngnaanggcaangnttctgnctgcccaaggacaantgctgatgagcngaatnanctgggnacnaannngnttcacctgatnggtattnacctntganacacatnngtngccaaaaaatgggaataaggnnctgaggnactctcagaggcataatgnactatctgttcgtctntgatanaggnaggtgnatatgtgannagcccataanngagcatatttcaccaaaactntntccctgggtggtaccaccttggtcnaatgtngnagcaattngcaaaatngactangtncanacgatcctaccgtgntctnnaccaactctgatnatgnnnngnnctngtcttcattgcnaaaangaanctcattttgcnntantactacttgaacgacttagagtngacnnatctacccatgnagtcttacnat

SEQ ID NO: 5464 - DNA, 760 bp, Homo sapiens
  misc_feature 2, 3, 8, 12, 14, 15, 17, 22, 24, 94, 608, 629, 723, 734, 759: n = A,T,C or G
annttacnaaancnngnggacntnctctttctgcaggatcccatcgattcgggggcacaggccgagctggaaggagaatttggcaaaaaggctnatggcttgctggggatgttcctgaaacgcctcttgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaagctttttggcattgagagcagctctggcaccatcctgtggaaacagtatctacccaatgtcaagccagactcctcctttaaactgatggtccagagaactactgctcatttcccccatcccccacagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaggcgtctgcattgtttccttttcttttgcccatncatgaatggttctggtttggntttggttttttttaataaggaatttcccggctggatttttgtgaaggcctgttttaaattggactttactttgccctttttggggtttctcaanttttatcctanaaacctttctgacttttttccatcnc

SEQ ID NO: 5465 - DNA, 612 bp, Homo sapiens; identical to SEQ ID NO: 5463
  misc_feature 2, 3, 6, 9, 10, 14, 21, 38, 41, 60, 65, 72, 77, 79, 81, 87,89, 90, 92, 94, 98, 100, 107, 112, 115, 116, 120, 122, 131,133, 138, 141, 145, 147, 152, 153, 158, 159, 164, 166, 169,176, 177, 187, 189, 192, 198, 200, 206, 221, 233, 238: n = A,T,C or G
  misc_feature 240, 246, 249, 252, 253, 254, 256, 267, 274, 279, 283, 290,291, 294, 315, 316, 323, 342, 358, 364, 368, 374, 383, 384,394, 395, 416, 418, 443, 449, 451, 459, 467, 473, 476, 479,494, 498, 499, 512, 516, 517, 518, 519, 521, 522, 525: n = A,T,C or G
  misc_feature 537, 542, 546, 557, 558, 561, 584, 588, 589, 601, 610: n = A,T,C or G

SEQ ID NO: 5466 - DNA, 1526 bp, Homo sapiens
  misc_feature 4, 14, 20, 41, 42, 46, 53, 60, 62, 66, 79, 80, 81, 83, 84,85, 91, 93, 94, 95, 100, 106, 112, 119, 124, 127, 130, 131,136, 138, 140, 142, 144, 146, 151, 152, 156, 163, 167, 169,176, 179, 181, 185, 187, 188, 189, 193, 194, 197, 202: n = A,T,C or G
  misc_feature 204, 210, 219, 228, 230, 231, 232, 238, 241, 242, 247, 256,258, 261, 266, 282, 284, 287, 288, 291, 292, 296, 297, 303,304, 307, 310, 322, 323, 326, 328, 332, 339, 341, 342, 343,345, 353, 357, 365, 369, 371, 375, 377, 379, 387, 389: n = A,T,C or G
  misc_feature 392, 393, 395, 396, 405, 408, 417, 420, 421, 423, 424, 426,427, 431, 436, 444, 447, 458, 460, 461, 469, 470, 471, 473,474, 487, 488, 489, 491, 492, 501, 503, 507, 512, 519, 521,525, 531, 534, 535, 536, 545, 547, 561, 568, 575, 577: n = A,T,C or G
  misc_feature 581, 582, 583, 586, 588, 589, 592, 598, 608, 615, 616, 623,625, 627, 630, 653, 656, 658, 661, 662, 665, 667, 670, 672,677, 682, 687, 689, 694, 700, 710, 713, 718, 725, 727, 729,736, 741, 744, 747, 760, 768, 772, 774, 776, 779, 781: n = A,T,C or G
  misc_feature 782, 786, 789, 791, 802, 804, 805, 811, 812, 814, 817, 820,823, 826, 840, 844, 848, 850, 851, 855, 861, 872, 874, 888,891, 893, 895, 896, 898, 904, 906, 912, 913, 914, 917, 919,920, 921, 922, 924, 925, 926, 928, 930, 931, 933, 944: n = A,T,C or G
  misc_feature 946, 950, 952, 954, 957, 960, 961, 962, 967, 980, 985, 987,988, 996, 1006, 1007, 1014, 1015, 1036, 1044, 1047, 1049,1051, 1057, 1058, 1063, 1065, 1067, 1068, 1081, 1091, 1092,1094, 1095, 1098, 1100, 1104, 1106, 1108, 1110, 1111: n = A,T,C or G
aggntcttgcttgncccatngcgaacgctggaaaccctcgnncaanagcgcgngaaaccncngggntaaatgcccacgnnnannncacgcnannnccccnttttcncacgcnacccacnagggngcngannagggncntnanangnacacnnatcngaaccantctntnaaagggncgncnaaantnnnctanngtncggcntnacgagngggaactgnaacccccgngnnngctacnagnnacacnagaaaacancnctngggtnaatacaacagccaacngncanncgnntaannaattcnncancanaggagagagacnnagnancgcncacacantnnngncccaacantggnaaaccacnagcncntaananancgacccangncanntnnctacaaganagnggcctcacngcnnanncnncacntcgtncgcacccnatnggaaccgcaantnncgaatcannncnnagggggccgccannncnnacactcgtntnacgngagcncgctcananaccntactanatnnngggcgcctngngaacaaaacaacangccccanaccgccntntagnnnccntnnaanagatanccgacggganactctannacgcganangnacngtccaaccactctagagggaaantgntngtnntananaancnacaangggtnttccntncgcancacaangccaaaatcnatntatgnacccatntncnctccacngggancancanggaaagaccgagnagcccaangacnananacngnngtanccntnaaacaaaccanannagacannanggnagncanaanccccccaggcaaancacnctantnngcanaaaacnccccctaaatnancgcgaaccctttgncgncnanngnatcggntngacagnnncanannnncnnncntnnanactcaaaaggnancaangntnganacnnngcaanaaaccagcaccgnggtgncnnaacactcnggcgtacccnnagcgcanntatatcaccaccccgggacangaaggtcncgngngnatatannaatcncntnncggcgacacgcanctctaaagcnncnnagntntaanangncnnatnntaanannangctctcaaaccnntccgcgnnannngncnctannactacgcaaccacatcaagnnccgnnatgcgnatccanncgttcacataaacggggngaccacnnngngncncnancganctntgtnnacgngnngcgagnnntnnnccgannngacangacnannngnaaanacgctaccctnggcnaangcacacatgngtgnaccganaantctgantatntncncntntacacncantaacnacncannagnntanngaggnaacccaantgaatngatanncncncncgnaacgnnganncccnnnnganantnaanntaagnacannnanagnntnnangcgcgcannacctntacnaacnncacannctngcnntcnaaaagancnacgccnctntcnccg

SEQ ID NO: 5467 - DNA, 797 bp, Homo sapiens; identical to SEQ ID NO: 487
  misc_feature 5, 6, 7, 8, 16, 21, 32, 36, 40, 47, 76, 77, 78, 89, 97, 101,109, 120, 125, 130, 138, 168, 173, 176, 179, 189, 190, 194,197, 213, 214, 217, 219, 221, 223, 224, 225, 226, 227, 231,233, 236, 240, 241, 242, 250, 253, 255, 261, 263: n = A,T,C or G
  misc_feature 267, 273, 281, 284, 285, 292, 297, 299, 303, 305, 307, 313,315, 342, 345, 346, 354, 368, 372, 374, 381, 384, 385, 393,413, 435, 443, 444, 473, 481, 484, 490, 491, 506, 518, 539,540, 565, 570, 576, 582, 583, 601, 604, 607, 613, 614: n = A,T,C or G
  misc_feature 616, 624, 631, 635, 638, 643, 644, 652, 664, 666, 678, 693,696, 699, 723, 729, 731, 734, 748, 756, 757, 771, 775, 779,787: n = A,T,C or G

SEQ ID NO: 5468 - DNA, 797 bp, Homo sapiens; identical to SEQ ID NO: 487
  misc_feature 5, 6, 7, 8, 16, 21, 32, 36, 40, 47, 76, 77, 78, 89, 97, 101,109, 120, 125, 130, 138, 168, 173, 176, 179, 189, 190, 194,197, 213, 214, 217, 219, 221, 223, 224, 225, 226, 227, 231,233, 236, 240, 241, 242, 250, 253, 255, 261, 263: n = A,T,C or G
  misc_feature 267, 273, 281, 284, 285, 292, 297, 299, 303, 305, 307, 313,315, 342, 345, 346, 354, 368, 372, 374, 381, 384, 385, 393,413, 435, 443, 444, 473, 481, 484, 490, 491, 506, 518, 539,540, 565, 570, 576, 582, 583, 601, 604, 607, 613, 614: n = A,T,C or G
  misc_feature 616, 624, 631, 635, 638, 643, 644, 652, 664, 666, 678, 693,696, 699, 723, 729, 731, 734, 748, 756, 757, 771, 775, 779,787: n = A,T,C or G

SEQ ID NO: 5469 - DNA, 1133 bp, Homo sapiens
  misc_feature 6, 12, 14, 20, 21, 25, 26, 33, 38, 81, 88, 103, 104, 110,111, 114, 118, 129, 137, 145, 147, 161, 163, 167, 170, 176,177, 187, 189, 192, 197, 198, 211, 220, 226, 229, 230, 231,232, 238, 241, 243, 245, 247, 248, 251, 274, 277, 278: n = A,T,C or G
  misc_feature 280, 286, 288, 291, 292, 299, 305, 308, 315, 319, 322, 325,332, 335, 344, 345, 348, 355, 356, 357, 361, 366, 372, 375,378, 381, 384, 387, 392, 399, 400, 401, 403, 404, 411, 412,417, 418, 420, 426, 431, 435, 436, 443, 455, 456, 457: n = A,T,C or G
  misc_feature 465, 467, 469, 471, 473, 474, 477, 479, 487, 488, 489, 492,504, 506, 508, 514, 518, 524, 533, 536, 537, 540, 541, 543,547, 559, 566, 576, 578, 582, 583, 588, 590, 594, 595, 598,605, 609, 613, 615, 620, 625, 626, 627, 629, 634, 636: n = A,T,C or G
  misc_feature 657, 659, 660, 667, 668, 681, 682, 698, 703, 705, 709, 711,718, 727, 730, 731, 737, 742, 743, 752, 753, 760, 764, 776,780, 781, 782, 788, 792, 794, 798, 800, 801, 803, 805, 809,813, 817, 818, 821, 822, 826, 830, 833, 850, 852, 855: n = A,T,C or G
  misc_feature 860, 865, 866, 870, 877, 892, 897, 900, 904, 908, 909, 913,915, 923, 924, 930, 932, 936, 938, 946, 948, 970, 971, 972,974, 995, 996, 997, 1004, 1010, 1012, 1046, 1048, 1050,1054, 1057, 1059, 1072, 1073, 1074, 1078, 1080, 1085, 1086: n = A,T,C or G
  misc_feature 1090, 1095, 1097, 1099, 1110, 1122, 1128, 1131: n = A,T,C or G
gctacnagcggngngaaaanntccnnccctttnaaagntccctggttaaaaaaaacccccctttttccccttttttggggnaaaaccnccccggtttttcgcnnaaaaannggncccnggggggaaacncccccaanttcggganangcgcaaaaaaatancntggnggnaccggnngggggaagcncnccncacanncggagggcaccanttttaccgngaatantgnnnnaggaancangncncnntgnttaccgggcgaagcccggacaangcnntntgggtnanaanntgggggnggaaancgngatccangggnccnccnacgcgcnaanggtagggannctnaaacaannnaaangtggngtccgntcnaanagngtngancccanaaaaaannncnnggtaagnntgcgnncnatacanaacanaacnnggaagcngatgaaataaannnctgtcatnananangnncancncacctggnnnacngggccgggaacncnanaagggnacanactcgnagaaaaaanaanntgnntngggncggggccgtgcnagccacnccaaaacaanangaannggatntngatnnggnaaagaanaaanattncnaaaancaaannnanaatgngnaatatgggggggggaagggananncggggannggggggggatccnnatcctctgttaaaaanggagngngggnangggggancgaaaaccnggnnaaggancccannatgtggaanncaggttntagnaaccaaaaaaancggnnnatctgnaggngncaanannancnttantcancccnnganngccntatnggngcaaggtggagaaatcncnggntaaanagggnncccnggtgggnagtggtgaaaaaaancccanggnaaangacnncaantngggccccnnaggggnangaanangggggaangntaaaaagtggaaaccccaaaannngngaaaagaaggtaattttttgnnnagaaccntttaancngagggccctccaaaaaaaaaatactccgcaaatnancngaanacntnactaggggcccannnagananaactnntcgngctanananagtgacatccnataaaaacggtntgaacnccncg

SEQ ID NO: 5470 - DNA, 1195 bp, Homo sapiens
  misc_feature 5, 6, 7, 8, 9, 10, 11, 12, 13, 14, 15, 16, 22, 23, 24, 25,26, 27, 28, 29, 30, 31, 32, 48, 55, 100, 104, 105, 110,128, 129, 138, 139, 140, 141, 142, 151, 152, 159, 160, 161,162, 166, 168, 169, 170, 171, 172, 173, 174, 175, 176, 178: n = A,T,C or G
  misc_feature 179, 183, 184, 185, 186, 188, 189, 190, 191, 192, 193, 194,195, 196, 197, 198, 199, 201, 207, 209, 210, 211, 212, 213,214, 215, 216, 217, 219, 221, 222, 223, 224, 228, 229, 230,231, 232, 233, 234, 235, 237, 238, 239, 240, 241, 242: n = A,T,C or G
  misc_feature 243, 244, 254, 255, 256, 257, 258, 259, 260, 265, 267, 268,269, 271, 272, 273, 274, 275, 276, 277, 279, 280, 281, 282,283, 284, 286, 287, 289, 290, 291, 295, 296, 298, 304, 306,307, 308, 309, 310, 311, 312, 313, 314, 315, 327, 330: n = A,T,C or G
  misc_feature 331, 332, 333, 337, 339, 340, 342, 345, 346, 347, 348, 349,360, 361, 362, 363, 366, 367, 368, 369, 370, 371, 372, 373,375, 376, 377, 378, 381, 383, 386, 388, 389, 390, 393, 396,397, 398, 399, 400, 402, 404, 407, 408, 409, 410, 411: n = A,T,C or G
  misc_feature 414, 417, 418, 419, 421, 423, 424, 426, 427, 429, 431, 432,433, 435, 439, 440, 441, 445, 446, 447, 448, 449, 452, 453,454, 456, 457, 459, 463, 464, 465, 466, 468, 469, 470, 472,473, 475, 477, 478, 479, 480, 481, 482, 483, 484, 485: n = A,T,C or G
  misc_feature 486, 488, 489, 506, 508, 512, 514, 527, 540, 541, 546, 547,556, 560, 566, 567, 571, 574, 577, 584, 586, 589, 592, 597,601, 607, 608, 610, 611, 615, 620, 621, 622, 623, 625, 632,636, 637, 638, 644, 650, 651, 657, 658, 666, 672, 678: n = A,T,C or G
agggnnnnnnnnnnnnagggtnnnnnnnnnnnttttttgggaaaaagnccccccntttttttggggaaaaaccccccctttttgggggaaaatttgggcncccnnccccnttttggtttttaaggggnncccaaaaannnnnccccccttnnggggggnnnnaaanannnnnnnnncnngggnnnncnnnnnnnnnnnncnaaaagngnnnnnnnnnancnnnntggnnnnnnnngnnnnnnnnttttttttgnnnnnnnccccnannnannnnnnngnnnnnngnncnnngggnngngggggncnnnnnnnnnngggggggggggnaannnngggngnnanacnnnnnggggggggaannnnggnnnnnnnnannnnggncnccnannnaancgnnnnnananccnnnnnganggnnncncnnannangnnngnaacnnnaccnnnnnacnnngnngngaannnngnnngnnancnnnnnnnnnncnngacgcccccgcgccgcnangaananaggcggccaacgnacaccaggaacgnnggcgnnaaagcagancagncgaccnnacgnagngcngagagcncnagnaangaacngagnaggganngnnacgnaccannnngnaggcccncgcnnnagaggngcaagnnaaacgnncgggagancaaaangacacnaaacngncanncgaancaaccgaannanggggnccagccnagacacgangcacacngnaanngagnangnnnacagacgaannggganacgnnannancacagnaanngncnnaaggccnccgganacaangggacgnnacngccngnngccncaaaggccngaagaaannnnngcgagacannccngcngngncnnngnanaagaggnagacangggncgannnnanggggaaggacaancaancnaaggagcgcnngnancacnnnccannggannagcancngacaanaannnanaaccgnnaacgnccngaaaagagnannnnagaaaaanngaangcaaacngaaccggcacncnccnnnnnncgacngcagacagannagggnncggnccnaacnnngagggnnnnncgaganacancggngaangcngnagnaaccgagnaaangncnannngacnannnggncancacncncgngannggcgcnnanaacgcnngncncaaaanncgcc

SEQ ID NO: 5471 - DNA, 729 bp, Homo sapiens
  misc_feature 18, 20, 59, 60, 63, 66, 73, 87, 89, 94, 95, 100, 105, 109,111, 114, 120, 122, 128, 178, 182, 189, 195, 202, 214, 217,224, 225, 226, 227, 230, 239, 243, 247, 275, 280, 295, 296,298, 303, 305, 306, 310, 312, 316, 318, 319, 321, 331: n = A,T,C or G
  misc_feature 334, 347, 348, 353, 354, 365, 371, 372, 373, 377, 380, 411,417, 443, 454, 455, 460, 467, 469, 476, 478, 482, 483, 486,515, 538, 541, 554, 559, 567, 569, 577, 583, 586, 593, 605,606, 623, 624, 652, 666, 684, 687, 695, 697, 703, 709: n = A,T,C or G
  misc_feature 714, 726, 728, 729: n = A,T,C or G
cttttctaatgcttgggntngctctttttgcaggatccctcgattcgaatacagccctnncgntgncgctggntctgatggctgggntnttganncgagnctctngtgnangtncacacncnctcacncgacatatgggacattacacacacactcctgctcaaatgctgtacccatnatgngtggaanttctgnaggcctnagctctggcccntanggcggannnngcnactactttncatnaccncgacaccaaggtggctatggcctttccnacttnaactacaacgttggnngnggcanannatcntnattnannancaaagcttancangataggagagccnnataanngactgggaacntactgnnnacanccnatctgagaactcatgcggcacatggtggagncctatntgctcgaagaaactgtgttaacatgnactcatgtgcnnggctnacactcntngctgttncntgcnnatngtatacatgtatgacacttctgtctgtgnaaagtggaagcatttctcatacnggncctatgtctaatnagttntgaccccngnctgtagtngctaantgnaacaggnttgatccttacnntgaataactgtcacatnnttaatgagctggagaaaagtagtccaanccttagcccttctngggaaagtttgcccaacngtntgggagtncnaaattncttttnaggtnaaggcccctttntnn

SEQ ID NO: 5472 - DNA, 911 bp, Homo sapiens
  misc_feature 3, 6, 9, 10, 11, 12, 14, 15, 16, 17, 18, 19, 20, 21, 22,23, 26, 27, 28, 29, 30, 35, 38, 39, 40, 41, 42, 43, 45,46, 48, 49, 51, 52, 54, 57, 60, 62, 64, 69, 71, 74, 76,78, 82, 83, 87, 88, 89, 90, 103, 110, 116, 118, 121, 126,131: n = A,T,C or G
  misc_feature 133, 139, 143, 148, 150, 152, 153, 170, 177, 211, 215, 222,233, 240, 248, 250, 270, 288, 292, 305, 350, 357, 358, 372,378, 389, 400, 403, 404, 467, 484, 489, 497, 499, 505, 506,509, 520, 521, 523, 546, 550, 588, 620, 625, 638, 644: n = A,T,C or G
  misc_feature 652, 657, 670, 680, 692, 702, 706, 712, 736, 737, 749, 764,772, 777, 794, 804, 807, 831, 843, 844, 848, 877, 881, 890,893, 904, 910: n = A,T,C or G
tantangannnntnnnnnnnnnngtnnnnnatcanatnnnnnntnntnnanngntcnttntntnggggntnaananangcgnnagtnnnngattttgaaaacnttataangccttnangcnatcgngtttntncagggncccntcgantngnnatcgggacgagccggantacgccntgtttggggttatgtgggtcggggtggccggtgnttcngccttcnggggccttgcngagactnacccctanancgtcgctgcccccagctcanctcttactgcgggcccgntccnacgggggaccatnctgtcagggactatgcggcccaaacatctccttcgccaaaagcangcgccgnnaccgggcgcatcgnggcggncattggcgcantggtggacgtncannttgatgagggactaccaccaattctaaatgccctggaagtgcaaggcagggagaccagactgnttttggaggtggcccancattntggggtgnanggaaannccnacccaaaatgnntncgaggactattgctatggatggnacanaaggcttggttaagaagcccaaaaaaagtactgggatncttggtgcaccaaatcaaaaatttccttgttnggtcncttgagaactttngggcanaaaatcantgaantgtcaatttgggngaaaccctanttggattgaaangaaggtcccnatcnaaaaanccaaaaccaaattttgcctccccnnttcattgctggnggggccttcccaagnaatttttnaattngggaaaaattggaaggnggtttggaanccnaagggaaaaatttttttgggtggnaacttggggtannttcnaaaggggttttggtccgaaatccttggcnttancctttcccnttnttgccccaaangggggng

SEQ ID NO: 5473 - DNA, 944 bp, Homo sapiens
  misc_feature 5, 6, 9, 10, 14, 15, 16, 17, 18, 19, 22, 23, 24, 26, 29,30, 33, 35, 40, 41, 43, 49, 50, 51, 52, 54, 59, 61, 63,65, 66, 67, 69, 70, 72, 84, 95, 97, 100, 103, 111, 117,125, 126, 128, 129, 131, 136, 139, 142, 144, 148, 151, 152,159: n = A,T,C or G
  misc_feature 160, 169, 172, 177, 182, 184, 188, 194, 197, 204, 214, 215,217, 222, 225, 246, 256, 263, 270, 277, 281, 288, 293, 301,304, 305, 307, 315, 316, 321, 322, 328, 330, 333, 334, 335,337, 344, 346, 348, 352, 356, 366, 372, 378, 381, 388: n = A,T,C or G
  misc_feature 398, 407, 410, 416, 418, 424, 432, 433, 435, 436, 447, 448,463, 464, 465, 470, 476, 485, 490, 491, 493, 502, 504, 508,512, 513, 521, 523, 527, 532, 534, 535, 543, 559, 563, 564,565, 574, 575, 576, 587, 593, 599, 601, 603, 606, 610: n = A,T,C or G
  misc_feature 611, 612, 615, 616, 617, 624, 629, 647, 649, 650, 653, 656,661, 666, 677, 681, 682, 686, 700, 713, 730, 739, 743, 745,750, 752, 753, 758, 761, 762, 773, 775, 776, 777, 787, 791,796, 798, 802, 804, 808, 816, 821, 829, 835, 841, 842: n = A,T,C or G
  misc_feature 843, 844, 856, 858, 871, 883, 890, 891, 894, 897, 898, 911,917, 920, 933, 934, 938, 943: n = A,T,C or G
aaaanncanntacnnnnnnaannnanatnntancnaaaanntnattaannnntncggancncncnnncnncngttgattccaancttaatcaccntngantcngatatccngagccntcgatgcnncnntnaaacnatncgnangggngannccaaccnngggtctccnaangaacngcccncnggantgaccntgnaccctancaaagcaacnngncccanctntttgaaagggttctagggcangcgaaaaccnaataagnccccttnaaaaccnacangaaactnggccngatccctnaanncnccccaagnntgctnnccaccntnggnnntnttgcctngnangctnctgnaaccccctgnaacatnaaggangcnaccaggnaaaacacaangacattccnccnttaacntnggaagnaaaagccnnanntctaaatacanncccaaccagacccannnttggnggggtntggggaaanacctnngnggggggggngnaggngggnntaattaangntaanattantnnccaaaggnctcccaaaggccttgntttnnnccccctttnnncaaaaacaaangaaccntttttncnanggnctgnnntannnaaaaatnggggnccccccaaaaaaaaattncnntgntanggaancaacntagggcctggncatnncccnttaatcgggggccntggaaaaaaattntaaaatataaaaaattncccgggggnattngnaaacncnntgccnggnnaatttgggaangnnnggggtttctngttnaaaantnggtngnattngaccccanaaatntttttttnattatncaaaannnngtttaattcccncncattcttaaaaanttatcggggaancaaaaannatnggnnaaaaaaaccccanacaaanttnggggaaaaccccnnttanaaaant

SEQ ID NO: 5474 - DNA, 937 bp, Homo sapiens
  misc_feature 19, 39, 46, 75, 76, 81, 82, 85, 86, 89, 103, 108, 111, 118,136, 138, 139, 141, 143, 145, 150, 152, 157, 159, 166, 172,174, 179, 180, 190, 193, 194, 205, 207, 212, 213, 214, 215,218, 221, 228, 230, 236, 238, 244, 245, 251, 253, 267: n = A,T,C or G
  misc_feature 278, 282, 283, 284, 286, 292, 293, 297, 308, 309, 314, 324,329, 330, 334, 342, 343, 345, 349, 350, 353, 362, 366, 367,368, 372, 377, 378, 383, 390, 395, 409, 410, 427, 431, 437,441, 443, 444, 456, 457, 466, 468, 470, 474, 489, 497: n = A,T,C or G
  misc_feature 499, 507, 510, 516, 521, 523, 524, 525, 529, 532, 535, 537,541, 544, 547, 550, 554, 556, 559, 561, 571, 573, 578, 585,587, 589, 591, 602, 614, 616, 636, 637, 643, 645, 651, 658,661, 666, 669, 676, 677, 678, 682, 685, 690, 705, 706: n = A,T,C or G
  misc_feature 709, 713, 722, 729, 738, 739, 742, 747, 754, 755, 756, 760,761, 766, 767, 773, 775, 781, 791, 802, 803, 809, 818, 821,828, 831, 840, 852, 854, 857, 858, 859, 861, 862, 867, 869,870, 886, 888, 890, 891, 893, 895, 902, 907, 914, 921: n = A,T,C or G
  misc_feature 931, 932, 935: n = A,T,C or G
gttctaatgcttggaattnaatcgttggaaagagctagngattttngaaatcggtcataagtagatgttgtggannggaannaannttnggatactgattttntaagngtngttgtgnattggtcaggaattgttnannangnanataananttaantnaagatancatgcnantaacnnagatagaaanaannatgggggagtntntgatnnnnagnaantataacntnataagntnttattnncttacnanggtaaaagattttntgaaatggatnactnnntnagtttnnattntaatatggttnnagaancacttttttnatganncatngaagattnntnatanncantatattttntaannnagancttanngcatntatggcnatttnatttgtgcttttanntaagttttcttggatgnaagntatatnattnannattttatggtanntgaataganantngtangtaattttgatgtantaatagtngnttaatganaantttttnttaanannnttanttnggntnattnatntgnaantttntnggngntaaataattncnatttnttgaaantntncntttaataattngtatattaaccntngaacaagataatataattgnnaacagntnttattnaatattntanaatanttntgaatannngtanatnggganataattattggggtnnatngtanttgttttcnacgtaanattttaatnngtnaaatntgtattnnnaaanncttgnntgtaantnattaangaccgcctanatttaaagttnnttagtnaataaattnggntttgggnaanaaaatattntatatttataananatnnnannaattnanntctttaataaatttanangnntntnatatatntaatnatattanttataanttttgtatannagnaa

SEQ ID NO: 5475 - DNA, 937 bp, Homo sapiens; identical to SEQ ID NO: 5474
  misc_feature 19, 39, 46, 75, 76, 81, 82, 85, 86, 89, 103, 108, 111, 118,136, 138, 139, 141, 143, 145, 150, 152, 157, 159, 166, 172,174, 179, 180, 190, 193, 194, 205, 207, 212, 213, 214, 215,218, 221, 228, 230, 236, 238, 244, 245, 251, 253, 267: n = A,T,C or G
  misc_feature 278, 282, 283, 284, 286, 292, 293, 297, 308, 309, 314, 324,329, 330, 334, 342, 343, 345, 349, 350, 353, 362, 366, 367,368, 372, 377, 378, 383, 390, 395, 409, 410, 427, 431, 437,441, 443, 444, 456, 457, 466, 468, 470, 474, 489, 497: n = A,T,C or G
  misc_feature 499, 507, 510, 516, 521, 523, 524, 525, 529, 532, 535, 537,541, 544, 547, 550, 554, 556, 559, 561, 571, 573, 578, 585,587, 589, 591, 602, 614, 616, 636, 637, 643, 645, 651, 658,661, 666, 669, 676, 677, 678, 682, 685, 690, 705, 706: n = A,T,C or G
  misc_feature 709, 713, 722, 729, 738, 739, 742, 747, 754, 755, 756, 760,761, 766, 767, 773, 775, 781, 791, 802, 803, 809, 818, 821,828, 831, 840, 852, 854, 857, 858, 859, 861, 862, 867, 869,870, 886, 888, 890, 891, 893, 895, 902, 907, 914, 921: n = A,T,C or G
  misc_feature 931, 932, 935: n = A,T,C or G

SEQ ID NO: 5476 - DNA, 1191 bp, Homo sapiens
  misc_feature 4, 6, 12, 13, 14, 15, 16, 18, 33, 41, 47, 60, 77, 87, 95,96, 101, 102, 103, 105, 106, 107, 108, 109, 110, 112, 113,115, 119, 120, 123, 126, 128, 129, 131, 132, 137, 138, 139,140, 141, 142, 143, 144, 145, 146, 150, 151, 155, 157: n = A,T,C or G
  misc_feature 158, 160, 161, 163, 164, 165, 167, 169, 171, 173, 177, 185,189, 193, 195, 196, 198, 199, 202, 203, 204, 205, 206, 207,208, 209, 210, 212, 215, 217, 218, 219, 221, 222, 223, 224,225, 226, 227, 229, 231, 232, 234, 236, 237, 240, 246: n = A,T,C or G
  misc_feature 248, 249, 250, 251, 252, 253, 254, 255, 256, 258, 260, 261,263, 265, 266, 267, 268, 269, 270, 272, 275, 284, 285, 288,290, 291, 292, 293, 294, 295, 297, 299, 301, 313, 315, 317,320, 321, 322, 323, 324, 327, 331, 334, 339, 340, 341: n = A,T,C or G
  misc_feature 342, 343, 345, 346, 347, 351, 357, 359, 360, 361, 363, 366,367, 371, 373, 374, 376, 378, 380, 386, 387, 389, 391, 394,396, 397, 399, 400, 402, 407, 410, 411, 412, 413, 416, 417,421, 424, 431, 432, 438, 443, 444, 448, 454, 455, 458: n = A,T,C or G
  misc_feature 461, 465, 466, 467, 471, 472, 474, 478, 479, 481, 486, 492,507, 510, 511, 515, 518, 521, 522, 525, 527, 531, 532, 538,543, 551, 554, 564, 581, 585, 588, 595, 599, 604, 607, 608,616, 618, 622, 625, 633, 637, 639, 647, 652, 653, 654: n = A,T,C or G
  misc_feature 655, 659, 667, 668, 670, 672, 673, 674, 677, 679, 680, 681,684, 685, 693, 705, 709, 710, 713, 722, 725, 728, 729, 733,738, 739, 740, 741, 743, 744, 745, 747, 748, 749, 753, 755,759, 762, 767, 770, 774, 775, 777, 780, 783, 784, 787: n = A,T,C or G
tttngnaaaaannnnncnagagggtttttgccnaaaaaatnggcccntttgggggaaaantttgcaaaaaatccccntttttggggnaaaaaggnnggccnnnannnnnnanngnattnngangangnnannaaatnnnnnnnnnngggnngggngnnannannntnangngngaangagggggnaaanttanannannagnnnnnnnnntntanannngnnnnnnngnannanannggngtttanannnnnnnnngngnnangnnnnnngnaangggaggggnnaanannnnnnanananaggggggggggngnanacnnnnntanacgnggnggggnnnnnannnaaangagganannncnagnnaganannananangagaannananaanannannangagantannnnaannatanganaagaggnnaaaggnaccgnnaggngggggnntgntanacannntganntnggcnnancaacnaatcanacatgactgagaatnggnntacnaantannaananctanngagaantgganggaaagangantcaagaatanaaagggacaacatgagnaaanaangacacgntatncgaanatnngaagaaananaaanagncggcaaanatangntgaatagnaaatnnnnacgngataatannanannntanannnagnnaccatctngaagcaagagtnactnngtnaaacgacantanatnngagnagagnnnntnnnannnttcnantagnggnagacnacnatannantantgnntanaatnctncgaaaatntaactancnaanacntatatgaatgagannnatatctantnngagacantncnacgacnnnnnngtggnaaaannnacannannngtgntganancnngatgtgtcacacacangntgntnnactntannnnattagacntnangananantatccgagntnnannannaanantnntgananatctagaaatatngatnacanatnaaaananatatntctagcncatcatgagatatncnancagangctgancngaagatanncgagagtctacntanatncanantaactgnatnnanataagcannatgatanatantgncgtnancnnnagntaanggagaagactanntngtnatcnnntngaaancctaananacatgnca

SEQ ID NO: 5477 - DNA, 1191 bp, Homo sapiens; identical to SEQ ID NO: 5476
  misc_feature 4, 6, 12, 13, 14, 15, 16, 18, 33, 41, 47, 60, 77, 87, 95,96, 101, 102, 103, 105, 106, 107, 108, 109, 110, 112, 113,115, 119, 120, 123, 126, 128, 129, 131, 132, 137, 138, 139,140, 141, 142, 143, 144, 145, 146, 150, 151, 155, 157: n = A,T,C or G
  misc_feature 158, 160, 161, 163, 164, 165, 167, 169, 171, 173, 177, 185,189, 193, 195, 196, 198, 199, 202, 203, 204, 205, 206, 207,208, 209, 210, 212, 215, 217, 218, 219, 221, 222, 223, 224,225, 226, 227, 229, 231, 232, 234, 236, 237, 240, 246: n = A,T,C or G
  misc_feature 248, 249, 250, 251, 252, 253, 254, 255, 256, 258, 260, 261,263, 265, 266, 267, 268, 269, 270, 272, 275, 284, 285, 288,290, 291, 292, 293, 294, 295, 297, 299, 301, 313, 315, 317,320, 321, 322, 323, 324, 327, 331, 334, 339, 340, 341: n = A,T,C or G
  misc_feature 342, 343, 345, 346, 347, 351, 357, 359, 360, 361, 363, 366,367, 371, 373, 374, 376, 378, 380, 386, 387, 389, 391, 394,396, 397, 399, 400, 402, 407, 410, 411, 412, 413, 416, 417,421, 424, 431, 432, 438, 443, 444, 448, 454, 455, 458: n = A,T,C or G
  misc_feature 461, 465, 466, 467, 471, 472, 474, 478, 479, 481, 486, 492,507, 510, 511, 515, 518, 521, 522, 525, 527, 531, 532, 538,543, 551, 554, 564, 581, 585, 588, 595, 599, 604, 607, 608,616, 618, 622, 625, 633, 637, 639, 647, 652, 653, 654: n = A,T,C or G
  misc_feature 655, 659, 667, 668, 670, 672, 673, 674, 677, 679, 680, 681,684, 685, 693, 705, 709, 710, 713, 722, 725, 728, 729, 733,738, 739, 740, 741, 743, 744, 745, 747, 748, 749, 753, 755,759, 762, 767, 770, 774, 775, 777, 780, 783, 784, 787: n = A,T,C or G

SEQ ID NO: 5478 - DNA, 756 bp, Homo sapiens
  misc_feature 8, 11, 22, 23, 92, 496, 615, 676, 682, 708, 725, 746, 754: n = A,T,C or G
acttaganggntgaagtgaaanncccttctgcaggaagcccatcgattcgaattcggcacgagagcagacgttgaaggcattcagtataaantttttcgaacatttcaccatggagtcagggttgatggcatagcttggagcccagagactagacttgattcattgcctccagtaatcaaattttgtacttcagctgctgatatgaaaattagattatttacttcagatcttcaggataaaaatgaatataaggttttagagggccataccgatttcattaatggtttggtgtttgatcccaaagaaggccaagaaattgcaagtgtgagtgacgatcacacctgcaggatttggaacttggaaggagtgcaaacagctcattttgttcttcattctcctggcatgagtgtgtgctggcatcctgaggagacttttaagctaatggttgcagagaagaatggaacaatccggttttatgatcttttggcccaacangctattttatctcttgaatcagaacaagtgccattaatgtcagcacactggtgcttaaaaaacaccttcaaagttggacccgtgccggaaatgattgggtaatttggggatattactcnggccaagttattcctcaaaataagagacccgttcacatggatccgagcctgcttaattcangggggnccacaatttaggggaaaatctggttncaacccactgggttatncctggccaaaatgggccaagnccagtttnat

SEQ ID NO: 5479 - DNA, 820 bp, Homo sapiens
  misc_feature 2, 3, 4, 6, 7, 8, 9, 10, 12, 13, 15, 16, 17, 21, 24, 25,30, 94, 110, 113, 154, 174, 210, 216, 269, 305, 323, 329,335, 341, 354, 361, 363, 428, 452, 496, 499, 542, 551, 552,556, 557, 566, 572, 594, 597, 598, 618, 624, 637, 647, 650: n = A,T,C or G
  misc_feature 657, 664, 669, 671, 693, 694, 714, 738, 756, 758, 762, 766,775, 789, 792, 796, 798, 800, 804, 820: n = A,T,C or G
gnnnannnnncnngnnntttnaannccttntttcaaatgcttggctactcgttctttttgcaggatcccatcgattcgccaatggatgcagganaactgagatgggattnccncacgttgcccaggctggtctcctgagctcaaagcaatccanattgctgggattacagctgngagccaccgtgcctggctgagatgacttttaaaaanggactnctctaaagtagaaggaagggtggaattgtatgcacaagaagaaaaaaacctgnaagaaaaacatactaaagaggctggagtgcaatggngcgatcttggctcaccgnaacctncgcctnccgggntcaagtgattctnctgcctnancctcccaggtagctgggattacaagcatgggccaccacgcctggctaattatgtatttttagtanagacggagtttctccatgttggtnaggctggtctcgaactacccgacctcaggtgatccacccacctnggnctcccacagtgctgggattacaagcatgagccaccgtcccggnctccctgtnncagnntctataatntgttcntattatattctgggtatatgtnggnngtgtgattattcatgtgganctattntcacattctttgnattaactatnatngtccttnaatggtntaaananaaagtttcattcctacaaaagnnggttttggtccaaataaccncgggttttcaaggttaaccaatcnttgaaaaaaaaaaccttnanttcnattntaaaaaatnaaccattttaaaanttngccnantnccantttaaaacattaaaan

SEQ ID NO: 5480 - DNA, 778 bp, Homo sapiens
  misc_feature 14, 17, 31, 50, 618, 666, 682, 700, 704, 737, 755, 775, 777,778: n = A,T,C or G
ttctaatgcttggnttnaaacccttttaaancccttgcacttgctctttntgcaggatcccatcgattcggagaggagcaggtgcagtgattcatacccactctaaagctgctgtgatggccacccttctctttccaggacgggagtttaaaattacacatcaagagatgataaaaggaataaagaaatgtacttccggagggtattatagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgtgagtgttatgactatttatttgatattgccgtatcaatgaagaaagtaggacttgatccttcacagctcccagttggagaaaatggaattgtctaagccaaaagaaagtctaattatatacagaagataaagctaaacgtaattattatttaaatgaaagctatttttttaaatgaattgaaatttttcatgatgctactaatttgccactaaatactgcaaatggtcaccctgnatctcttctgacattgggatgttatttgcttatattcttataattttnaaatgaaggcacagtngaaatggaaaattttatnctcnatggttcctggttatttttaaatccttaaccancaaaattttggccttaantttctttttatatatacccncnn

SEQ ID NO: 5481 - DNA, 750 bp, Homo sapiens
  misc_feature 3, 17, 33, 180, 584, 694, 710, 750: n = A,T,C or G
ttnaaaatcgcttggcnactcgctctttctgtnggatcccatcgattcgaattcggcacgagccaaaatggggtggggcgcagtggctcacgcctgtaatcccagcactttgggaggccgaggtgggcggatcacgaggtagggagatcaagaccatcctggctaacacggtgaaacccnggtctctactaaaaatacaaaaaaaaaacaaaaaaaactagccaggcatggtggcaggcacctgtagtcccagctactcgggaggcagaggcaggagaatggcgtgaacctgggaggtggagcttgcagtgagccaagatcgtgccactgcactccagcctgggtgacagagtgagactccgtctcaaaaaaaaaaagaaaataggcacaataagtaatacatttctgcccaagtaagagccttcccttttgtggatgtaatgaaaatatcttcaagcactttataaataaattatatgtctgatactagccttccattgcctggatcacatctgattgtcctggtaatttgagaaaagggtagccccttggtatggatagtagcttgatgacatggaattcanggaaaagactatgatggtgtcacttgtaactgcttttggtgctgtaaaatggcatggatttaagaagagaattggctgggtgccgtggcttacacctgtaatcctacacnttgggaggccaaagtnaggctgctttgacccagaatttcagaccaacctggccaan

SEQ ID NO: 5482 - DNA, 827 bp, Homo sapiens
  misc_feature 3, 4, 5, 6, 7, 8, 9, 10, 12, 191, 501, 554, 598, 626, 635,704, 714, 725, 726, 729, 734, 749, 774, 782, 784, 792, 795,800, 802, 803, 808, 818, 824: n = A,T,C or G
ttnnnnnnnntnttcaaatcctttgctacttgttctttttgcaggatcccatcgattcgggcggaggagcagaagctcaagctggagcggctcatgaagaacccggacaaagcagttccaattccagagaaaatgagtgaatgggcacctcgacctcccccagaatttgtccgagatgtcatgggttcaantgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggangaggaagtgcccagtttcaccatggggcgatgacaatgtttgccacagccttntgcctggaacctggctcgtgcttgtgaccagaagggaaaaggcngctgttttggctctttcttccccgcaanggaccccgnttgaccccgccttggattggaagaagccaaaagggagaacccccttttccggaacccggtttaacaagntcccttggtntttttgggcannggnttttngggaaacccttgaanggggcccttttttcccttggcaacnttaaaaangncaccttgnccnttggnannaacanccattccggngcttcntcc

SEQ ID NO: 5483 - DNA, 827 bp, Homo sapiens; identical to SEQ ID NO: 5482
  misc_feature 3, 4, 5, 6, 7, 8, 9, 10, 12, 191, 501, 554, 598, 626, 635,704, 714, 725, 726, 729, 734, 749, 774, 782, 784, 792, 795,800, 802, 803, 808, 818, 824: n = A,T,C or G

SEQ ID NO: 5484 - DNA, 769 bp, Homo sapiens
  misc_feature 2, 12, 184, 447, 513, 537, 580, 583, 606, 655, 701, 714,733, 750, 754, 756, 763, 769: n = A,T,C or G
tnttttcaaatngattggctacttgttctttttgcaggatcccatcgattcggaactcagaacactgagtccctatttgatgttaaaatatgaccgttaaacttctgggtaagataatgaatggcactatggtttatactgtttctgttttatgggctcttccagagacgtgaactggaaaacnctctgcagtgtctgggattcgctcagtgctgcaggggagggcaggtgtgaggggaatggccctggagggtgatggggctggggcatccgatgcagctttatagttctgtaattaccacttttaaactttttattacgaaaaatgtcaaggaccctggaattacggtgaggtaggcaggataatggcccccaagatgcccgtgttgtgacccccagaccttgtgagtgcctcacatggggagattgtcctaggtcatcttgcangcccagggcagccccatgggcccttaaagcttgagagcctttcctgctgagtctgagagatgccanaagcaggagaggttagaacccgangagggcccgcacctgcgctgctggccttagaggaaggcccgangantgtggtggcccctaagcagcttnggactggggaccttcgtcccaccctgcaaagaaactggaattctggcanaagcccccattatggaggaaaagggaaggatcctgcccttggcagnacctttgaccctntggaccttcacaaattgtnaagcctgagggttttgngtangnacccatnaaaaan

SEQ ID NO: 5485 - DNA, 769 bp, Homo sapiens; identical to SEQ ID NO: 5484
  misc_feature 2, 12, 184, 447, 513, 537, 580, 583, 606, 655, 701, 714,733, 750, 754, 756, 763, 769: n = A,T,C or G

SEQ ID NO: 5486 - DNA, 772 bp, Homo sapiens
  misc_feature 14, 15, 19, 59, 142, 211, 234, 240, 245, 262, 282, 405, 413,432, 464, 475, 483, 502, 549, 557, 559, 608, 632, 660, 669,673, 687, 688, 704, 725, 729, 730, 733, 757, 764, 771, 772: n = A,T,C or G
ttatttgaaccctnncccnttcaaactccttgttctttttgcaggatcccatcgattcncttttccatgactccaggctgtgcctctctccatgtttggtcccttctgtgcccatggtcaggagctattcgggtggcacctngctggccaggctctcccgagtcgtggcacctccacaatgtgaattttctgaatccctattccaggattnctgggaataatgtttacttctanaatggncctgntgtaaaccatctcatcnaggtgtggtaaagccattgnatgatgaggggactgccatggaaaggagagtttgttacttacggttctgagaggaggggccacataggaaagccccacggtgggtcacaaagcggaaggagggaggggaacgtgtgggcttgntttttctngcacatctctgaagagttnttaatcttcactcatcatgtgccaagaagtgncatcataaaangaaatatntttttttcctaggagcagngttaaaatctgggtcacattcctgaccaaggacagcatcctgccttntgcccatncncttcagttcacaaaagctgacattttaaacaaatcatgactcacacgtnttaattgggtataaaaaatgttgnggtacacctggttagataaaaacttaanggccacaanggangggccccaaggtanncgatgtcaagtgtgtnaaaggggcctggattgggccntggnnaanggatttttgggcaaaacccaaaantttttgngcccccnn

SEQ ID NO: 5487 - DNA, 710 bp, Homo sapiens
  misc_feature 1, 2, 6, 17, 37, 42, 62, 67, 84, 114, 119, 121, 146, 152,161, 164, 174, 175, 181, 186, 187, 188, 190, 191, 192, 193,195, 199, 203, 225, 231, 241, 242, 244, 253, 258, 270, 272,278, 280, 281, 292, 295, 304, 305, 309, 313, 325, 352: n = A,T,C or G
  misc_feature 357, 366, 383, 386, 389, 394, 397, 403, 417, 430, 436, 438,441, 442, 443, 444, 446, 453, 466, 468, 475, 479, 492, 495,496, 512, 517, 520, 521, 523, 542, 544, 554, 557, 560, 571,574, 575, 576, 578, 584, 591, 602, 607, 610, 627, 628: n = A,T,C or G
  misc_feature 630, 634, 641, 642, 646, 648, 660, 661, 669, 670, 675, 685,694, 702: n = A,T,C or G
nnaacngaaccttgcantttgacttcctttacgcatncgcangatcccatcgattcccaganatgcncaccagccctgcacggnaggtttttcctgaacctggctcatggatanagaancncacgagggcataactgcctgtccgngaaaanccaagctanccnaccttggtcnnctttgntgtgnnncnnnntntgcnaagntggtgaaaaagaaagagatccngaccanagaacttctnnanggatggacntgctnactggggaatgngncgcccncnntacttgcacantanattcgaaanngtgnaggntacacgacattntgacccgctcaaattgcagggctcctnacgcnacgcttctntagctttctacgtttcnttntcnccacngtngacgcntttccccgggaagntctaaataaatgngctccntntannnntncgattcnatcgctatacagncncctgaanaccngaaaaaatttgcnggnntgtggtgcacgtaaanggccnctnncngggaacagttattgacctntncgatggaaancanggntttaaactggntcnnngnggaacntgaacanactaaccttcnagtcnatnttttttggttacggaanntntaantgggctnncttnanaatctctgatannatggtagnngactncacgattaanctacaatcnttcttttngggggaat

SEQ ID NO: 5488 - DNA, 1315 bp, Homo sapiens
  misc_feature 2, 5, 7, 8, 9, 16, 17, 18, 19, 20, 28, 29, 30, 36, 39, 40,46, 47, 48, 49, 69, 70, 72, 94, 107, 108, 109, 111, 112,116, 117, 119, 120, 121, 122, 138, 139, 140, 141, 144, 145,151, 152, 154, 155, 156, 157, 158, 159, 160, 161, 166: n = A,T,C or G
  misc_feature 167, 168, 169, 170, 171, 172, 173, 174, 175, 176, 177, 178,179, 180, 181, 182, 183, 184, 185, 186, 190, 191, 192, 193,194, 196, 198, 200, 201, 202, 205, 206, 207, 208, 209, 210,211, 212, 213, 215, 218, 219, 220, 221, 222, 223, 224: n = A,T,C or G
  misc_feature 225, 226, 227, 228, 229, 230, 232, 233, 234, 235, 237, 238,239, 240, 241, 242, 243, 245, 246, 247, 248, 254, 255, 257,258, 260, 261, 262, 263, 264, 265, 266, 267, 268, 275, 276,293, 294, 296, 299, 300, 301, 302, 304, 305, 306, 307: n = A,T,C or G
  misc_feature 308, 309, 310, 312, 313, 314, 315, 316, 317, 318, 319, 320,321, 322, 323, 324, 325, 326, 327, 331, 332, 333, 334, 335,336, 337, 338, 339, 340, 341, 342, 343, 344, 345, 347, 348,349, 350, 351, 352, 362, 363, 364, 365, 366, 367, 368: n = A,T,C or G
  misc_feature 369, 378, 379, 380, 381, 382, 383, 386, 387, 389, 390, 391,392, 393, 395, 396, 397, 398, 399, 400, 401, 403, 408, 409,410, 411, 412, 414, 415, 416, 417, 418, 419, 420, 421, 423,424, 425, 426, 428, 430, 431, 432, 433, 434, 435, 436: n = A,T,C or G
  misc_feature 437, 438, 439, 440, 441, 442, 443, 444, 445, 446, 447, 449,450, 451, 452, 453, 454, 455, 456, 457, 458, 459, 460, 461,462, 464, 466, 467, 468, 469, 470, 471, 472, 473, 474, 475,476, 477, 478, 479, 480, 481, 482, 486, 501, 503, 505: n = A,T,C or G
anggngnnnttttttnnnnntttttttnnncccccnttnntctacnnnncgtgggaaaaaaaaatcccnncntttttttgggggaaaaaaaaantcccccccccccnnntnncggnncnnnntttttttttggggggnnnngtnnaaaaanngnnnnnnnnccccnnnnnnnnnnnnnnnnnnnnnttgnnnnnancngnnnagnnnnnnnnntnttnnnnnnnnnnnnntnnnncnnnnnnnannnnttttgnngnngnnnnnnnnnggggggnnttttttttttttggggnnanggnnnncnnnnnnnannnnnnnnnnnnnnnngggnnnnnnnnnnnnnnngnnnnnngggggggggnnnnnnnngtttttttnnnnnnaanngnnnnngnnnnnnngnggggnnnnngnnnnnnnnannnnancnnnnnnnnnnnnnnnnnngnnnnnnnnnnnnnnanannnnnnnnnnnnnnnnngcgnggggggggggggggncnangcngtnagggganccacgagnnggaggngtggggccannatgtccttngancgcgtctgcnagnaacnctncgaggatgancnanagnnccannnanggnncnggccagnntagcncagnnttctnannnctaantgngcggatcanggggnntntncctaatagngtgnnggctaanannatgnatggngnnactgatggngaaacanntctnancgtantnccangtagtgaatgctggnttantnnntttagnggntnantagcannngcggnnaacnnanngtggntcntnnannnnanttgnnannngnngggnttcnncntnngnaganngntntnaggngncnnnncgntaaagtccnnnannangtgtntaanctnnctnaancgggtatannnnnnntnnnnggggtnnngnnnttcnnnannngnnngnnannntgnnnnnagtntgngnntacgannangtnnannancangnnannnattgtnnntnngnnnnannnannntntctgaactcgtacnnnganancnnnggtnnnngcctcacanngtatngtangctgnnagngnantatannntaagnantnttcntnnncganttnntnncgtnaacgacgatntnngtanncncgnntaanngcntaanngcanatangtnatagngagattcctnagtngaccnaggnnatgatatnaangntcangnannnannntnnnctntngactanangagannatgananatggntnnctngtgnnnagnatntgatntctcgntgctcncnagnaggntaacacacc

SEQ ID NO: 5489 - DNA, 791 bp, Homo sapiens
  misc_feature 7, 8, 12, 17, 18, 19, 22, 23, 26, 27, 29, 30, 31, 54, 60,62, 478, 582, 638, 647, 689, 697, 708, 709, 723, 736, 737,749, 781, 789, 791: n = A,T,C or G
ttgaaanncccnttagnnnttnnttnncnnnctctcaaaaccctttggcaactngctctntntgcagggatcccatcgattcgaattcggcacgaggctgccacaggggggcaatctttatttgtcttacttcctaccccttccctgttctgcctctttaactcagttaagttgttctgtttgggacctggaaaagaacccaaagaaaacctgaccggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgntttcacttggtatcctggagttgggttgctaaccttaatttctatgatgttttctaaaatgaaacttgataaagtagaccaccagctgcacccgtgttttctgnaaaagtattggtagtaagtggccaagagacttgaggaaaataccagattttttggntaccttggncttggtttaagtcttaaaaaattaaagataacattataatgnagaatcanatggggcatannccttggaaagcctnccttgaaaaaggnnttaaatatttangaagcctttaaaagacacttaaatggaccctnaaagacancn

SEQ ID NO: 5490 - DNA, 791 bp, Homo sapiens; identical to SEQ ID NO: 5489
  misc_feature 7, 8, 12, 17, 18, 19, 22, 23, 26, 27, 29, 30, 31, 54, 60,62, 478, 582, 638, 647, 689, 697, 708, 709, 723, 736, 737,749, 781, 789, 791: n = A,T,C or G

SEQ ID NO: 5491 - DNA, 1427 bp, Homo sapiens
  misc_feature 1, 2, 5, 9, 17, 36, 37, 41, 83, 94, 96, 101, 105, 149, 177,180, 182, 201, 349, 376, 379, 436, 446, 481, 484, 508, 531,536, 555, 579, 601, 637, 647, 660, 665, 695, 699, 703, 710,711, 719, 743, 747, 762, 794, 802, 808, 814, 841, 846: n = A,T,C or G
  misc_feature 854, 864, 892, 910, 913, 919, 932, 947, 950, 965, 969, 979,993, 994, 1000, 1005, 1022, 1029, 1039, 1052, 1082, 1089,1115, 1132, 1155, 1166, 1176, 1184, 1189, 1214, 1215, 1227,1237, 1258, 1289, 1290, 1296, 1302, 1310, 1311, 1317: n = A,T,C or G
  misc_feature 1322, 1331, 1338, 1343, 1368, 1377, 1378, 1394, 1407, 1415: n = A,T,C or G
nnttntttnggaaaaanttttcccccttttttactnntaanacctccggccattggccctgggccagggggttccggggaacnttctttaaggnanggggnaatncccccccgggggtttaacccgggaaggcccttccggaaaatttnccggccccctttaattaaggtgggaagnttntntttattttaacaaaatttncaacttggggcccggtccggtttttttaacaaaacggttccggttggaacttggggggaaaaaaaaacccccttgggccggtttaccccccaaaactttaaatcggccctttggcaagccaacaatcccccctttttcggcccaagcnttgggcggtaaataagccgaaaagaanggncccggcaaccggaatccggccctttcccaaacaagtttggcgccaacccttgaaatnggcggaaatnggaacgccgcccccttgtaagccgggcgccaattnaanccgcccggccggggtggttgggtngggttaacgccgccaagccggtnggaanccggctttacaactttggnccaagccggcccccttaaaccggncccggctttccttttttcggcntttttctttttccccttttcccttttttctttcggnccccaacggnttttcgggccccngggcnttttttttcccccccgggttccaaaaaaangggncccnttttttnntttttttnaaaaaaaaaaaaaaaaaaaaaaanatcngggggggggcctttnccccctttttttaagggggggttttcccccgnaaattttnaaaatngggccntttttttaaaccggggggaaaaccccnttttngggaaaancccccccccnaaaaaaaaaaaaaacctttttgggaaanttttaaaggggggggttnggnaaaatngggggtttttccnaaacccgtttaaaanttngggggggccccaaantttngggccccccntttggaaattaaannaaaccnggggnttttttttttttccggnccccccntttttttggnaaacccttttttnggggaaaatttcccccaaccgggttttccnttttttnaaaaaaaaagggggggggaacctttntttttgggttttccccnaaaaaaactttgggggaaaaaanaaaaaacaaantttttaaaancccccccnttttnttttttttttggggggggggccccnnaaaattttcccntttttttttnggggaaaatttttttaaaaanaaaaagggggggggaaaattttttttttggnnccccgnaaaatnttttttcnngggggnccccnttaattttnggggggnttttnaaaaaaaaaaaaaaattgggggggnccttggggnnttttttttaaaacccnaaaaaaaaaaaantttttttnaaaacccgcccg

SEQ ID NO: 5492 - DNA, 1505 bp, Homo sapiens
  misc_feature 6, 24, 27, 45, 57, 58, 59, 60, 61, 63, 69, 70, 75, 76, 80,81, 82, 83, 84, 85, 86, 87, 88, 96, 97, 98, 105, 107, 108,115, 116, 118, 120, 121, 130, 143, 146, 151, 155, 174, 178,180, 187, 188, 192, 207, 208, 211, 214, 215, 217, 218: n = A,T,C or G
  misc_feature 220, 221, 222, 225, 227, 228, 229, 230, 231, 232, 233, 237,238, 239, 240, 241, 242, 243, 244, 245, 246, 252, 255, 256,257, 259, 261, 262, 263, 264, 266, 268, 269, 271, 274, 275,278, 279, 281, 283, 287, 288, 298, 299, 301, 302, 303: n = A,T,C or G
  misc_feature 304, 305, 306, 310, 311, 312, 315, 317, 318, 324, 327, 328,329, 332, 333, 334, 335, 340, 343, 345, 348, 350, 354, 355,356, 357, 360, 362, 365, 366, 367, 374, 376, 377, 378, 379,381, 383, 385, 389, 390, 392, 393, 394, 395, 396, 397: n = A,T,C or G
  misc_feature 399, 400, 405, 410, 417, 418, 419, 420, 421, 422, 423, 424,425, 426, 427, 429, 430, 431, 434, 437, 438, 442, 444, 446,450, 452, 455, 456, 460, 464, 465, 466, 469, 470, 474, 476,477, 480, 482, 483, 484, 486, 489, 490, 493, 494, 495: n = A,T,C or G
  misc_feature 502, 506, 507, 509, 511, 513, 515, 526, 527, 529, 530, 535,538, 548, 553, 555, 559, 565, 567, 568, 573, 578, 579, 580,582, 583, 586, 596, 597, 598, 600, 601, 602, 604, 605, 612,620, 625, 631, 634, 636, 642, 650, 652, 653, 654, 656: n = A,T,C or G
  misc_feature 658, 665, 666, 667, 675, 678, 679, 680, 681, 688, 689, 695,698, 700, 703, 704, 705, 708, 712, 713, 718, 724, 736, 739,743, 746, 758, 764, 781, 784, 792, 796, 801, 810, 812, 813,818, 824, 825, 835, 837, 838, 844, 847, 861, 867, 888: n = A,T,C or G
tttttncccaaaaaaaaaaatttnggncccccttttttttttttnaaaaaaaaaaannnnngncccccnnttttnnaggnnnnnnnnntttttttnnnaaaaatnannccccccnntnannttttttttncccttaaaaaaanagnaaccntttngggggcaaaaaaaatcccntccnanaaaattnnaatnccatacaattaaatnnagnaanngnncnnnaangnnnnnnnaaannnnnnnnnnaaaatntannnangnnnnancnnanaannggnncngnaaannggggacaccnngnnnnnntggnnnggntnnaaatgnccnnnccnnnnaaggnggntngtncnaaannnnttngnaannncacattngnnnnancnanaaanngnnnnnntnnacctnaacantggggannnnnnnnnnntnnnaanacnncatnananaaananganntgcncaannnaannaagngnnaanannnanatnnacnnnaagcacnaacnncnancnanaaaaaaaaccnngnnacacntgntaccactcanggctngnaccnttatgngnncaatngatgnnnannggncgcactacannnannngnnccaaggnccacaganccacnaatcanacntngtaatntaatgcancnnngncngcaatannnagaccacnttnnnnatgacanngcaaanacngncannntancaannggaangtagtnacagtaacatangancctnaantaacctatagcngggatnccagaactaaaatactntanctacatgnaacnttatnaataagaanannggatnaaatannatagtaatgngnntcttanatnatatctcacaaacncgatcntagaaataaataaatcgtagnanttnttatatcnatanaanagattcatatanantnatatatctatataatcantatataaacaacatatagnnntataaaaanaaatactaaaaantcaananntanattanactcnnaanngagggcaaaataanncgnagnanaatatataagtnnnantcacatanatnnanaaaaanatatacaatatanannaaaaaananatangaaaananaaaanctaaatannaacnnatanatataaaatatantcnnaaaacaatatataanatanaaatcnanatntannganataaagatnaaananatnntntaancntncnnacacataatntaanntaatnnanaaaantnancttanngntganaanactanaaanatcnaaannnnatcaaatatanggnnaanaatatanaatatataacnaatgngaaacattcaaanactannanatnnanaaananatcttaataanaaatatanananataanaataataagannntaaanactaaaacacctatntctaaagtcactanatcattngnnanacanatctataatnnaannataaaaaaatatgnnntnnnanaataatattntatcnannnc

SEQ ID NO: 5493 - DNA, 759 bp, Homo sapiens
  misc_feature 4, 10, 22, 24, 27, 209, 240, 648, 679, 713, 723, 733, 737,759: n = A,T,C or G
ttantcatcnctcttgtttgantnccntacaactacttgttctttttgcaggatcccatcgattcgaattcggcacgaggtgagccgaggttgcgccattgtactccagcctgggcaacaagagcaaaactctgtttcaaaaaaaaagaaagaaagaaaattacctggaattcaatattgccatcggctgatttaattctaatatgaanaaaggggcagtgtgatgtgccatggagcatncacaacctgccatttcacccaccaaccttagaaagccattgaaaagagttgtttttaatggtgtttttacatccagcttcccacacctcaaatacttggggtggaattgttaatctcacattgcagtacaatgaaaatagtggaatggaaatcaagttataaaatggagctaaatatttcttctgcttgcctctgagttgacaagataccataagatactgtacatgaggctgggcgccggtggctcacgtcttatttcttctgcttgcctctgagttgacaagataccataagatactgtcatgaggctgggtgcagtggctcacgcctgtaatcccagcactttgggagggtgaggtgggcagatcacctgaggtcgggagttcaaaaccagcctgactgacatgnagaaaccccctcttttctaaaaaatcaaaantagcccaggccttggtggtgcatgcctataattncagctactcnggaagcttangcanggaaaaaaaaaaaaaatttccn

SEQ ID NO: 5494 - DNA, 917 bp, Homo sapiens
  misc_feature 3, 7, 8, 19, 20, 21, 22, 29, 34, 39, 40, 74, 94, 96, 100,103, 106, 108, 119, 126, 128, 131, 135, 136, 140, 142, 145,148, 149, 150, 151, 155, 157, 159, 162, 170, 171, 177, 186,189, 190, 192, 198, 206, 209, 221, 227, 231, 234, 235: n = A,T,C or G
  misc_feature 243, 244, 249, 257, 267, 271, 286, 287, 288, 291, 312, 315,325, 327, 328, 330, 331, 349, 353, 363, 364, 375, 379, 383,387, 392, 399, 400, 401, 405, 425, 442, 444, 450, 453, 456,458, 460, 465, 476, 485, 492, 496, 500, 501, 505, 513: n = A,T,C or G
  misc_feature 522, 529, 560, 577, 580, 583, 588, 589, 591, 595, 596, 597,599, 600, 608, 610, 624, 629, 650, 655, 660, 670, 683, 711,712, 717, 723, 724, 739, 743, 744, 753, 758, 761, 763, 766,767, 779, 785, 788, 797, 800, 826, 827, 834, 836, 838: n = A,T,C or G
  misc_feature 845, 846, 847, 853, 857, 858, 862, 876, 877, 878, 885, 890,893, 895, 898, 903, 909: n = A,T,C or G
ccncctnntttcccccttnnnnggtgggnaaaanaaccnncttttttgaaaaaaaacccccccctttttttggnaaaaaaccccccgttttacnanaaanacnggncncgagggggganccccccncnccngggnngggngngangcnnnnactngncnacnccacggcnnaacacncaaaaactnggnngnggattntattgagnggnaaaagggacganggctgngcanagnnagagaaanngggcnagcccggnaacgacggangggnaaaaatatggggggnnnaangacaaaaggaggccctgcgcnaanccgaaccatnannanncccacgtagcccggcccnaccnacgaaccaanncctaacagaancaanatgnggcnggganaaacagnnnaggnaaacaaggattcgagaggangaggggggaacaagcantngtgggngangtnananaacanggggattttcnaatgagaanaatgcanggcngaannatcncgctgggnatggagggnacttgcnccgccagatcgcataaaacgcacgcaactgngccacaaacatacggangantgngcaanncnaaannngnngccccgantnacctgaggaggganctaangctttgggaaaagaacaaaanacctnggacnggacaagggngaaggatgaacangaagacccggaaacaagaggaagggganncgccnctaaanntaaacacatccaaangcgnnaaggggaanccttnggncnaanngaggaaacctgnaccctnacntccaaaccncgnttttaagaaagggggaaaaccaaccnntgaagcnantnccccccnnngggggnaaannaacnacctgggcccaaannntttgaangaacngananggnaaacnaagggnaatggggg

SEQ ID NO: 5495 - DNA, 1282 bp, Homo sapiens
  misc_feature 3, 4, 5, 6, 7, 8, 9, 10, 11, 15, 16, 17, 18, 19, 20, 21,22, 49, 57, 70, 71, 76, 77, 92, 94, 95, 105, 108, 110, 125,135, 138, 140, 141, 142, 149, 152, 153, 155, 164, 166, 171,172, 173, 174, 175, 176, 178, 181, 183, 187, 188, 189: n = A,T,C or G
  misc_feature 190, 191, 192, 193, 194, 195, 197, 199, 200, 201, 205, 206,208, 209, 211, 212, 213, 214, 215, 217, 220, 222, 223, 224,226, 227, 228, 230, 232, 233, 234, 235, 236, 237, 240, 241,242, 243, 244, 245, 246, 247, 258, 260, 261, 262, 264: n = A,T,C or G
  misc_feature 266, 267, 268, 270, 272, 274, 275, 276, 277, 278, 279, 280,281, 283, 284, 285, 286, 287, 288, 289, 290, 291, 293, 294,295, 296, 297, 299, 301, 302, 304, 307, 308, 311, 318, 319,320, 321, 324, 326, 328, 331, 332, 338, 339, 341, 342: n = A,T,C or G
  misc_feature 343, 345, 347, 349, 351, 354, 355, 357, 358, 359, 362, 368,369, 372, 374, 375, 379, 380, 381, 383, 384, 387, 393, 394,395, 396, 397, 399, 401, 402, 403, 405, 407, 411, 423, 430,440, 441, 442, 443, 450, 454, 461, 467, 470, 479, 481: n = A,T,C or G
  misc_feature 483, 485, 487, 491, 493, 501, 519, 520, 530, 537, 541, 544,546, 554, 559, 560, 567, 574, 586, 595, 614, 620, 626, 628,631, 632, 638, 647, 648, 652, 654, 659, 669, 673, 675, 678,679, 690, 696, 700, 701, 704, 706, 712, 715, 718, 719: n = A,T,C or G
  misc_feature 720, 723, 724, 726, 728, 731, 734, 745, 746, 753, 754, 757,760, 765, 767, 768, 773, 774, 777, 784, 785, 787, 789, 790,791, 792, 794, 796, 798, 799, 803, 806, 810, 812, 817, 823,831, 834, 838, 842, 845, 846, 848, 853, 856, 861, 863: n = A,T,C or G
agnnnnnnnnnattnnnnnnnntttttggaaaaaaccccccttttgggnaaaaaaanggcccccgagggnnatttnnaatttacccccttcntnnttgcaaaaanccncnttttggggaaaaaanccccccacancgncnnntttttgnggnngnaaaaaaggnancccgnnnnnnanggnanctannnnnnnnncncnnnggcnnanngnnnnngnggncnnngnnngncnnnnnnaannnnnnnnggggttttttnannncncnnnancnannnnnnnnannnnnnnnngnnnnngngnncnagnncgnggggggnnnncangnanaanngggccnngnnngngnangnaanngnnnagngccaannacnannaagnnnannaanggaccnnnnnanannnanangccnccccccccccanaacaagnacccatgacnnnnaatgacnaggncctaggnacccanaanccaagcccnangnananctgncncaggccangaacaccagccaaagaanngagcaccccnaaccacnagcncancnagggaaancaggnncaaaggncaaaggnaactaaccaaanaacccccantaagggccaaaaaagcctnggagcngcgagnanaannaaaaangcctaaggnngccnanggccngaaaaaagangcgnanaanncaagggaccanaagagnaaannaangncccaantcncannnaannananagngcncccccaaccannaagatcnnaanccnggggnannaaacnngancaatcgnncncnnnncncnanncggnacnaaananaaaancggggngaccaagnccnaaangcangannanaaaanagntacangntcgnncatnaaaacnanancacgngaaaancacacnncaanncaancngnanannnggggagagnncacnnaanngananaaannacnacncaccacanaaggngancnacnggccnggannnanacaananggcanaaaanngagncaccgcagnaancngcgananngcgcnncacnanaacgnnagncnnaaaagaaaganacnaannacangcanngacncacgancnananccccaaacnaggnnanacncaanacacntnnngcagananaaccacnnnagnacacncacacgctacaagngnatnanagcnantataganantacanacncnanacanacngcatnanncacaacnatacngacanacngcanntgaaaaatnnggaannnanagaacggagagnacaaccn

SEQ ID NO: 5496 - DNA, 1282 bp, Homo sapiens; identical to SEQ ID NO: 5495
  misc_feature 3, 4, 5, 6, 7, 8, 9, 10, 11, 15, 16, 17, 18, 19, 20, 21,22, 49, 57, 70, 71, 76, 77, 92, 94, 95, 105, 108, 110, 125,135, 138, 140, 141, 142, 149, 152, 153, 155, 164, 166, 171,172, 173, 174, 175, 176, 178, 181, 183, 187, 188, 189: n = A,T,C or G
  misc_feature 190, 191, 192, 193, 194, 195, 197, 199, 200, 201, 205, 206,208, 209, 211, 212, 213, 214, 215, 217, 220, 222, 223, 224,226, 227, 228, 230, 232, 233, 234, 235, 236, 237, 240, 241,242, 243, 244, 245, 246, 247, 258, 260, 261, 262, 264: n = A,T,C or G
  misc_feature 266, 267, 268, 270, 272, 274, 275, 276, 277, 278, 279, 280,281, 283, 284, 285, 286, 287, 288, 289, 290, 291, 293, 294,295, 296, 297, 299, 301, 302, 304, 307, 308, 311, 318, 319,320, 321, 324, 326, 328, 331, 332, 338, 339, 341, 342: n = A,T,C or G
  misc_feature 343, 345, 347, 349, 351, 354, 355, 357, 358, 359, 362, 368,369, 372, 374, 375, 379, 380, 381, 383, 384, 387, 393, 394,395, 396, 397, 399, 401, 402, 403, 405, 407, 411, 423, 430,440, 441, 442, 443, 450, 454, 461, 467, 470, 479, 481: n = A,T,C or G
  misc_feature 483, 485, 487, 491, 493, 501, 519, 520, 530, 537, 541, 544,546, 554, 559, 560, 567, 574, 586, 595, 614, 620, 626, 628,631, 632, 638, 647, 648, 652, 654, 659, 669, 673, 675, 678,679, 690, 696, 700, 701, 704, 706, 712, 715, 718, 719: n = A,T,C or G
  misc_feature 720, 723, 724, 726, 728, 731, 734, 745, 746, 753, 754, 757,760, 765, 767, 768, 773, 774, 777, 784, 785, 787, 789, 790,791, 792, 794, 796, 798, 799, 803, 806, 810, 812, 817, 823,831, 834, 838, 842, 845, 846, 848, 853, 856, 861, 863: n = A,T,C or G

SEQ ID NO: 5497 - DNA, 1356 bp, Homo sapiens
  misc_feature 46, 47, 49, 56, 63, 65, 66, 67, 77, 92, 105, 116, 119, 128,136, 138, 143, 145, 146, 147, 148, 151, 155, 157, 159, 164,165, 166, 170, 171, 176, 178, 180, 181, 182, 184, 186, 187,191, 192, 194, 195, 196, 197, 198, 199, 201, 202, 203: n = A,T,C or G
  misc_feature 204, 205, 206, 207, 209, 210, 211, 212, 213, 214, 215, 216,218, 221, 222, 223, 225, 228, 232, 233, 234, 235, 238, 239,240, 241, 243, 244, 245, 246, 249, 250, 252, 254, 258, 259,260, 261, 263, 264, 266, 267, 268, 269, 270, 271, 272: n = A,T,C or G
  misc_feature 273, 274, 284, 285, 289, 290, 292, 294, 295, 296, 298, 299,306, 307, 308, 309, 312, 313, 321, 323, 327, 329, 331, 332,334, 335, 338, 340, 343, 344, 345, 347, 350, 353, 354, 356,357, 358, 359, 361, 362, 363, 365, 367, 374, 376, 377: n = A,T,C or G
  misc_feature 378, 381, 382, 386, 387, 389, 394, 396, 397, 398, 399, 400,401, 407, 408, 410, 411, 415, 416, 417, 419, 423, 425, 426,427, 428, 429, 431, 437, 440, 444, 450, 451, 452, 454, 457,460, 472, 478, 481, 486, 489, 492, 495, 496, 497, 503: n = A,T,C or G
  misc_feature 507, 522, 523, 531, 543, 547, 553, 555, 558, 560, 562, 567,570, 572, 575, 578, 581, 582, 596, 598, 600, 611, 613, 614,621, 622, 627, 636, 639, 641, 649, 650, 651, 655, 667, 669,670, 675, 683, 692, 693, 696, 699, 704, 707, 713, 714: n = A,T,C or G
  misc_feature 716, 717, 718, 719, 720, 723, 728, 734, 735, 737, 739, 740,750, 751, 771, 777, 780, 788, 793, 795, 800, 803, 810, 819,821, 826, 828, 830, 834, 842, 843, 844, 845, 849, 853, 859,861, 862, 868, 869, 876, 878, 879, 887, 895, 899, 902: n = A,T,C or G
tttggggaaaaaaaaaaccccccccctttttgggggaaaaaaaaanngnccccccngaaaggngnnncttttttggnaaaaaaacccccctnttttgtttttgcnaaaaaaaaccnccnttttggggnaaaaattncnccccnannnncgncccnantntttgnnngaannggaanangnnnananncccnncnnnnnngnnnnnnnannnnnnnnangannnanaanaggnnnncannnnannnnaannananaatnnnntnnannnnnnnnnggggggggcnnatannanannnannaaaaaannnnaannaaaaccanangggngnanngnnaananacnnnanaanaannannnnannnananggaaaanannnaannaaannanaaganannnnnnacaaanncnnaaannngnaacnannnnngnaaacanagnaaanaggaannnanacnacncaaaaaaacacngggacnaanaacanganagnatnnnacaagncaanacaacgaagaagacnnataaacangcacaaaataancaangaaagngnaangngnaaagnacnanggnaanaanngaatacaggaaaantnanataaagacaantnngaatagnnaacancaaatcaanaangnaaggaacnnnctanacaacacccaananngaaancaagatanatactaganntanggnacaanagnaaaaannannnnncangctangagganngngnnaaacgaaaannacaacaaaacgacaagagancacaangangaataaangcaananacacnaanacgaaancaaaagaangnacccncnangaanaagagacnnnngaangaancgaaanannaacgcnnacagacnanntaaggacncacataangaancanagaaangacgancnaganaggggnaaananancnccagnagctaacaaaacagnaaaatanngcacntannagatnnannanangaaacanacaangcaagngcatnnaaaganaaagaataanaanacannnannanaggccnaagaannnaaanacnaaaatanaaaagnacatagacatanaccanacagnnnaaaangaanagntacgnanacaanaaaanaaaatcacaaannccnaaacgcnacnactaacanacatatcaacnngacannnnnnacagcaaaacagannnnanganaaancacnnaannaagagaatannacanaccangaatatgtananacannnacaagagacgnaatagnnaacaganatcacaacacacnnanatatacgcnaatnnncacgaanngatatgaannacacannacncgtcacaatcacancc

SEQ ID NO: 5498 - DNA, 1356 bp, Homo sapiens; identical to SEQ ID NO: 5497
  misc_feature 46, 47, 49, 56, 63, 65, 66, 67, 77, 92, 105, 116, 119, 128,136, 138, 143, 145, 146, 147, 148, 151, 155, 157, 159, 164,165, 166, 170, 171, 176, 178, 180, 181, 182, 184, 186, 187,191, 192, 194, 195, 196, 197, 198, 199, 201, 202, 203: n = A,T,C or G
  misc_feature 204, 205, 206, 207, 209, 210, 211, 212, 213, 214, 215, 216,218, 221, 222, 223, 225, 228, 232, 233, 234, 235, 238, 239,240, 241, 243, 244, 245, 246, 249, 250, 252, 254, 258, 259,260, 261, 263, 264, 266, 267, 268, 269, 270, 271, 272: n = A,T,C or G
  misc_feature 273, 274, 284, 285, 289, 290, 292, 294, 295, 296, 298, 299,306, 307, 308, 309, 312, 313, 321, 323, 327, 329, 331, 332,334, 335, 338, 340, 343, 344, 345, 347, 350, 353, 354, 356,357, 358, 359, 361, 362, 363, 365, 367, 374, 376, 377: n = A,T,C or G
  misc_feature 378, 381, 382, 386, 387, 389, 394, 396, 397, 398, 399, 400,401, 407, 408, 410, 411, 415, 416, 417, 419, 423, 425, 426,427, 428, 429, 431, 437, 440, 444, 450, 451, 452, 454, 457,460, 472, 478, 481, 486, 489, 492, 495, 496, 497, 503: n = A,T,C or G
  misc_feature 507, 522, 523, 531, 543, 547, 553, 555, 558, 560, 562, 567,570, 572, 575, 578, 581, 582, 596, 598, 600, 611, 613, 614,621, 622, 627, 636, 639, 641, 649, 650, 651, 655, 667, 669,670, 675, 683, 692, 693, 696, 699, 704, 707, 713, 714: n = A,T,C or G
  misc_feature 716, 717, 718, 719, 720, 723, 728, 734, 735, 737, 739, 740,750, 751, 771, 777, 780, 788, 793, 795, 800, 803, 810, 819,821, 826, 828, 830, 834, 842, 843, 844, 845, 849, 853, 859,861, 862, 868, 869, 876, 878, 879, 887, 895, 899, 902: n = A,T,C or G

SEQ ID NO: 5499 - DNA, 1326 bp, Homo sapiens
  misc_feature 9, 19, 20, 21, 22, 29, 42, 49, 50, 51, 52, 53, 63, 64, 67,70, 72, 73, 74, 75, 76, 78, 79, 83, 84, 85, 86, 87, 89,94, 99, 100, 101, 102, 103, 113, 117, 123, 132, 133, 149,150, 158, 159, 160, 161, 162, 164, 165, 166, 167, 168, 183: n = A,T,C or G
  misc_feature 191, 192, 193, 194, 195, 202, 203, 205, 206, 207, 208, 209,210, 211, 212, 213, 214, 215, 216, 217, 218, 219, 220, 221,222, 223, 224, 225, 226, 227, 228, 229, 230, 231, 232, 233,234, 235, 236, 237, 238, 239, 241, 242, 243, 244, 245: n = A,T,C or G
  misc_feature 246, 247, 248, 249, 250, 251, 252, 253, 254, 255, 256, 257,258, 259, 260, 261, 262, 263, 264, 265, 266, 267, 268, 269,270, 271, 277, 286, 287, 288, 289, 290, 291, 292, 293, 294,295, 296, 297, 298, 299, 300, 301, 302, 303, 304, 305: n = A,T,C or G
  misc_feature 306, 307, 308, 309, 310, 311, 312, 313, 314, 315, 316, 317,318, 319, 320, 321, 322, 323, 324, 325, 326, 327, 335, 336,337, 338, 339, 340, 341, 342, 343, 344, 345, 346, 347, 348,349, 350, 351, 352, 353, 354, 355, 356, 357, 358, 359: n = A,T,C or G
  misc_feature 360, 361, 362, 363, 364, 366, 367, 368, 369, 370, 371, 372,373, 374, 375, 376, 377, 378, 379, 380, 381, 382, 383, 384,385, 386, 387, 388, 389, 390, 391, 392, 393, 394, 395, 396,397, 398, 399, 400, 401, 402, 403, 404, 405, 406, 407: n = A,T,C or G
  misc_feature 408, 409, 410, 411, 412, 413, 414, 415, 416, 417, 418, 419,429, 432, 434, 437, 438, 440, 441, 442, 445, 446, 447, 449,450, 452, 453, 456, 457, 461, 462, 464, 466, 467, 469, 470,471, 473, 474, 477, 478, 479, 482, 483, 484, 485, 486: n = A,T,C or G
ttttggccnaaaaaaaaannnnggccccnttttggggggccnaaaaaannnnnggggcccccnnggnggngnnnnntnntttnnnnngnttttnccccnnnnntctttttctngggnaaaaanccccccttnntttgggggaaaaaaanncccccccnnnnngnnnnnttttttttggggggnaaaaaaannnnnccccccnngnnnnnnnnnnnnnnnnnnnnnnnnnnnnnnnnnnngnnnnnnnnnnnnnnnnnnnnnnnnnnnnnnngggggnttttttttnnnnnnnnnnnnnnnnnnnnnnnnnnnnnnnnnnnnnnnnnngggggggnnnnnnnnnnnnnnnnnnnnnnnnnnnnnngnnnnnnnnnnnnnnnnnnnnnnnnnnnnnnnnnnnnnnnnnnnnnnnnnnnnnngggggggggnggngnggnngnnngcnnngnnannggnngcanngngnngnnnannggnnnggnnnnnnngnannnnnncnnngnngnnngnnggnnnngggncnannnnggcnnnnnnggggggnannngnnnnnggnannnnannnngggggannnggnncgnngngnnnnngnganannnnggnngnanggannnannnannnnnnnnggnanccnnacnnannnnnnnnngngcgggaancnnncnnnngnnncnnngacnngggnnngnnnnnnnnnnnnnnnnnngaanggnnnnnnnnngnnnnnnnngannnnnnnnnnnnngngncnnngncgnnngaagnngnnnnnnngnnnnnnnnnnnnnggggggggnnnnnnnnnngnnnnnngnancnnnnnnnnngnnnagnngcnnngnnnnnnggnnnngcncnnnnnnngnnnannnngnngnnnannnnnnnnnnnnngnggnnnnnnannnnnnnnnnngnnnngnnnnnnnnnnngnnnnnnnnnnnnnnanagnnnnnnnggngnaangnnannnnnnnnnnnngngngnnnncgnngngnnnnnnggnnannnnnnnnnngnnnnnnnnnnagggnnnnnnngnnngnnnnngngnnnnnannngnnnnnngngnnnnanngnnnannnnnngnnnnnanncacnnnnnnnnnggnnncgnnnngnnngnnngnnnnnnnngngnnnnnnnnnnnnnnnngnnnnngnnnnnnnnngcgnnnnnnnnnnnnnngnngngnannnnnnnngnggannnnnnnnnnnnnngnnnnnannnnnnnnnnnnngnannannnnangnnngnnnnnngnanngnnnngnnnnnnnnnnnnnngnannnnnnnnannnnnnancgcgncc

SEQ ID NO: 5500 - DNA, 868 bp, Homo sapiens
  misc_feature 2, 3, 4, 5, 6, 7, 8, 9, 10, 11, 12, 13, 14, 15, 16, 17, 18,19, 20, 34, 44, 49, 50, 51, 59, 60, 61, 69, 70, 85, 99,100, 101, 102, 107, 108, 110, 112, 120, 123, 125, 136, 175,181, 193, 194, 198, 203, 210, 228, 230, 248, 250, 251: n = A,T,C or G
  misc_feature 254, 257, 261, 263, 264, 273, 278, 288, 289, 313, 324, 325,328, 334, 350, 351, 356, 362, 372, 377, 383, 387, 392, 397,410, 414, 429, 433, 449, 490, 494, 496, 503, 507, 509, 542,544, 567, 568, 569, 580, 582, 587, 594, 598, 610, 616: n = A,T,C or G
  misc_feature 637, 641, 647, 652, 662, 669, 690, 694, 714, 716, 720, 721,722, 723, 724, 726, 742, 745, 746, 754, 762, 780, 783, 793,795, 797, 804, 814, 815, 817, 819, 829, 830, 831, 842, 845,849, 850, 851, 855, 857, 863, 865, 866, 868: n = A,T,C or G
gnnnnnnnnnnnnnnnnnnnttttgggaaaaacnccctttgggnaaaannncccggggnnntttgaaannccctcctccggaaancccctttgggaaannnnccccnngncngttggganccnancgacccgaatncggcacgagccgaggaccagcgcagcgaggagaaggctncagcgngaggccaacaannagancgagnagcagcngcagaaggacaagcaggncnaccgggccacgcaccgcngnngcngcngggngnngggggaacncgggnaaagcaccanngagaagcagatgaggagccggcangtgaatggggnnaanggagangagaaggcaaccagannagagnggactncattctgagngagangaacgngccngactntgacncacctcccgaagnctangagcatgccaaggcnctgngggaggatgaaggagngcgagcctgctacgaacgcgccaacgaggaccaagctgatngacngngcccagngctncnggacaagaacgacggggagtaagcaggccgacnangagcccgagcgaacaggacccgnnncgctgccatgncngactnccggaanccanggggaccaaganccaggnggacaaaggcaactgccacangggncgacgnggganggccagcgcngaagaangccgcaagggggaacccaggngctnaaaccgaaggggaactggcnancagnnnnngngggggggccagcagcnacnnaccaacanggggcaanccgggaagggaaaaccangancaacgcgccngnanggaaggnaccggaaccnngnanaagaagcaannngggaacaacangangggnnngcananccatcncnncn

SEQ ID NO: 5501 - DNA, 1319 bp, Homo sapiens
  misc_feature 4, 14, 16, 18, 56, 59, 60, 61, 62, 63, 64, 65, 77, 92, 95,102, 113, 120, 145, 147, 152, 153, 155, 157, 158, 160, 162,171, 175, 176, 182, 183, 186, 187, 188, 194, 198, 199, 201,202, 205, 206, 209, 211, 213, 214, 215, 218, 222, 223: n = A,T,C or G
  misc_feature 224, 225, 229, 231, 232, 233, 236, 237, 238, 239, 240, 241,242, 244, 249, 250, 251, 254, 255, 257, 260, 261, 262, 264,267, 268, 269, 270, 271, 272, 273, 274, 275, 276, 278, 280,281, 283, 284, 287, 288, 290, 293, 294, 295, 307, 309: n = A,T,C or G
  misc_feature 311, 313, 314, 315, 316, 317, 319, 320, 322, 323, 330, 332,333, 334, 335, 342, 343, 344, 345, 348, 350, 351, 352, 353,355, 358, 361, 363, 365, 367, 368, 369, 370, 372, 375, 378,379, 386, 388, 390, 392, 394, 396, 397, 398, 399, 400: n = A,T,C or G
  misc_feature 401, 404, 405, 409, 410, 411, 415, 417, 418, 420, 422, 424,425, 426, 427, 430, 431, 432, 433, 436, 437, 438, 439, 440,441, 444, 446, 447, 449, 450, 453, 457, 459, 460, 462, 463,467, 473, 475, 477, 482, 483, 484, 485, 487, 489, 498: n = A,T,C or G
  misc_feature 499, 512, 516, 521, 526, 528, 536, 538, 542, 548, 552, 553,555, 569, 570, 573, 575, 580, 590, 594, 595, 598, 601, 602,604, 606, 607, 611, 613, 615, 625, 632, 636, 639, 644, 649,650, 651, 663, 671, 673, 677, 681, 686, 691, 701, 702: n = A,T,C or G
  misc_feature 705, 711, 712, 714, 716, 728, 738, 739, 744, 745, 746, 747,748, 753, 755, 764, 771, 773, 780, 781, 782, 783, 784, 786,792, 794, 797, 803, 812, 820, 821, 822, 823, 828, 834, 835,841, 842, 843, 845, 846, 849, 856, 862, 866, 868, 871: n = A,T,C or G
cccnaaaaaaaaanangnccccttttgggggtcaaaaaaaatcccggccccaattnttnnnnnnnttttttcaaaanaaaaaaccccccctnacnttttttnccaaaaaaaanccgcccntttggggggaaaaaaaaaccctccncnaaaanncngnncntncaattcaanaccnngagggnnatnnngccccnaaannannccnnaangngnnncantagnnnnaaanannngannnnnnncncaatnnnggnngnccnnnanacnnnnnnnnnngncnnannaannanacnnnaaggggggaaantncntnnnnnannannaaagggngnnnnccaaaannnnaanannnngnggnaanananannnngnagnacnngaaaccncnanantncnnnnnnaannacannnaccnannanancnnnncannnnccnnnnnnaanannannagnaaangnnannaaancgaganancnaaacnnnnananaacccacanncaccagaacacancagnacagncaaancntcacatananaaangtgcantacnncnatatcccgacacannccnanagacnaaatacaacngatnnacncannanannaccnancnaaaaaacaancacaaancaanganaaaanaacannnaacgacactaanaagcacananacgngccnacaanacccnacacaaaccnnacngccaannancnaaaactaaaacngaatatcacnnacacnnnnnaactncnacaaaaacnaccaccngnaaaaacnnnnngnaaaggngncancaaatngaaaaaacnaaaaaaannnnaccangcacannaaaacnnntnnacnatgacanacaaanaaananacnntaaaannnaacaannacaacncnaacannttaaanncaaaannatancccgcagcnaaattaatangnnanancntcacanannaaannaacnaaccccantgtananaaaccncaatancaccacnanatanncaaaggtaanganaaacccanaaanaccanatntnaaacaagcgncaaaccanaacnngacccatccaannatncnaacacaaanaaanatatncatnaaacacacacaanaccacctcnnnaannnacntaccntanaaacatncaaaanctnnatngacacnnacaaaacagcaccanntcaanaccnaananactacacagagatacanagacaanntnnnnncnnagaaaccacacgacccatnanacnnacctntcncacnacncnntcnancgcgggagnnaaaaataanacacanaaacacacnca

SEQ ID NO: 5502 - DNA, 1088 bp, Homo sapiens
  misc_feature 5, 6, 21, 22, 33, 34, 35, 54, 71, 84, 93, 99, 101, 108, 109,112, 114, 116, 121, 122, 123, 125, 128, 131, 132, 133, 134,135, 138, 139, 143, 148, 150, 151, 155, 156, 158, 159, 160,162, 163, 164, 165, 166, 169, 170, 171, 173, 174: n = A,T,C or G
  misc_feature 175, 176, 178, 182, 185, 190, 192, 193, 194, 196, 198, 199,201, 202, 207, 208, 209, 210, 211, 213, 214, 217, 225, 226,228, 229, 230, 233, 235, 236, 241, 244, 246, 247, 249, 250,251, 252, 253, 255, 256, 257, 258, 259, 260, 262, 263: n = A,T,C or G
  misc_feature 264, 268, 272, 273, 274, 276, 278, 279, 280, 283, 284, 286,288, 292, 296, 300, 301, 302, 304, 305, 306, 307, 309, 310,311, 313, 315, 319, 320, 323, 324, 325, 327, 328, 329, 333,335, 336, 337, 341, 345, 346, 349, 350, 352, 353, 354: n = A,T,C or G
  misc_feature 356, 358, 367, 371, 372, 373, 378, 395, 399, 403, 405, 408,412, 429, 431, 435, 437, 439, 444, 446, 448, 457, 461, 464,465, 473, 485, 487, 492, 501, 505, 507, 508, 511, 520, 526,527, 528, 531, 535, 538, 544, 548, 550, 551, 556, 565: n = A,T,C or G
  misc_feature 567, 568, 573, 582, 585, 587, 591, 592, 597, 600, 601, 606,619, 620, 621, 627, 629, 632, 634, 642, 649, 652, 660, 668,673, 674, 678, 679, 683, 686, 688, 689, 692, 694, 707, 708,717, 721, 724, 735, 741, 744, 745, 752, 757, 761, 763: n = A,T,C or G
  misc_feature 771, 773, 780, 781, 784, 788, 791, 795, 804, 806, 813, 816,820, 824, 825, 827, 831, 833, 837, 839, 841, 845, 847, 855,862, 863, 868, 869, 871, 872, 876, 878, 880, 885, 887, 888,893, 894, 895, 896, 900, 902, 904, 910, 912, 913, 922: n = A,T,C or G
gaggnntttttccaaaaaaannccccagagggnnnatttttgcaaaaaacgccntttggttttacaaaaanccgctttttgggnaaaattttngggccngnaaaaagnnatntntngggannnanaanaannnnnaanngganggganannaaannannnannnnnaannnannnnanaganaanagggngnnnangnnannttttnnnnnanngangggggaannannnacnannggggnganannannnnnannnnnnannngggngggnnnanannnaannangngggnaganagannnannnngnnnananaccnnagnnnannnaganannnaaanaaannccnnannnananaagaaacanaagnnnaaaanacaggaaaaaaaaaganaaantacngnaantaanacaaaaaaaacaaaacnancatngnancaggnananagtagcaanaacnganngaaggcanaagagagaaagncntgacnaaagaggangagntnnttnaactaaganagagannnacngaantgnaaacangaancnnatganaaaaaaggntnngacanaagaagaangcnanacannaaaanganngaagnatgaaagaaaaannnaaagcntnggnanaaaaaaanagagatnaanaaaaaatnaaaagaanagaannaacnnaatntcngnnaancncgagaaaaatggnnaagaaacangaanaanatacaagaacnaaaganagnncggaaanaaganaggnanaaagaacnanatataannganaagntanacanggataacangnagatganaangagnacannanagananatgnangngacnanagggagantaaaaanntaagnnannaaanananaagcnanngagannnnaccngnanacgggnannacataacanactnannnnanaaaatacnnnaaagggagananacgcanaatnnngcanaannannananaacgaagaatangaagngannncagganagatagaaananganntagaacngaaannaaantnnncaaancaatnanaaanagncanngnacatanaaaacaacnn

SEQ ID NO: 5503 - DNA, 1267 bp, Homo sapiens
  misc_feature 20, 27, 35, 37, 38, 46, 53, 54, 69, 91, 92, 105, 110, 112,113, 117, 118, 119, 120, 121, 125, 126, 127, 128, 129, 130,131, 132, 134, 135, 136, 138, 141, 142, 143, 144, 145, 146,148, 149, 150, 153, 155, 158, 159, 163, 165, 166, 167: n = A,T,C or G
  misc_feature 169, 170, 172, 173, 174, 178, 179, 181, 184, 185, 186, 188,189, 190, 195, 198, 199, 200, 202, 204, 210, 211, 212, 214,215, 216, 217, 218, 220, 225, 228, 229, 230, 232, 233, 234,235, 236, 237, 238, 239, 240, 241, 244, 245, 246, 248: n = A,T,C or G
  misc_feature 249, 250, 252, 254, 259, 260, 263, 265, 267, 269, 271, 272,274, 275, 278, 279, 281, 282, 283, 285, 287, 290, 291, 292,295, 297, 299, 300, 301, 302, 303, 304, 305, 306, 308, 309,310, 313, 314, 319, 322, 323, 324, 325, 326, 327, 329: n = A,T,C or G
  misc_feature 331, 334, 335, 338, 339, 340, 342, 345, 346, 347, 348, 349,351, 352, 354, 357, 361, 362, 363, 364, 367, 369, 371, 372,373, 374, 376, 378, 381, 384, 388, 390, 391, 392, 395, 401,404, 405, 406, 409, 411, 412, 413, 415, 416, 417, 420: n = A,T,C or G
  misc_feature 421, 422, 424, 425, 431, 432, 447, 449, 450, 455, 456, 462,469, 470, 475, 478, 484, 487, 490, 491, 495, 496, 499, 501,504, 517, 520, 522, 523, 524, 525, 529, 536, 539, 547, 548,551, 552, 557, 561, 563, 568, 571, 572, 573, 576, 578: n = A,T,C or G
  misc_feature 579, 583, 584, 587, 588, 590, 591, 598, 599, 600, 601, 603,604, 607, 610, 617, 622, 625, 626, 636, 637, 638, 644, 649,650, 651, 653, 655, 657, 662, 665, 666, 667, 668, 669, 670,671, 677, 679, 684, 685, 686, 687, 689, 696, 699, 700: n = A,T,C or G
aggtttttttgcaaaaaaanccccccntttttggncnntttttgcnaaaaaanncgccttttggttttnaaaaacaccccccttttttgcnnaaaattatacgcncagtnannatgnnnnntatnnnnnnnnannnanaannnnnnannnaananaanngggngnnnannannnaaannanaannnannnttttntannnangnaaatannnannnnnanatttnttnnnannnnnnnnnnaannntnnntntnaaaannggngngnanannannacnnannntnanatnnnaananannnnnnnnannntanngaggngannnnnnananaanngannnanaannnnnannancanaatnnnnaanantnnnngnanaanaantaanannnacnaatcanaannnaanannnannnaannnannaataanncaaaaaaaaagccananntatannaaaacntcaatanncgtanaanaagaanatnacnnatannaananaanactaccaaaactnaanannnnaatncatatcnaanataactannaanngaatnatanancaganaannnagnannaatnntannannaaagcannnngnnaanacntcaagcntagantanntacaaatacnnnaaatantaacnnnanananaaaanaannnnnnnaacatncnaagannnnanaacaaanaanngnacaannantaacnannananaaananatataaacannaananannnaataaataaantatanataangngntcanatatnnaagacaancnaantaaacntnnancatnancgaactataaatagaannganatatganataanatnanntanaacncnatatatancnagtanatntnanancactananatacnannanaaantcntactanacannaacanctnnaactnanannantannnagnaacacncatanancgannnaatancnctnaanntnnannactctgaanaaannacanataaataactatanangctagnnacantncacntagtannnaatatntananattcnctanatananntntanatcactacgnactcanacatanaaannaagtcttanaganaaatatcactcaanaannnangggncactatntanncatnanncanaatannncancatatannacanataaantnnanatcnnaangatnaaatntnanangacnanacanatangtntatnnctaanctgtaaatacancacgaa

SEQ ID NO: 5504 - DNA, 1235 bp, Homo sapiens
  misc_feature 10, 18, 33, 35, 37, 40, 45, 50, 53, 54, 57, 59, 61, 68, 70,71, 73, 78, 82, 84, 85, 99, 104, 109, 123, 125, 126, 127,131, 139, 144, 151, 154, 156, 161, 165, 168, 175, 178, 193,201, 204, 207, 208, 209, 210, 223, 228, 230, 237, 240: n = A,T,C or G
  misc_feature 244, 246, 247, 250, 251, 262, 269, 271, 272, 277, 283, 284,287, 294, 296, 300, 301, 310, 314, 319, 323, 326, 346, 348,349, 355, 356, 359, 360, 363, 364, 365, 371, 384, 388, 393,395, 399, 403, 406, 408, 414, 420, 423, 426, 427, 429: n = A,T,C or G
  misc_feature 434, 435, 436, 440, 442, 447, 452, 454, 458, 466, 472, 476,479, 485, 496, 498, 499, 502, 506, 514, 515, 517, 518, 521,533, 535, 541, 548, 551, 567, 570, 571, 580, 581, 583, 587,608, 611, 613, 615, 616, 621, 625, 637, 642, 644, 654: n = A,T,C or G
  misc_feature 664, 679, 683, 699, 711, 712, 722, 727, 728, 730, 731, 732,745, 761, 764, 768, 774, 777, 781, 782, 785, 786, 796, 802,803, 807, 819, 822, 825, 832, 833, 853, 862, 864, 865, 866,872, 879, 886, 890, 898, 900, 905, 916, 917, 919, 926: n = A,T,C or G
  misc_feature 931, 933, 941, 948, 962, 980, 990, 991, 994, 998, 1009, 1010,1021, 1024, 1026, 1033, 1042, 1058, 1060, 1066, 1072, 1073,1083, 1084, 1086, 1088, 1092, 1108, 1110, 1131, 1137, 1144,1147, 1148, 1151, 1152, 1162, 1176, 1180, 1190, 1196: n = A,T,C or G
  misc_feature 1210, 1211, 1214, 1228, 1235: n = A,T,C or G
gtttgaaatncctttggnatttctaatgcttgntnancgncattnatatntgnngantngnttggaantnngnacgangatntnntaaagcatgtttanaagtnattanaatggacggtttgncnnntaangattgggnataantggtggnaanantggantganttngtattgnttngatttgagttatctnattgaganctntannnnataaggagagttntattntnataaagntantagnanntannggatccttatntatcttngnnatgtnttaaannganataatantntttnnaattttacnattntaganattnatnggtgaaactttatcatatgntnnaaattnntannttnnnaatctntgcaaaaaattantagntttantntatncatntcnantttttntatttnttnctnntnattannnttantntgatntatgnanttcntaatttcntttatnatcnctnttactnatataattttnanntanaaanaagtaatnnannatntttgaatatatntntatcanaatatgnganattataatcatttatnttnnatagtatanntnatgnatgtagatatatatctatagntgntntnntattntttngatctgtatagncatcngnactaatatantttgtgatanagctattatggggantatntaaaactattgatgtnaaaaaaacatanntttataagantatanncnnnacgttataatagntctctgtacctattangcnattngattanaanattnntcnngatacctatntgtatnncatnacatattatatnggnganttatttnnttgtatataggattactatnttatgatanannntctttntataatnaaatatnatantgagggtntnctttntacagttgtanntnaaatatnagcgntnttaataanatagagngatatatgacattnatttatatatattaagantgtaagattnnatnaagnagtaatatcannatatagtatcnatnantgtcttncatggatgntatggatacttagtgntngtgaantttatnnttatatatanntntnattngtaaaatatactatantntatatatctgatatatataangaatgnatctatnatnnacnntataatatcntgtacgattaaaanattnaatatatgtntatatntgaatatgtataannaanctactgtctattgntacagan

SEQ ID NO: 5505 - DNA, 1235 bp, Homo sapiens; identical to SEQ ID NO: 5504
  misc_feature 10, 18, 33, 35, 37, 40, 45, 50, 53, 54, 57, 59, 61, 68, 70,71, 73, 78, 82, 84, 85, 99, 104, 109, 123, 125, 126, 127,131, 139, 144, 151, 154, 156, 161, 165, 168, 175, 178, 193,201, 204, 207, 208, 209, 210, 223, 228, 230, 237, 240: n = A,T,C or G
  misc_feature 244, 246, 247, 250, 251, 262, 269, 271, 272, 277, 283, 284,287, 294, 296, 300, 301, 310, 314, 319, 323, 326, 346, 348,349, 355, 356, 359, 360, 363, 364, 365, 371, 384, 388, 393,395, 399, 403, 406, 408, 414, 420, 423, 426, 427, 429: n = A,T,C or G
  misc_feature 434, 435, 436, 440, 442, 447, 452, 454, 458, 466, 472, 476,479, 485, 496, 498, 499, 502, 506, 514, 515, 517, 518, 521,533, 535, 541, 548, 551, 567, 570, 571, 580, 581, 583, 587,608, 611, 613, 615, 616, 621, 625, 637, 642, 644, 654: n = A,T,C or G
  misc_feature 664, 679, 683, 699, 711, 712, 722, 727, 728, 730, 731, 732,745, 761, 764, 768, 774, 777, 781, 782, 785, 786, 796, 802,803, 807, 819, 822, 825, 832, 833, 853, 862, 864, 865, 866,872, 879, 886, 890, 898, 900, 905, 916, 917, 919, 926: n = A,T,C or G
  misc_feature 931, 933, 941, 948, 962, 980, 990, 991, 994, 998, 1009, 1010,1021, 1024, 1026, 1033, 1042, 1058, 1060, 1066, 1072, 1073,1083, 1084, 1086, 1088, 1092, 1108, 1110, 1131, 1137, 1144,1147, 1148, 1151, 1152, 1162, 1176, 1180, 1190, 1196: n = A,T,C or G
  misc_feature 1210, 1211, 1214, 1228, 1235: n = A,T,C or G

SEQ ID NO: 5506 - DNA, 750 bp, Homo sapiens
  misc_feature 2, 9, 12, 15, 18, 19, 22, 30, 514, 622, 650, 710, 714, 745,750: n = A,T,C or G
tntaatttnatnctntannccnttcaactncttgttctttttgcaggatcccatcgattcgaattcggcacgagatgagcccatgaacttccccagaaactcattgtcttctatttccgtaacagctcctaaccactagtcgggctttgcacacagcgacttctccgtaaatgttgactgcagggcagaaagaaaggctaaaagttcttaggagaatgtttgcctttgcatgtatatgctggcgatgctaataagtcccagctagacctggcagtgagtaagttcaggggtggcaatttaattttcttgctattagtaaaacaaacagtaggtgggatgggtggtaagcttaaatatctctgacgcgccatttaaaccatccatcccacctgtgggttgtctgcacctgctcttttgttgcggtgggtctcctaatttgcttttcagtccctttcatcttatcattgttctcaaaggcaccgctctgcaaaccacataaaggcctttcaacttncgctgcattttgttttattcagccaattgactagtactgtcagctaattggattggaaatgtaaaatgaaagctgtattattcaactgccaacctcctcacttggcanggagtgggtgatgctggtaattgaccanaagtgtaattgctctgggtctgcctctggatttaacaatgaaccctgggagggctttctntganacacttgatacctgcttttttttttttcccnggggn

SEQ ID NO: 5507 - DNA, 808 bp, Homo sapiens
  misc_feature 4, 5, 6, 7, 8, 21, 27, 29, 453, 549, 685, 690, 709, 712,734, 739, 740, 741, 742, 743, 748, 750, 751, 752, 753, 754,755, 756, 757, 758, 759, 760, 761, 762, 763, 764, 765, 766,767, 768, 769, 770, 771, 772, 773, 774, 775, 776, 777: n = A,T,C or G
  misc_feature 778, 779, 780, 781, 782, 783, 784, 785, 786, 787, 788, 789,799, 804: n = A,T,C or G
gttnnnnntttgaatcccttngctctngnctttttgcaggatcccatcgattcgcactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcatttttttttttttttggctagagtttccactatcccaataaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgntgttccattttatgcagaagcatattttgctggtttgaaagattatgatgcatacagttttctagcaattttctttggttctttttacagcattgnctttgctggactcttgctgatggctgctagattttaatttatttggttccctacttgataatattaagggattctggatttcaggttttcatttggtttgcttttggttttttcctcatgtaaccattgggggaanggatncaaggaatttgacacaaanggngggaataaaacattaattttgngcccnnnnnaaaanannnnnnnnnnnnnnnnnnnnnnnnnnnnnnnnnnnnnnnnaaacctcggnccttntaaa

SEQ ID NO: 5508 - DNA, 1008 bp, Homo sapiens
  misc_feature 5, 7, 9, 10, 12, 13, 14, 16, 17, 18, 19, 20, 21, 23, 24,25, 26, 27, 28, 29, 31, 32, 33, 34, 36, 37, 38, 39, 43,44, 50, 52, 53, 56, 63, 99, 100, 106, 114, 117, 118, 134,136, 145, 162, 164, 188, 227, 242, 244, 318, 325, 326, 330: n = A,T,C or G
  misc_feature 333, 338, 348, 351, 353, 354, 379, 400, 407, 410, 417, 419,438, 445, 450, 465, 484, 487, 489, 495, 506, 514, 516, 532,542, 548, 566, 572, 573, 580, 582, 588, 590, 594, 595, 602,605, 611, 616, 619, 627, 628, 643, 647, 648, 655, 667: n = A,T,C or G
  misc_feature 670, 710, 714, 725, 734, 736, 759, 771, 782, 786, 790, 793,808, 812, 814, 820, 823, 824, 826, 835, 840, 842, 846, 848,857, 864, 868, 873, 878, 894, 897, 901, 902, 918, 930, 941,942, 952, 961, 973, 983, 987, 988, 990, 999, 1003: n = A,T,C or G
  misc_feature 1004: n = A,T,C or G
ccgcncncnncnnngnnnnnnannnnnnngnnnngnnnntttnnttttcnannccnttcagcnccttgttcatgatgcaggatcccatcgattcgaacnngcacgngtctatcnctnngtgaagcactaccccngntacgggttncaccatgcctgggcagntnggccatgggcccggtcacgaacanaacgggcctggacgcctcgcccctggccgcagatacctnctactaccagggggngnactcccggcccattatgaactcctcttaagaagacgacggcttcaggcccggctaactctggcaccccggatcnaggacanntgangancaagngggggtcganacntnngggagacggagttgcatagacgcanggggagaagaaattcataacnccccggnccnaacaccncnaaggacagcagtcgttttnaccccgntgcancccgttctcggtccnaacagagggccaccacagnatncnccacanttctatattanggaggaanancggggaaagaatgtanaattttgaanaataancctactggtggtccaaanaactgnngccgacncncttgcntngtgnnaaagcgnccntggcangattnctngaaatttnntttggttggttgggnaggnnccccccntcccatttgccncgnccggttggcaaggggaaatttcctttcctttcaccctcantatnaaaaggttttncctgggagntngaactttcggggggttaaaaaancccattgtgggngcccaataaanccangacnccncttagggggggaagncccntnccgggnganntncgtgtccanaacgngngggncngtatctttngtggggncttntttcnaaccnattttggggggaggangcngggnntaacccttggcaaccncccggaaacatngggtgatgtgnnaaaacatttncggatgcanaatattttggcncccggggggngccnnantatatttgnggannagcc

SEQ ID NO: 5509 - DNA, 1690 bp, Homo sapiens
  misc_feature 3, 6, 7, 9, 10, 13, 14, 15, 18, 19, 20, 21, 22, 26, 27, 28,31, 32, 33, 35, 36, 37, 39, 40, 41, 42, 48, 49, 50, 51,52, 54, 55, 56, 57, 58, 59, 61, 62, 67, 69, 70, 71, 73,75, 76, 77, 79, 85, 86, 88, 90, 94, 96, 103, 104, 105, 106: n = A,T,C or G
  misc_feature 108, 109, 110, 111, 112, 116, 119, 120, 121, 122, 123, 124,126, 129, 132, 134, 136, 139, 141, 143, 144, 145, 150, 155,157, 159, 164, 165, 166, 168, 169, 172, 174, 175, 179, 182,183, 184, 190, 192, 194, 196, 197, 198, 203, 208, 209: n = A,T,C or G
  misc_feature 210, 212, 217, 220, 221, 226, 227, 228, 232, 233, 234, 236,241, 242, 243, 245, 249, 251, 253, 258, 264, 268, 272, 274,275, 276, 279, 314, 323, 327, 328, 342, 343, 358, 360, 366,368, 370, 374, 376, 377, 393, 396, 398, 399, 401, 402: n = A,T,C or G
  misc_feature 407, 410, 411, 413, 416, 424, 425, 426, 429, 432, 433, 436,442, 444, 445, 450, 468, 469, 470, 473, 478, 481, 484, 485,490, 491, 493, 498, 500, 501, 505, 507, 508, 517, 521, 523,524, 525, 530, 533, 534, 537, 538, 539, 540, 542, 543: n = A,T,C or G
  misc_feature 547, 550, 555, 558, 561, 562, 563, 564, 573, 574, 577, 588,590, 592, 594, 595, 600, 602, 603, 605, 606, 607, 609, 612,614, 615, 616, 617, 620, 633, 634, 637, 638, 641, 643, 644,647, 649, 653, 654, 661, 663, 666, 670, 674, 675, 678: n = A,T,C or G
  misc_feature 679, 683, 686, 687, 698, 703, 705, 707, 710, 712, 716, 718,720, 724, 726, 727, 728, 730, 732, 735, 738, 740, 742, 744,746, 753, 755, 757, 772, 774, 782, 784, 788, 789, 790, 794,796, 797, 798, 802, 807, 809, 810, 812, 815, 817, 819: n = A,T,C or G
ccnccnnannacnnngcnnnnnaaannnaannncnnnannnngaaacnnnnnannnnnnanngcagngnnngnannnangcgagnnancngaanangacgcannnnannnnngaangannnnnncncgnggngncntgnanannnacaanaggcngnanacacnnngnnganannggcncannnacacgnananannnaccanaacannncngctancannaagannncacnnnanagcannncncagngngnggganccgagngcgngacntnnnccnattttttgggaaaccgggttttgggccaaaaacgngcttggggnagannctcacaaacgcacnnaggagacgagagagngnagccgngncnacgntnnaccagctacagcgaantcncnngnncgccnagnngnaanacgagacnnnagnagnnacnaccaanannaccangggaaggggggggaaccnnncgnccaanagnccnnacacnnantaaananngagngnngtaagacanccangnnncaaantgnnaannnnanncaanacnaaaanaanccnnnnacctatacnnagncacaacaactnanancnnagaanannannntntcnannnnaancaaaaaagaatcnncanntanannagnancganncgcgcananccncaangtannaannatantannacacgacgganacatngnanacnangcgnananacangnnnancncancananancnangaagatntntncgagaacgcgctgcngnatacacancngctnnngacngnnnaacnccagnannangcntnangacncacnnnacacacncgcnannncancngcacagcgnngatanacgaacgnnncaagctcnagnaanacaggtangccacangnagagnanaccnnnnacnagnnaaanaagncacatcaccgatanatnctcgannncnaccagcnnnnnncnagngacnncaccgcnnnnanctctnncnacangnnnangnaccnnngcntncacacgnanaanaatctncncccagaagcncggcncncgncacganacgcagagnaccgncagnatnantnacgcgcaaanagcgacanaangcangnccaagatanagnnganagcgnnatannagcacgtcnacacagcganacnngaagancacgngnanntnntnaganacannnngnaanacagcctntgacgnaacacagcannacatcnnacagctcngacancacganananggacagncncnganacacgngaacnacncaannncacannagangagancannctnannnagatgananctancanncacgngatnncactatatngannangnncgntgccgnngnnancagcagccngcaccancncctacttgcntactnnatncnatgagcaccaacganataagannaccacnccctnnancgannanatgaacacatncanntaaanngnagantnantanacgacnnncncannnacngangtacagnnnnntcaccanngncgnnngatangctcnnntatactaacnnanananagnnnnaacaacagaaanaancacnagacagagaagcnnncncatgatnncccactcacgancnnnngagtcngcngannntccnnnnctnatcnncagaantncntnncn

SEQ ID NO: 5510 - DNA, 839 bp, Homo sapiens
  misc_feature 14, 71, 73, 77, 78, 80, 81, 84, 94, 97, 100, 102, 107, 125,130, 135, 138, 140, 150, 168, 169, 171, 172, 176, 179, 182,183, 186, 194, 195, 198, 200, 213, 215, 217, 220, 221, 222,223, 224, 231, 232, 233, 237, 241, 242, 243, 247, 249: n = A,T,C or G
  misc_feature 253, 257, 260, 261, 265, 266, 271, 272, 273, 276, 277, 282,283, 291, 292, 295, 296, 297, 301, 302, 309, 310, 313, 314,316, 318, 325, 326, 335, 352, 354, 361, 369, 373, 385, 395,396, 404, 423, 427, 428, 432, 444, 449, 450, 457, 459: n = A,T,C or G
  misc_feature 463, 466, 467, 469, 479, 480, 481, 487, 494, 495, 503, 507,511, 512, 514, 525, 533, 539, 559, 560, 572, 586, 598, 601,604, 609, 613, 617, 621, 622, 624, 627, 628, 641, 642, 644,645, 656, 670, 676, 679, 686, 695, 701, 704, 706, 718: n = A,T,C or G
  misc_feature 719, 725, 727, 733, 739, 753, 771, 775, 800, 804, 807, 822,836: n = A,T,C or G
tttgaaaacctttnatacaagctacttgttctttttgcaggatcccatcgattcgaattcggcacgagggnangganncnncangatcttgganggntcncnctggncgagaccaaggaaaagcntcggncgatnggngncccaatgcanggtgatggggatggcttnnannctantgntgnnccnatatccannatnangctggtgcataangnantcnnnnnccctaannncgcngaannntggncngatnttgntcnngacnntgtgnnnttnnatgtnnacactgtnnttnnnaacnntgttcgnnccnncnangctgatnntgacctggncaatgacctgctgtggnantgctggnttcactgntcangtgactatattnatccatacannaccaattnaccttgctcatatcatccntagnnttgnattgccactcgngattnnattgcantncaangcnnanctttaactannngggatnataaatnntccgcccntttnttgnnanaaaaatcttgnaaaggaanagcccnttacacttgtaaggaaattnnggccccaacctnagcaaatggcatanaaaaggttggcnggncangtccnatanaaancttnnangannattgtcaaaacanntnnacctttctggncatgaatcattggntgttgnttntagactnccaagagtntggggnggntntttttcaaaaannttttananagaacntttgcncggaactgttcagngggcaatcaactttttcncggnaaggctttagactgctaaaatggantttnttnccttataactgccancccaaatctttatncct

SEQ ID NO: 5511 - DNA, 848 bp, Homo sapiens
  misc_feature 2, 3, 4, 5, 6, 7, 8, 9, 10, 11, 14, 16, 62, 65, 68, 83, 88,109, 110, 113, 119, 142, 144, 147, 153, 154, 178, 198, 243,259, 262, 267, 281, 308, 310, 316, 332, 340, 350, 359, 399,409, 422, 467, 476, 482, 497, 498, 542, 569, 585, 598: n = A,T,C or G
  misc_feature 610, 626, 635, 644, 670, 674, 682, 709, 718, 734, 761, 799,800, 801, 802, 803, 808, 810, 811, 825, 831, 834, 843: n = A,T,C or G
gnnnnnnnnnnttntnaatatacagctcttgttctttttgcaggacccatcgattcgctcangcnggngcctccttccccagntttgntgcctgagtggaaccagtgcnnacncacagnccggaaaaggcgcatctaacgcntnttnaggctnnggtaactgcggacaagttgctttnacctgatttgatgatacatntcattaaggttccagttataaatattttgctaatatttattaagngactatatgaatgcanctncattnaccagtaacttatnttaaatatgcctagtaacacatatgtngnataatntctagaaacaaacatntaataagnatataatccngtgaaaatntgaggcttgataatattaggtagtgacaatgaagcatggnagaagctgtnacagattacatanagaataatgaggagattatgatggaaccttaatatataatgttgncagcgattntagttnaatattcgatactgnnatctatctgctgtatatggaatacttttaattcaaacgctgaanacgaatcagcatttagtcttgccaggnacacccaataatcagncatgtgtaatatncacaagttcgtntctgttttgggttatnttgatggtnggtttgtgnttttgctttaagttgcatgagctttntgcnggaaatantcactcatcccactccagataaggggnttagtcatnagaaagtctgtctggntgatgatggatacggggccaatctttntcccctttctggttaatagtcattacatttctatgccnnnnnaggancnnatccataactttancttaangtncacattggnatttt

SEQ ID NO: 5512 - DNA, 1690 bp, Homo sapiens; identical to SEQ ID NO: 5509
  misc_feature 3, 6, 7, 9, 10, 13, 14, 15, 18, 19, 20, 21, 22, 26, 27, 28,31, 32, 33, 35, 36, 37, 39, 40, 41, 42, 48, 49, 50, 51,52, 54, 55, 56, 57, 58, 59, 61, 62, 67, 69, 70, 71, 73,75, 76, 77, 79, 85, 86, 88, 90, 94, 96, 103, 104, 105, 106: n = A,T,C or G
  misc_feature 108, 109, 110, 111, 112, 116, 119, 120, 121, 122, 123, 124,126, 129, 132, 134, 136, 139, 141, 143, 144, 145, 150, 155,157, 159, 164, 165, 166, 168, 169, 172, 174, 175, 179, 182,183, 184, 190, 192, 194, 196, 197, 198, 203, 208, 209: n = A,T,C or G
  misc_feature 210, 212, 217, 220, 221, 226, 227, 228, 232, 233, 234, 236,241, 242, 243, 245, 249, 251, 253, 258, 264, 268, 272, 274,275, 276, 279, 314, 323, 327, 328, 342, 343, 358, 360, 366,368, 370, 374, 376, 377, 393, 396, 398, 399, 401, 402: n = A,T,C or G
  misc_feature 407, 410, 411, 413, 416, 424, 425, 426, 429, 432, 433, 436,442, 444, 445, 450, 468, 469, 470, 473, 478, 481, 484, 485,490, 491, 493, 498, 500, 501, 505, 507, 508, 517, 521, 523,524, 525, 530, 533, 534, 537, 538, 539, 540, 542, 543: n = A,T,C or G
  misc_feature 547, 550, 555, 558, 561, 562, 563, 564, 573, 574, 577, 588,590, 592, 594, 595, 600, 602, 603, 605, 606, 607, 609, 612,614, 615, 616, 617, 620, 633, 634, 637, 638, 641, 643, 644,647, 649, 653, 654, 661, 663, 666, 670, 674, 675, 678: n = A,T,C or G
  misc_feature 679, 683, 686, 687, 698, 703, 705, 707, 710, 712, 716, 718,720, 724, 726, 727, 728, 730, 732, 735, 738, 740, 742, 744,746, 753, 755, 757, 772, 774, 782, 784, 788, 789, 790, 794,796, 797, 798, 802, 807, 809, 810, 812, 815, 817, 819: n = A,T,C or G

SEQ ID NO: 5513 - DNA, 780 bp, Homo sapiens
  misc_feature 567, 664, 683, 689, 713, 737, 744, 758, 775: n = A,T,C or G
ttttcatacagctcttgttctttttgcaggatccctcgattcgaattcggcacgaggtgaggctctcttaaaaaatttaaaaatactgaagaaacaaagggaggagtttgtagaatctggagtggaggaaacttctgtgtcaccaaacacagaaaccatcaaagaaaatctttcacttccaaaattagtctatagaaaaaaaaaagaaaatcttaacccaaataagagactgaggcaagagcttcaatcaatcgaggtttactgagccagagttggagcgtgccaggaaagcaacacaagtcaaagaaacgtctgtggcctgtgctctcccaagaagttttcaggaggctcaatatttgtacatttctttaaaggggagaagacagtgaggcaaatggttatgtttttgtgagactcttaattagtgtcccgtaaatctaagctatatggaagatagggtgaacactggaagaacagggagtaacagaagaccaattatgcagaggtctcaggttaggtggaggaatgattgatctcatcttatccttgtctgcacctgggcagatnaactttgtaattgacattgtcagtgtgaaatttacaagacttttggttttaggagttaggtttaggttgccagacctaaagttgcagttgacatgtncttgttttataggaggatntccatnctgaaagtttagggactggccaanaattactggtgagcaatttgtgantgcggcnctggagatcatgangctttttgcctttttgngggat

SEQ ID NO: 5514 - DNA, 712 bp, Homo sapiens
gttttagagcagctcttgttctttttgcaggatccctcgattcgaattcggcacgaggaactagtctcgagtttttttttttttttttttatgatattacaccataggttttattaacgataaatgtttgcattacttttaaaagcttagctcttactaagcattctttaacaaaagctaataagcaagaaatcatttgccatacggaaactatattcacaaacaagactttaatccaatattgaaagctaaagaattagaaaaaatacaaaacactgctatgagtcaattgaactgctatcattgaatttgctgcatttagaatgacataaacatactgaacataaaaacaattttatggatttattctataagactagcattaagaatgacatacaatttgtgatttcctttaaaaataattttttacaacagaatccatttgaacaaagggtctttttttcccctcatttgaggggaagacaatctatgtttcccaaacagatcctcctttcatactaaaatagcaaactgtggcctcgatctcctcttcccagatgctacttatagatgactttgcataataacttaattagaattacttttctggtaacagtgtcacggccataaataatcagtttttaaaaaacaaacatcaagggcaaatctagaaaacttcctttaaaggaattacccaaacccagcacacatg

SEQ ID NO: 5515 - DNA, 782 bp, Homo sapiens
  misc_feature 3, 8, 23, 29, 729, 735: n = A,T,C or G
gtnccctntaaaaccttttttanaatctncttgttctttttgcaggatcccatcgattcgttcatatttgaagaattagaaatgaagtccgttcagattctccaaagaacctccagccactggtgggggacattcttaattcacattcctatcagttggtatctcctgtccctgaagacactgatgaggcttgggaggagaatcccacctttccctgcagggggttaggctgggcagggcagggaggtgagggcgctggtccagaacactggcaagggatgggaacctaacttcttctgtgcttctgatttgcccttgcaggtgtttttccaggtctgaccacctggccctgcacatgaagaggcacctctgagggagcagagaggtggatcctgtaggctaaaaggcttccaggctgagagcccggcccgtggaaggagggatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccccttgagactttcatatagaccttgcacaacaattgtatagatcacacaccggcttgtatttaatatgtaacattttcncacatnttaaagatccagaagttttaaaaaacccccaatgttaatgtatttgc

SEQ ID NO: 5516 - DNA, 782 bp, Homo sapiens
  misc_feature 6, 12, 18, 503, 650, 661, 667, 671, 672, 673, 674, 675, 676,678, 681, 682, 689, 698, 722, 723, 726, 742, 761, 765, 768,774: n = A,T,C or G
gagccnttgaancctatntacaatctacttgctctttttgcaggatcccatcgattcgaattcggcacgagaaaaaacctcctgggactgttgcaaggatgaaatgaaggattgagggattgagggattgctgagctggagctccaggtgtcctatctttctcagtggggtggcacggagcggggccgcctccctcttctctccaggcaggtggggctgtggttatgcgatagggtctcccttccctccagcccatgccagaggagcttgtaactctttatcctcatggtgcccactacgagtcatactcttccccatgctgctcattctcctgggccccatccactcagccaaagcagaatgcagggtttcctgcctgacaacccttctcacctcccaagtcccacttttgaacaagctgatgattctgaaactggcccaatttcctaacaagccggatgcttgagaaacctacatttggacaatgagaggctgctcctgcngcctgcgggccacctcctcttccttggctcctgctttctttttagactatatcaacctacaactttactcgggaagagggacaggggtggacctgagtttcgtctcctgtctctctggctgatgtcacctggaataaagccttcttncctggccaaanaaaaanaccnnnnnnanaanntacttcnagcctctanaactatagtgagtcgtattacgtnnaanccaacttgaataaganacattgatgaattttggancaanccncaactntgaatgct

SEQ ID NO: 5517 - DNA, 706 bp, Homo sapiens
  misc_feature 2, 5, 9, 54, 62, 65, 79, 85, 132, 147, 155, 156, 158, 167,193, 199, 201, 202, 207, 224, 253, 255, 269, 273, 277, 281,298, 302, 346, 395, 422, 511, 545, 581, 630, 647, 648, 663,671, 677, 695: n = A,T,C or G
gnttnagancaggctctgttctttttgcaggatccatcgattcggtttcggcanctggggtnggnactgttgataggangatgtnttaaggaaatgctaaaattgggcaccctgcccccaacttcaaagccncagctgttatgccanatggtcanntnaaagatatnaccctgtctgactacaaaggaaaatntgttgngnncttcntttaccctcttgacttnacctttgtgtgccccacggagatcattgntntcagtgatagggcngaanaatntaanaaactcaactgccaagngatnggagcttctgtggattctcacttgtgtcatctagcatgggtcantacacctaagaagcaaggaggactgggacccatgaacattcctttggtntcagacccgaagcgcaccattgctcangattatggggtcttaaaggctgatgaaggcatctcgttcaggggcctttttatcattgatgataagggtattcttcggcagatcactgnaaatgacctccctgttggccgctctgtggatganactttgagactagttcaggccttccaggcactgacnaacatggggaagtgtgcccagctggctggaaacctggcagtgatccatnaagcctgatgtccaaannagcaaagaatatttntccaagcngaagtnagcgctgggctggtttantgccaggctgc

SEQ ID NO: 5518 - DNA, 710 bp, Homo sapiens
  misc_feature 113, 626, 629, 634, 649, 666, 671, 675, 676, 677, 680, 683,686, 691, 692, 693, 694, 701, 708, 710: n = A,T,C or G
gtttaatcagctcttgttctttttgcaggatccctcgattcgaattcggcacgagtattggtttgtagaaatgctactgatttttgtacgttaatttttgtatcctgaaactntactaacgtcatttatcaggtcttttggagggattgttagggtttttttaggtttagaatcatattgtgagtgaacagagataatttgacttcctctttttctatttagatgccttttgtttctttttcttgcccgattgctctgggtaggacttcagtactatgttgaatagaggtggtgagagtgggcatccttgtcttgttcttaggggggatgctttcacctttgcccattcagtatgatattggctgtgggtttgtcatagatggctcttattattttgagaggtatgttccttcattgcctagtttgttgaggatttttatcatgaagggatattggactttatcaaatgcttttctacatgtattgagatgatcatatggtttttgtttttaattctgtttatgtgctaaaactattccccaaaatcaaagagaaaggatttctccttaacacattctacgaaaccagtatcatcctgatccaaaatctggcaaggacaccaacancanaaaanaaaaaaaaaaaactnggcctttaaaaactttnggggngccnnnttncgnaanatccnnnncttgatnagatccntn

SEQ ID NO: 5519 - DNA, 782 bp, Homo sapiens
  misc_feature 8, 19, 389, 393, 446, 474, 507, 538, 580, 582, 598, 615,618, 620, 633, 637, 640, 642, 679, 703, 704, 706, 710, 714,718, 719, 721, 724, 726, 729, 732, 733, 734, 735, 736, 738,739, 741, 742, 743, 750, 751, 756, 757, 758, 759, 760: n = A,T,C or G
  misc_feature 765, 768, 769, 770, 774, 775, 776, 778, 779: n = A,T,C or G
tttgaaancttttatacanctacttgttctttttgcaggatcccatcgattcgaattcggcacgaggtggggacgagccctccccatcctgagtccacagggagatccacagctcacggagcctggccgcggacccctcccacccctgccttgccggcccctgcacatttaggatatgctcctgggtggggactgggctgtgcccagggcctctgtcccccaggatgtcttgtggtgcgggtcggccgttctgccccccagggcaccccctgttgtaggcactggctagggaggggcaggcctccttcctgcccctcgagacactcttgggagatgcattttccgtctggctcacagggggagggtgaggctttgcaccccacccctgnccangccactgtgatggtgggtgctgctgaacccccggggcagcaggagccaggcangtgatgtctttgtctcggctcccacagnagaaccaggtgagggggcgcctgccaaggccanaaccatgtggggcaaactgaaccctgttccnctgtggcggcatgccccgatcttttacacactggtgaccctnanaaaagatgtaagatgnaacctggccggggtttnttnancccgacttttaanttgnccntncaaacctttggcttgaacttgggtctgtttacctaanaaagtcccacaaggtgccttattnntngggntttntttnnanaancnccnttnnnnngnnannnttttttnnatttnnnnnaaaanatnnnaaannngnnttt

SEQ ID NO: 5520 - DNA, 808 bp, Homo sapiens; identical to SEQ ID NO: 5507
  misc_feature 4, 5, 6, 7, 8, 21, 27, 29, 453, 549, 685, 690, 709, 712,734, 739, 740, 741, 742, 743, 748, 750, 751, 752, 753, 754,755, 756, 757, 758, 759, 760, 761, 762, 763, 764, 765, 766,767, 768, 769, 770, 771, 772, 773, 774, 775, 776, 777: n = A,T,C or G
  misc_feature 778, 779, 780, 781, 782, 783, 784, 785, 786, 787, 788, 789,799, 804: n = A,T,C or G

SEQ ID NO: 5521 - DNA, 708 bp, Homo sapiens
  misc_feature 2, 9, 10, 13, 14, 346, 480, 568: n = A,T,C or G
gntctcatnntgnnaggctcttgttctttttgcaggatcccatcgattcgaattcggcacgaggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcanaggtacttgaactggcaggaaatgcatcaaaagacttaaaggtaaagcgtattacccctcgtcacttgcaacttgctattcgtggagatgaagaattggattctctcatcaaggctacaattgctggtggtggngtcattccacacatccacaaatctctgattgggaagaaaggacaacagaagactgtctaaaggatgcctggattccttgttatctcangactctaaatactctaacagctgccagtgttggtgattccagtggactgtatctctgtgaaaaacacaattttgccttttttgtaattctatttgacaagtttggaagttaattagctttccaccaaccaaatttctgct

SEQ ID NO: 5522 - DNA, 808 bp, Homo sapiens; identical to SEQ ID NO: 5507
  misc_feature 4, 5, 6, 7, 8, 21, 27, 29, 453, 549, 685, 690, 709, 712,734, 739, 740, 741, 742, 743, 748, 750, 751, 752, 753, 754,755, 756, 757, 758, 759, 760, 761, 762, 763, 764, 765, 766,767, 768, 769, 770, 771, 772, 773, 774, 775, 776, 777: n = A,T,C or G
  misc_feature 778, 779, 780, 781, 782, 783, 784, 785, 786, 787, 788, 789,799, 804: n = A,T,C or G

SEQ ID NO: 5523 - DNA, 880 bp, Homo sapiens
  misc_feature 5, 15, 247, 270, 275, 374, 390, 403, 501, 510, 556, 565,585, 647, 668, 675, 678, 704, 705, 736, 741, 742, 744, 750,768, 769, 781, 819, 826, 827, 830, 840, 852, 856, 860, 864: n = A,T,C or G
ttatntttcattcanctcttgttctttttgcaggatccctcgattcgaattcggcacgagtcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctcttaagaagacgacggcttcangcccggctaactctggcaccccngatcnaggacaagtggagagcaagtgggggtcgagactttggggagacggtgttgcatagacccaagggagaagaaatccataacacccccaccccaacacccncaagacagcagtcttnttacccgctgcanccgttccgtcccaaacagagggccacacagataccccacgttctatataaggaggaaaacgggaaagaatataaagttaaaaaaaagcctccggtttncactactgngtagactcctgcttcttcaagcacctgcagattctgatttttttgntggtggtgntctcctccattgcttgttgntgcaggggaagtctttactttaaaaaaaaaaaaaaattttgtggagttggacttcgggggtnaaaaacccatgtttgtttttnaacaagnaancaagaaggggttggtacttatttggnnttaaaaaaaaaaaaaaaaaaaaaaaaaaacntttgnngncccttnttaaaaaactttttttgnnggaggttcggtnattttaccgttaaaaattccccccacccttgggtttanggaattnncantttggattgnaaatttttgggnaccnaaancccncccaacctttgggaaa

SEQ ID NO: 5524 - DNA, 880 bp, Homo sapiens; identical to SEQ ID NO: 5523
  misc_feature 5, 15, 247, 270, 275, 374, 390, 403, 501, 510, 556, 565,585, 647, 668, 675, 678, 704, 705, 736, 741, 742, 744, 750,768, 769, 781, 819, 826, 827, 830, 840, 852, 856, 860, 864: n = A,T,C or G

SEQ ID NO: 5525 - DNA, 880 bp, Homo sapiens; identical to SEQ ID NO: 5523
  misc_feature 5, 15, 247, 270, 275, 374, 390, 403, 501, 510, 556, 565,585, 647, 668, 675, 678, 704, 705, 736, 741, 742, 744, 750,768, 769, 781, 819, 826, 827, 830, 840, 852, 856, 860, 864: n = A,T,C or G

SEQ ID NO: 5526 - DNA, 1690 bp, Homo sapiens; identical to SEQ ID NO: 5509
  misc_feature 3, 6, 7, 9, 10, 13, 14, 15, 18, 19, 20, 21, 22, 26, 27, 28,31, 32, 33, 35, 36, 37, 39, 40, 41, 42, 48, 49, 50, 51,52, 54, 55, 56, 57, 58, 59, 61, 62, 67, 69, 70, 71, 73,75, 76, 77, 79, 85, 86, 88, 90, 94, 96, 103, 104, 105, 106: n = A,T,C or G
  misc_feature 108, 109, 110, 111, 112, 116, 119, 120, 121, 122, 123, 124,126, 129, 132, 134, 136, 139, 141, 143, 144, 145, 150, 155,157, 159, 164, 165, 166, 168, 169, 172, 174, 175, 179, 182,183, 184, 190, 192, 194, 196, 197, 198, 203, 208, 209: n = A,T,C or G
  misc_feature 210, 212, 217, 220, 221, 226, 227, 228, 232, 233, 234, 236,241, 242, 243, 245, 249, 251, 253, 258, 264, 268, 272, 274,275, 276, 279, 314, 323, 327, 328, 342, 343, 358, 360, 366,368, 370, 374, 376, 377, 393, 396, 398, 399, 401, 402: n = A,T,C or G
  misc_feature 407, 410, 411, 413, 416, 424, 425, 426, 429, 432, 433, 436,442, 444, 445, 450, 468, 469, 470, 473, 478, 481, 484, 485,490, 491, 493, 498, 500, 501, 505, 507, 508, 517, 521, 523,524, 525, 530, 533, 534, 537, 538, 539, 540, 542, 543: n = A,T,C or G
  misc_feature 547, 550, 555, 558, 561, 562, 563, 564, 573, 574, 577, 588,590, 592, 594, 595, 600, 602, 603, 605, 606, 607, 609, 612,614, 615, 616, 617, 620, 633, 634, 637, 638, 641, 643, 644,647, 649, 653, 654, 661, 663, 666, 670, 674, 675, 678: n = A,T,C or G
  misc_feature 679, 683, 686, 687, 698, 703, 705, 707, 710, 712, 716, 718,720, 724, 726, 727, 728, 730, 732, 735, 738, 740, 742, 744,746, 753, 755, 757, 772, 774, 782, 784, 788, 789, 790, 794,796, 797, 798, 802, 807, 809, 810, 812, 815, 817, 819: n = A,T,C or G

SEQ ID NO: 5527 - DNA, 933 bp, Homo sapiens
  misc_feature 4, 9, 18, 25, 35, 53, 56, 63, 77, 99, 116, 118, 124, 125,135, 141, 143, 151, 154, 155, 163, 169, 175, 179, 184, 186,188, 193, 198, 199, 203, 204, 214, 216, 218, 219, 226, 228,229, 230, 233, 244, 245, 247, 248, 249, 250, 255, 257: n = A,T,C or G
  misc_feature 262, 265, 275, 279, 285, 306, 313, 328, 329, 335, 337, 339,343, 353, 370, 373, 378, 380, 382, 385, 406, 407, 408, 415,438, 444, 445, 451, 467, 468, 470, 473, 483, 486, 489, 493,501, 510, 511, 512, 513, 517, 524, 530, 532, 534, 536: n = A,T,C or G
  misc_feature 538, 539, 550, 557, 560, 565, 579, 580, 587, 589, 590, 592,594, 597, 598, 600, 604, 612, 617, 622, 629, 636, 637, 640,643, 648, 653, 664, 666, 675, 676, 680, 691, 700, 701, 710,716, 720, 728, 730, 736, 738, 744, 745, 752, 762, 763: n = A,T,C or G
  misc_feature 767, 768, 773, 780, 783, 788, 791, 797, 803, 807, 830, 833,836, 840, 841, 842, 846, 852, 853, 859, 865, 866, 867, 873,874, 880, 881, 890, 894, 895, 896, 900, 902, 903, 905, 906,908, 909, 912, 914, 919, 920, 926, 927, 928, 931, 932: n = A,T,C or G
gagnagggngttctaatnctggctntcagcccaanaacagctctgttcttgcncangatccgntcgatgttctccantggaccatccagcctttttccnagccaggaaagcccggntngagcanntgatatccangaatgngngaggctgncgnngcaaggancacctnaggtcngganatctnanancatcntggcnncatnntgaaaccctntngnnactatgnannntcncaaatcagctnngnnnnctggngnacgcntgnagtgccagcnccanggaggntgatgcagctgaacccctgancgccggnatggtcaagattgcnntgacgntnanatcnaaccattggnactccatcctggggcangangaacnananctntgactcacggtaatgtaatcnnnaggtggntggataaacttgaggataaaggnttcgannatcaanactggaggcaactttnncnggntaaccctatntantanctanaatatatntggaaatcnnnnacanggcaatnggctanancncnanncccttggtaanacacccntanttccntaggggcacgcgtnnacggcangnntnantcnncntaanaaacccancgtanggtgntaagggnttaccanntantcncgaanaatcnacgcccacctngnattttcctnnggcncttggggcaancaaaaatgnntgaaaaacntcttgngagntccaatanancccacnanatttcnnaactatntaagcacgcnntaannttggnaaaaacnccnaattnggnaatcantattanggangggggacatccatttttaaaccnttnganaatnnncccnaaaacnnatgctnttctannnggaagnnccaatnnggcataacnaaannntttngnngnnanncananatccnntctctnnntcnnc

SEQ ID NO: 5528 - DNA, 1383 bp, Homo sapiens
  misc_feature 4, 5, 6, 8, 9, 10, 11, 12, 13, 15, 20, 22, 27, 28, 29, 30,31, 32, 35, 37, 41, 43, 46, 49, 52, 55, 56, 58, 61, 62,65, 67, 68, 70, 72, 73, 75, 77, 79, 80, 81, 83, 87, 88,89, 93, 96, 98, 99, 102, 105, 107, 108, 110, 111, 113, 115: n = A,T,C or G
  misc_feature 116, 118, 119, 122, 124, 126, 127, 131, 132, 133, 135, 136,138, 139, 141, 142, 144, 145, 146, 148, 149, 150, 152, 155,157, 164, 168, 169, 170, 171, 172, 173, 174, 175, 176, 177,179, 181, 182, 183, 184, 187, 189, 195, 196, 197, 199: n = A,T,C or G
  misc_feature 200, 201, 202, 203, 204, 205, 206, 209, 210, 211, 217, 218,220, 221, 222, 223, 227, 232, 233, 234, 256, 259, 268, 269,278, 280, 284, 288, 299, 304, 306, 307, 309, 320, 321, 326,331, 332, 338, 340, 345, 346, 348, 349, 350, 356, 365: n = A,T,C or G
  misc_feature 372, 382, 385, 391, 402, 408, 410, 411, 419, 426, 427, 429,435, 437, 439, 441, 442, 443, 447, 449, 456, 458, 460, 465,468, 476, 477, 481, 485, 492, 499, 504, 508, 513, 517, 524,526, 527, 529, 536, 538, 539, 542, 543, 545, 553, 555: n = A,T,C or G
  misc_feature 558, 560, 561, 562, 563, 572, 574, 575, 577, 581, 589, 598,600, 602, 605, 606, 608, 628, 630, 631, 633, 636, 637, 643,650, 656, 657, 659, 666, 669, 671, 674, 679, 680, 681, 682,686, 688, 689, 691, 695, 697, 699, 706, 709, 719, 721: n = A,T,C or G
  misc_feature 725, 730, 736, 740, 741, 744, 753, 768, 773, 783, 812, 816,824, 826, 836, 838, 843, 844, 846, 848, 853, 859, 860, 861,862, 866, 869, 878, 881, 882, 884, 885, 888, 896, 902, 903,906, 909, 910, 913, 915, 917, 923, 931, 936, 942, 945: n = A,T,C or G
cccnnncnnnnnncnacccnanccccnnnnnnacnancccnanacngcnaanaannanctnnccnannancnnanangnnncncaannncaanccncnnaanacnanncnnananncnncanancnnacannnannannannannncnnncntcnanaaacacngacnnnnnnnnnnangnnnnaangnaggggnnncnnnnnnnnccnnngagganncnnnngggnaggannnggccccgttttttcctgaaaanagnccttggggnnaacagggcnanacantcancaaggagaganaggcnannanagggccttttnnaacangccannccacanangaacnncnnnaattcnggaaaatangcgcacnaaccaggcanacnactccngcgcacgatcnccaaancnntggggaancacatcnncnacaacnancntnnncccnanaagcctnangnccacnacnaacccccnncaancganaacacancccctanaaccnaacncaaanacanacccacncnnangacaacngnncanncnagcaccancnatncnnnnccggaccantnncngcanaccaaagnacaccagcnanancgnnancccaaacacacagataaacncnnanagnntccatngcataancggaanngncaccatnctncnaancaaannnncccntnnanccananancacttancantaacacccancnggtncgacnacaacngcanngcnactacatcncaaacacagccaacncgacncaaaaccacnacacagcccgcgccaaacccttaaccctncaanaccattancnagacctaacncnaacanncngnacggncaccannnncacnccnatagacccnagnncnncanaccggagnaaaacnntcnggnntanananaacaancaccaacnataangcaacngcnnagnacccnaccacatnncccnctcanannnacccnnacacgcgaancaccgagcaacannctgggcnaatacnctgcacaccnnccgccatagcgacaaanacnttcgcanngnnnnaaancannncgagcanccccgncctnnnaacacaaatngcnaannccagagcaaccacacancaggatcaacaacacatanngggnancngcnanagagggcaaanngncacaaaaccnaaaacatactctnnaaacacacaaaggccnccgacaaaanntnncacnnncananacncatcggacaccaccannaanaaccnnngggacgcgcnccantnnttccanananagnannnacccncccattacgagcgataancctcaaaaaacnnggaacantaccccgaacggccccactcantntnngnggatcaacgc

SEQ ID NO: 5529 - DNA, 773 bp, Homo sapiens
  misc_feature 7, 10, 11, 13, 14, 15, 18, 20, 24, 25, 28, 29, 36, 40, 46,47, 48, 650, 659, 709: n = A,T,C or G
ctaatcnaanncnnngcntntcgnnctnnccgaaanaaanaggctnnngcgtggtgggaagcgtgcggtgccgcagcaatggcggcgctcacaattgccacgggtactggcaattggttttcggctttggcgctcggggtgactcttctcaaatgccttctcatccccacataccattccacagattttgaagtacaccgaaactggcttgctatcactcacagtttgccaatatcacagtggtattatgaggcaacttcagagtggacgttggattacccccctttctttgcatggtttgagtatatcctgtcacatgttgccaaatattttgatcaagaaatgctgaatgtccataatttgaattactccagctcaaggaccttacttttccagagattttccgtcatctttatggatgtactctttgtgtatgctgtccgtgagtgctgtaaatgcattgatggaaaaaaagtgggtaaagaacttacagaaaagccaaaatttattctgtcggtattacttctgtggaacttcgggttattaattgtggaccatattcattttcagtacaatggctttttatttggattaatgctactctccattgcacgattatttcagaaaaggcatatggaaggagcatttcnctttgctgntctcctacatttcaagcatatctacctctatgtaagcaccagcttatggngtatatctgctgcgatcctactggttcactgcaagtaaaccagccttttgtctgtgggaaaaat

SEQ ID NO: 5530 - DNA, 784 bp, Homo sapiens
  misc_feature 2, 4, 8, 16, 17, 18, 40, 43, 47, 51, 66, 67, 171, 268, 274,297, 308, 351, 354, 402, 409, 422, 426, 428, 430, 432, 437,441, 443, 444, 454, 474, 475, 476, 480, 485, 492, 494, 497,505, 513, 519, 521, 523, 524, 526, 534, 536, 542, 543: n = A,T,C or G
  misc_feature 545, 557, 558, 566, 567, 570, 576, 579, 581, 587, 590, 594,595, 598, 601, 607, 624, 627, 628, 630, 635, 636, 647, 651,654, 659, 664, 665, 667, 673, 674, 678, 691, 692, 693, 695,699, 700, 717, 729, 731, 732, 733, 735, 737, 743, 744: n = A,T,C or G
  misc_feature 753, 758, 762, 763, 764, 765, 766, 769, 770, 771, 774, 776,782: n = A,T,C or G
gntntttntaagcgannngctacttgctctttgcgcgagnccntatnttcnaattcggcacgaggnngtctcctgagccagagtgtgctcagacagcagtccagctggtggaaagggacttatggagagaaaaagaaaagcgatgtagaaaaattgaaaagaggtacaganacagctggattggttacagctcggtgtttgccttattttgaacagggtttgaacagttggccacctttggttgctcaaaacttggtgattggcacangagtangttacagtctgtttgcacatccntttaggttgcngttcactgtgtacagagaaacctttaggctgaacttaaaacgngtnaggagacagctttctgcttgatttaacagtatcacgggtgtgtgttgngaggtanggaggtgggggcncttnantncngtctnctangnntgtgtcaacntctggtgcagtatctgtgcnnnttgnatctnctggaancnctnatctaacngacttggntaccangntnncnctttactnantgggtnnangggccacccttnntcttattnnggntggcanaancnttcccnttnggtnnctnggnaaactntttatgtggctctttgntgnnanaaganntggcttttttnggtntgnttaanggttnncnttttgnnaaanttgctcttttgtnnntntgtnnactaaaccccttttttntaacccttttanannngntnaaaacnnttttaatcnttccnatgnnnnnaannnttntngggtcnct

SEQ ID NO: 5531 - DNA, 751 bp, Homo sapiens
  misc_feature 24, 29, 50, 80, 87, 88, 92, 94, 99, 100, 102, 108, 110, 113,116, 117, 124, 125, 130, 131, 134, 136, 158, 166, 168, 173,182, 183, 186, 191, 196, 203, 218, 220, 226, 229, 263, 283,291, 304, 308, 310, 340, 342, 344, 350, 357, 363: n = A,T,C or G
  misc_feature 367, 380, 385, 387, 389, 397, 401, 407, 417, 418, 425, 442,462, 471, 476, 497, 506, 520, 528, 536, 537, 553, 566, 580,594, 608, 609, 614, 615, 619, 626, 631, 633, 642, 647, 650,657, 659, 660, 662, 668, 672, 677, 680, 681, 688, 697: n = A,T,C or G
  misc_feature 708, 711, 712, 717, 723, 727, 728, 732, 739, 740, 741, 742,744, 746, 747, 748, 749, 750: n = A,T,C or G
ggtatagatcattctacttgttcnttctntatgcaggatcccatcgattngaattcggcacgagacccacttaggtggcnccaatgnngacntncaganngnacagtncnttnatnnatggggnngtganngcntntatatcataaatctcaagaggncctgaganantcttntgctggcanntcntgcanttgtngccattnaaaaccctgctgatncnagtgtnatntcctacgggaatactggccagaagggctgtgctnaagtacgctgctgccactgnagccactncaattgctggccncttnantcctggaacctttactaaccatatccaggnancntttcgngagccanggcttnttgnggttactgacccnatggntnancaccagcntctnactgangcatcttatnntaacctncctaccattgctctgtntaacacagattctcctctgngctatgtgnacatngtcatatccatgcaacagcancgggagctnactcagtgggtaangatgtggnggatgctnnctcggcaagttcttcncatgccgtggcancattttccatgaanacccttgggagggnaatgcctgatcttnnacttnnacanaaaatcnttgangnaaaattgcnaaatntantaaaccngnntntcttgnttgngaaangcnnatgaacncattggaanggaattttcanggnnttaantggggntttnnttanccctccnnnnanannnnng

SEQ ID NO: 5532 - DNA, 1383 bp, Homo sapiens; identical to SEQ ID NO: 5528
  misc_feature 4, 5, 6, 8, 9, 10, 11, 12, 13, 15, 20, 22, 27, 28, 29, 30,31, 32, 35, 37, 41, 43, 46, 49, 52, 55, 56, 58, 61, 62,65, 67, 68, 70, 72, 73, 75, 77, 79, 80, 81, 83, 87, 88,89, 93, 96, 98, 99, 102, 105, 107, 108, 110, 111, 113, 115: n = A,T,C or G
  misc_feature 116, 118, 119, 122, 124, 126, 127, 131, 132, 133, 135, 136,138, 139, 141, 142, 144, 145, 146, 148, 149, 150, 152, 155,157, 164, 168, 169, 170, 171, 172, 173, 174, 175, 176, 177,179, 181, 182, 183, 184, 187, 189, 195, 196, 197, 199: n = A,T,C or G
  misc_feature 200, 201, 202, 203, 204, 205, 206, 209, 210, 211, 217, 218,220, 221, 222, 223, 227, 232, 233, 234, 256, 259, 268, 269,278, 280, 284, 288, 299, 304, 306, 307, 309, 320, 321, 326,331, 332, 338, 340, 345, 346, 348, 349, 350, 356, 365: n = A,T,C or G
  misc_feature 372, 382, 385, 391, 402, 408, 410, 411, 419, 426, 427, 429,435, 437, 439, 441, 442, 443, 447, 449, 456, 458, 460, 465,468, 476, 477, 481, 485, 492, 499, 504, 508, 513, 517, 524,526, 527, 529, 536, 538, 539, 542, 543, 545, 553, 555: n = A,T,C or G
  misc_feature 558, 560, 561, 562, 563, 572, 574, 575, 577, 581, 589, 598,600, 602, 605, 606, 608, 628, 630, 631, 633, 636, 637, 643,650, 656, 657, 659, 666, 669, 671, 674, 679, 680, 681, 682,686, 688, 689, 691, 695, 697, 699, 706, 709, 719, 721: n = A,T,C or G
  misc_feature 725, 730, 736, 740, 741, 744, 753, 768, 773, 783, 812, 816,824, 826, 836, 838, 843, 844, 846, 848, 853, 859, 860, 861,862, 866, 869, 878, 881, 882, 884, 885, 888, 896, 902, 903,906, 909, 910, 913, 915, 917, 923, 931, 936, 942, 945: n = A,T,C or G

SEQ ID NO: 5533 - DNA, 763 bp, Homo sapiens
  misc_feature 3, 62, 66, 72, 73, 82, 85, 93, 96, 101, 102, 122, 167, 182,190, 192, 194, 198, 199, 203, 222, 232, 258, 279, 282, 283,309, 317, 326, 329, 343, 346, 355, 357, 365, 370, 372, 381,402, 416, 430, 433, 450, 451, 453, 477, 487, 493, 545: n = A,T,C or G
  misc_feature 557, 580, 589, 595, 612, 613, 626, 628, 631, 633, 634, 636,641, 653, 657, 673, 675, 676, 678, 703, 706, 710, 712, 716,720, 722, 726, 733, 745, 747, 751, 753, 756, 757, 758, 759,762: n = A,T,C or G
ctngttcttttttcaggatcccatcgattcgaattcggcacgaggatcagatggtttaactnttgnggcagnngcgagaaanctntgatgatngangacanntttttaagaaagcaagaaanaaagatactatggggtcaagtgtaactccatggaaatgccacgtntgctcttcagtgaanaagctggntnanagtnncacngaaaacttttgactgtatntatttattgntgcaaaaaagacgcttttatattgcngccctcatttgtcacctaagnatnncttcttataaaatccagccccggatncatataancatctgtanctnatcatgattcctgntgnaaaagtcancnacgacctntagangncttttcttnctatgaaaggagctgctatgncacatgtgcacacnccgcacaactgggnatnaacaatgagtttattgnncntggtggaccaaaattaagcttgcntaagggttgngctaantggacctggactacagactctgacgccttgaatataacagtacaatttggcnatttctctgaancaggctaaactgagtaaaatctntttgaaggngtcctnggtgtgaacatttgccnngaagctaattagngnctntnngnatttnaaattcaacctntggngtggaatatgaaaccnanntnaaacggagataactttttctccccncanaaantnaacnttgngntccntaaaccnttttaggggatncnaaancnttnnnnccnc

SEQ ID NO: 5534 - DNA, 805 bp, Homo sapiens
  misc_feature 2, 3, 4, 5, 6, 7, 8, 14, 16, 22, 23, 31, 44, 178, 265, 275,330, 409, 662, 665, 799, 805: n = A,T,C or G
gnnnnnnntttgananccatcnntttaaatncattttgctactngttctttttgcaggatcccatcgattcgatcagtatgaactcttaaaacatgcagaagcaactctaggaagtgggaatctgagacaagctgttatgttgcctgagggagaggatctcaatgaatggattgctgngaacactgtggatttctttaaccagatcaacatgttatatggaactattacagaattctgcactgaagcaagctgtccagtcatgtntgcaggtccnagatatgaatatcactgggcagatggactaatattaaaaagccaatcaaatgttntgcaccaaaatacattgactatttgatgacttgggttcaagatcagcttgatgatgaaactctttttccttctaagatnggtgtcccatttcccaaaaactttatgtctgtggcaaagactattctaaagcgtctgttcagggtttatgcccatatttatcaccagcactttgattctgtgatgcagctgcaagaggaggcccacctcaacacctcctttaagcactttattttctttgttcaggagtttaatctgattgataggcgtgagctggcacctcttcaagaattaatagagaaacttggatcaaaagacagataaatgttttttntanaacacagttacccccttgcttcatctattgctagaactatctcattgctatctggtatagactagtggaacaaacttttaagaaaacagggataaaaaagaaacccattggctgtggctactgataaaaatatncccaan

SEQ ID NO: 5535 - DNA, 1197 bp, Homo sapiens
  misc_feature 14, 23, 31, 32, 35, 42, 52, 61, 64, 74, 78, 84, 94, 95, 99,113, 131, 132, 133, 139, 143, 145, 152, 168, 171, 179, 181,184, 185, 186, 187, 196, 203, 205, 206, 208, 211, 226, 229,236, 239, 240, 245, 249, 251, 265, 267, 282, 284, 290: n = A,T,C or G
  misc_feature 292, 293, 303, 306, 311, 324, 329, 330, 331, 334, 335, 338,341, 345, 347, 353, 364, 365, 371, 372, 382, 387, 388, 394,397, 400, 402, 403, 405, 409, 414, 417, 419, 420, 425, 431,433, 434, 441, 458, 469, 472, 477, 478, 479, 481, 482: n = A,T,C or G
  misc_feature 483, 485, 486, 487, 488, 493, 494, 495, 496, 503, 505, 510,514, 517, 518, 519, 522, 523, 525, 526, 528, 529, 530, 534,537, 538, 540, 542, 543, 549, 550, 552, 553, 554, 555, 556,557, 559, 560, 563, 564, 565, 567, 571, 577, 578, 581: n = A,T,C or G
  misc_feature 584, 585, 587, 590, 591, 593, 598, 599, 601, 605, 606, 611,612, 615, 621, 624, 627, 628, 629, 630, 631, 635, 640, 645,648, 651, 652, 657, 659, 662, 665, 668, 670, 671, 675, 677,678, 681, 682, 691, 695, 698, 704, 707, 708, 709, 711: n = A,T,C or G
  misc_feature 714, 716, 721, 727, 731, 735, 736, 746, 749, 753, 759, 762,765, 766, 767, 770, 773, 776, 777, 782, 786, 788, 789, 792,796, 797, 799, 801, 808, 809, 812, 822, 823, 824, 827, 834,835, 837, 851, 852, 854, 858, 862, 873, 876, 879, 884: n = A,T,C or G
  misc_feature 885, 890, 894, 898, 921, 924, 926, 936, 950, 952, 956, 964,965, 969, 980, 988, 1007, 1008, 1010, 1021, 1026, 1027,1028, 1029, 1035, 1045, 1053, 1056, 1058, 1064, 1069, 1081,1083, 1086, 1090, 1096, 1100, 1101, 1108, 1117, 1126, 1128: n = A,T,C or G
aggggtttacactnctaaaattnttgagctnncgntgggcgnaaagggggcncccttaaanaanttaaggcccncctnaaaaanaatcagggannattntgggggggctttgnggggggggtcatctatcnnnacaccntaantntattacncatagatactcaattnccntctctagnanatnnnnggatctttntcggctntnnanccnctcctactattactnctnaaacgtnccnncatantctntntacacatatatctnanatactatacatatantntcatantnntactactctnatntctcntctacatctctanttatnnntcnntcnctntctncnatctantctcatatctnnacgacnnactatttttnctccnnttcctnctntcncnntnttanccccnatnannatctntcaccntnnattttcnaatactctatctattanttaactatctnctntttcnnncnnntnnnnctatnnnncttctananactcntccnctnnnctnntnncnnntaantcnntncnntctctnntnnnnnntnntgnnnancctnactaanntcntcnncntcnntnattannanattnntacanntcntccctncanctnnnnnattntatantcttnttnccnnttcantntanatnttntnnctancnntcnntaattcaanattnatntcatcntcnnntnttnancaatnacaatnaccnccanntcacctaatnttnatcncatacnacnccnnnctntanccnnatatnactncnncanttcnntntnatctctnnttnacacactccnnngantatactnntnacacttcttatatnntntacntgtnatacactcttnacntanatatnnatcanactnatanaaagcatactatcatcttacctnctntnatataccatncaccaatcacttantntatncatctcannacanctccacatatnactcatcnctaatatgtctctataatnntncatctactcantcacnnnnactctntagatatatnctatactncancntatatntatcnattcatctacanantanctcncatctnttgnnctatacnataattgtntctcatatntntttctcctacannctttatctcgatnnttatcntgtancncnnntntatctanatatnacatatcacat

SEQ ID NO: 5536 - DNA, 1050 bp, Homo sapiens
  misc_feature 1, 2, 4, 6, 11, 14, 20, 22, 24, 31, 32, 42, 57, 58, 62, 63,78, 80, 82, 86, 88, 92, 94, 114, 119, 120, 124, 127, 132,133, 140, 141, 151, 156, 157, 158, 163, 164, 166, 167, 170,171, 175, 176, 178, 180, 181, 184, 188, 200, 201, 202: n = A,T,C or G
  misc_feature 203, 204, 206, 207, 215, 220, 232, 233, 239, 240, 242, 246,248, 250, 253, 256, 258, 263, 276, 279, 281, 294, 297, 300,303, 307, 308, 313, 315, 319, 320, 324, 331, 332, 337, 344,346, 350, 356, 359, 360, 362, 363, 364, 365, 367, 370: n = A,T,C or G
  misc_feature 372, 375, 380, 384, 385, 388, 389, 394, 398, 399, 400, 405,410, 415, 421, 422, 428, 431, 434, 435, 440, 446, 451, 452,454, 457, 460, 462, 463, 464, 467, 471, 472, 473, 476, 477,479, 480, 485, 486, 489, 495, 496, 498, 500, 507, 509: n = A,T,C or G
  misc_feature 511, 512, 515, 517, 524, 526, 528, 535, 545, 555, 556, 562,563, 566, 569, 572, 573, 579, 581, 586, 592, 598, 604, 605,607, 609, 613, 621, 634, 635, 637, 638, 639, 640, 641, 642,645, 652, 658, 663, 671, 673, 675, 680, 681, 684, 700: n = A,T,C or G
  misc_feature 701, 702, 707, 713, 717, 721, 723, 743, 745, 756, 760, 762,763, 766, 767, 769, 778, 786, 788, 790, 794, 803, 806, 821,829, 833, 834, 836, 841, 843, 850, 852, 858, 870, 871, 872,873, 880, 884, 889, 892, 893, 894, 897, 901, 906, 910: n = A,T,C or G
  misc_feature 911, 915, 919, 923, 924, 929, 933, 939, 940, 943, 949, 952,953, 954, 957, 958, 960, 961, 962, 970, 974, 978, 981, 982,983, 984, 997, 1007, 1016, 1018, 1025, 1026, 1028, 1042,1043, 1047: n = A,T,C or G
nntnanccccnacngctttncntntccaatnnccctaaacanaaaggggctggggcnnagcnnagaacacatacaganananacancnaagngnctaggtttttcacctttttnacacnnaaancancacgnnccgagtnncgcagaaccngcgcnnncagcnncnnganncgcnnangnnccncganggctagagcccnnnnngnnagaggcancaacnaaccatcaccanngccaanncncatncnantcnganangaganagcaacaccctgnatncnaacaagaacccanaantanaanccannaagtnanaaannaganccatcanncgaanacccatntnaccnccccanagnncnnnnanctnanagnccagnaccnnacnnccaancccnnncgacnaaacnacccnctacanncgaatncgnaanntccangaccanctcanncntcntcnannngcnctcnnncanntnnacccnnaantgccanncnantccccanancnnccntnccaaacntnantcccacnccatagccanccaagaaccnncaaacnnctncgncanntcgatncncatcnccaccnctgcgnatacgnntnancacntcaccaancacgccaaaaccnnannnnnncanaccgacnggacancctcnctacgccnangnaatcnnccncccactcactcacctnnnctacntacatnagtnaaananccctcatctagaccagaacncncactatctacnactnannctnnanagacacagncacaatcntnanactnacacgatcncanacaccccaactcccncagcaaangctnncnatcancnactcatncnactctntactaaacgtcnnnntcacagngcgnaccanaannngcnatanacatncacnnaaanacgnaccnncgatntctncactannacncaagtntcnnntcnntnnncactcaancacnctangannnnatgcggtactcgnagaaatctcngcccatagncncacacannanccccctacgcacanntccnccc

SEQ ID NO: 5537 - DNA, 776 bp, Homo sapiens
  misc_feature 6: n = A,T,C or G
caaacngctggctacttgttctttttgcaggatcccatcgattcgaattcggcacgaggctaagtattctaggatctacagttatggtcattcatgctccaaaggaagaggagattgagactttaaatgaaatgtctcacaagctaggtgatccaggttttgtggtctttgcaacccttgtggtcattgtggccttgatattaatcttcgtggtgggtcctcgccatggacagacaaacattcttgtgtacataacaatctgctctgtaatcggcgcgttttcagtctcctgtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctccgaagaaatggaaatt

SEQ ID NO: 5538 - DNA, 768 bp, Homo sapiens
  misc_feature 1, 3, 5, 275, 294, 383, 566, 578, 588, 614, 629, 630, 631,639, 640, 645, 646, 664, 675: n = A,T,C or G
ntncncatacagctacttgttctttttgcaggatcccatcgattcgaattcggcacgagcacattttcctgttttcttccaagccctccacagtgttccaacctctgccggttacccatttccaaagtcacttccacattttcgggtatccttatagcagcaccccactctaccagtaccaatttactgtattagtccattctcatgctgctataaagaactgctcaagactgggtaaattataaaggaaggaggtttaattgaccacagttctnagggttcgcaaggcctcangaaacctacaattatggtggaaggggaagcaaatgccctacttcacatggtggcaggaaggagaagaatgagaaccaaatgagggagangccccttataaaaccatcagatcttgtgagaacttactatcatgagaatagcatgggggaaactgccctgtgattcaattacttccactaggtcactcccaccatacatggagattataggaactacaatttacgatgagatttgggtgggaacacagccaaaccatatcaagtattaacagnagaattaaccangctgaggaangactctcagagctcaaagactggttnttcaaaatacagttnnnccaaaatnnaaaannaaaaaaaaactcggcctntaaaactatantgagtcgtattcgtagatccagacatgataagatacattgatgagtttggacaaaccacactagatgcagggaaaaaatgtttttttgtgaaa

SEQ ID NO: 5539 - DNA, 768 bp, Homo sapiens; identical to SEQ ID NO: 5538
  misc_feature 1, 3, 5, 275, 294, 383, 566, 578, 588, 614, 629, 630, 631,639, 640, 645, 646, 664, 675: n = A,T,C or G

SEQ ID NO: 5540 - DNA, 764 bp, Homo sapiens; identical to SEQ ID NO: 543
  misc_feature 1, 4, 28, 52, 101, 102, 114, 119, 125, 126, 138, 139, 142,156, 169, 172, 179, 180, 194, 195, 197, 200, 202, 206, 209,219, 234, 235, 237, 238, 245, 251, 258, 261, 263, 267, 272,277, 297, 309, 336, 357, 382, 391, 396, 406, 442, 443: n = A,T,C or G
  misc_feature 462, 472, 476, 512, 513, 540, 553, 554, 576, 580, 623, 630,637, 650, 663, 667, 673, 674, 700, 703, 709, 710, 718, 720,725, 750, 754, 758, 762: n = A,T,C or G

SEQ ID NO: 5541 - DNA, 744 bp, Homo sapiens
  misc_feature 5, 9, 10, 13, 15, 622, 674, 719, 737: n = A,T,C or G
ttaantaannctntntcttgttctttttgcaggatcccatcgattcgaattcggcacgaggcggggcggcgcagcccgagctcccggacccggaagaagcgccatctcccgcctccaccatggagcccaccgcaccgtccctcaccgaggaggacctcactgaagtgaagaaggacgtgagtaacgcagctgtgcccagggcgggcgggggcgggctgcagcccagcgggagacgaaagcggaagcctggagtccgaggacaaggaggatcctccaggtcggaggagcggaaagtcctagcacaggaggactgtggcgagccctgcatccgagggaccttggtggcagtgatcctccagtgatctgtcaatccaggttttacatcgctaaacgcagagcttgggctttgttgccaagtggtgttttgattcttgcccactcctcacccatctcctcatgctttccccccaactgggttcttggagatgcttcgttagggactggcggctcagattcatccttaagtcaggctgcctaggctgctcactcagcctagagcgaagctgtaccaggtgaaggatcccaagcagtggaccaaaaatgtgaaactcttttgcataanggggcttgaggaagctcaacagctgaaagcacaacctggaattcccctagtnagcagacgcccacatatttaaattggggttgggggaatgaatacncgtactgagaataatgtncaggtaa

SEQ ID NO: 5542 - DNA, 1224 bp, Homo sapiens
  misc_feature 7, 15, 29, 48, 54, 58, 73, 78, 105, 126, 130, 131, 137, 139,157, 158, 161, 162, 165, 169, 172, 177, 185, 233, 235, 238,243, 252, 253, 256, 258, 260, 266, 267, 269, 274, 279, 283,285, 288, 293, 296, 298, 302, 305, 336, 338, 353: n = A,T,C or G
  misc_feature 356, 367, 370, 378, 382, 394, 399, 400, 401, 403, 407, 408,411, 417, 420, 427, 430, 431, 445, 447, 455, 456, 459, 463,466, 467, 468, 470, 473, 474, 475, 478, 481, 483, 488, 501,502, 505, 508, 511, 514, 515, 517, 521, 522, 524, 527: n = A,T,C or G
  misc_feature 531, 532, 533, 540, 545, 546, 549, 557, 567, 569, 572, 573,577, 581, 582, 594, 599, 602, 603, 609, 610, 611, 617, 618,620, 623, 626, 628, 629, 630, 631, 638, 642, 645, 648, 649,658, 659, 666, 668, 670, 672, 691, 692, 694, 695, 702: n = A,T,C or G
  misc_feature 707, 721, 725, 726, 731, 735, 746, 747, 753, 755, 758, 768,773, 774, 775, 779, 781, 784, 786, 794, 795, 800, 802, 807,816, 819, 832, 836, 841, 845, 853, 854, 861, 879, 884, 889,894, 902, 904, 906, 910, 913, 924, 926, 927, 931, 932: n = A,T,C or G
  misc_feature 945, 948, 949, 951, 957, 959, 961, 962, 965, 966, 968, 983,984, 990, 1004, 1006, 1008, 1017, 1022, 1023, 1027, 1032,1038, 1039, 1052, 1067, 1069, 1073, 1084, 1086, 1096, 1098,1112, 1121, 1122, 1124, 1128, 1134, 1141, 1145, 1150: n = A,T,C or G
  misc_feature 1153, 1158, 1160, 1163, 1165, 1170, 1171, 1181, 1193, 1195,1199, 1200, 1204, 1209, 1216, 1218, 1220, 1222, 1223: n = A,T,C or G
gggttanccctttgnaactttgctaaatngcttggcaactcgaactcnctgcanggtnccatcgtttcgaatncggcncgagacgacacgcttctgcaggtgaanggcacgcggcgcccacggttncttnnagctgngncgtatgaagctggatggnngcnntgngganaangtagngcttgatntgctaataagaaatttcttggaaaagagactagctctcaacgcatccncnggngcggncggcttccnngcncncngacaannanctcgncaggngccngnatncggancantnctcncanaacaagggcgctggcgccaagaatagacaangngcggcatggccaacnaanacggtggcctncgnctggcaangaangtgaagaaggcngtcannncnaagnntanccaaantgncctatgnccnnaatgttgagctctntnaaaattcnntancttnttnnnantgnnnaantancncacancaggttttcattnnacncantantanntncttnnangancctnnncattagnccatnntcnttacattnaattccaatncngtnntggnttgnnccgccacttgcnttctntanncctgcnnncttccnncncgncantnnnngactgtnatcnttngtnnctactcttnntgcattncntncntatcaaccccaattgcccnntnnaattaancgcanttctcctcattcgncatnncctcnctantatttactcgnntctacnanttnacccaccgtntttannngctntnttntntaaacccnnctctnanctccnacatacgcnatnttttacacacctncttncttcnctcnggctatanngaccccntacattatctcatctcanctctnatacntgtcnccttatcngngntatnctnttctatcgcgncnnatcnnacggcctcacatnttnngnctcacncntnnatnnantctacacacttctcnntcatantgtctcaaaaactngnanctactcttnacttnnaganaattntatctnnccatactcatctnttcatagcgaatctntntacntctggtatccncnctctgttagntnggacacttcttctngtctctttnncntatnaaccgntatgtgnggtntattntcncaatncnctntntccanntttatcattnggtttccccctntngccnnatantgggngacacantngntnnt

SEQ ID NO: 5543 - DNA, 803 bp, Homo sapiens
  misc_feature 2, 3, 4, 5, 6, 7, 8, 9, 10, 11, 19, 33, 663, 701, 703, 704,709, 710, 712, 713, 714, 715, 716, 717, 718, 719, 722, 723,724, 725, 726, 727, 729, 730, 731, 733, 734, 736, 737, 738,741, 743, 745, 753, 754, 756, 757, 758, 760, 761, 762: n = A,T,C or G
  misc_feature 763, 764, 765, 766, 774, 775, 776, 777, 778, 779, 781, 782,783, 796, 799, 800, 801, 802, 803: n = A,T,C or G
gnnnnnnnnnnttttgcanaccgctggctactngttctttttgcaggatcccatcgattcgaattcggcacgaggcaaccttcgcctcctgggttcaagtgattctcctccctcagcatcccaagtagctgggactacaggcacgtgccaccacacccagctaatttttgcatttttagtagaggcagggtttcatcatgttggccaggctggtctcaaactcctgatctcaagtaatctgcccactttggcctcccaaagtgctggcattacaggaatggagccaccgcgcccagcctgatttctttttttaggtcttgtcaggaaagatattgattcttttgattcgtgaacatggtttttggtcgtctttaatttgtctcatcagtgcctccatgtgtttttgatgcctttgaactggtatttttaaaatttcaatttctaattgttcattatagaaacacaattgggttttatatattggcattgtattttgcaactttcctaaactcactagtaattctagtagctttttttggtagattcttaaggattttctgtgtaaatagtcatgtcatttgtgaataaagccatttttttttccttttcaaattttgtgccttttatttcttattcttaccatatcacattggcaaagacctncagtatgatattgaataaaagtggtgagagaaaaacanannttatnntnnnnnnnntcnnnnnncnnncnntnnnctncnanccctcccnncnnncnnnnnnntccttacnnnnnncnnncccccttttaaanttnnnnn

SEQ ID NO: 5544 - DNA, 770 bp, Homo sapiens
  misc_feature 3, 5, 6, 7, 8, 9, 11, 22, 29, 412, 726: n = A,T,C or G
ggngnnnnncntttgaaatctntatacanctacttgttctttttgcaggatcccatcgattcgaattcggcacgaggttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaggctggaagatggccctaaattcttgaagtctggtgatgctgccattgttgatatggttcctggcaagcccatgtgtgttgagagcttctcagactatccacctttgggtcgctttgctgttcgtgatatgagacanacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaacctttagaaggaaaggagaatgttttgtggaccactttggttttcttttttgcgtgtggcagtttaagttattagttttaaaatcatnctttttaatggaacaacttgaccaaaaatttgtcacagaatttt

SEQ ID NO: 5545 - DNA, 756 bp, Homo sapiens
  misc_feature 3, 256, 320, 476, 594, 644: n = A,T,C or G
ttncatcagctcttgttctttttgcaggatccctcgattcgaattcggcacgagggaggacgaggaggaggacgacgaagaggaggaggaggaaaaggaggtggaggagcagcagcagcagctgcagcagctaatatgttgtacttattctgtgctgggcaaaattctggatatttttcatgtactatttaagcctcacaaaaatcttatgatataggaaatgcttgtttccatttggcacatgaagaaactgaanaacagagaaatgtgaaacttgcgcagggtagtctgtccagagtctgtattttaactactgctgngttgcctcccattgcatagtgacttcacgtgtataggtggttttatcatgcgaggaaatatttgagtataaactgtatgtggtacaaatcattttttccaaatgggaatacagtgtgttccctaaaattaatgaatccaatataattccacctaanacaattactgagttttttctttgtggttgcagagcctaactcatcccatttccctccctgtcacttttcatttttaggatttgcatcttcatatttagtgaatctttgatctaatagntctggctatttaatagtagttttaaaacatctttagcaccgtcttggtanctttattcctttctttttacctagacagtttctcttaggacaaattctttttgttccacttctctttgatctgctatccacccatctcaaattatcaattttctttctgcac

SEQ ID NO: 5546 - DNA, 760 bp, Homo sapiens
  misc_feature 3, 4, 7, 8, 9, 10, 14, 114, 699, 730, 738, 760: n = A,T,C or G
ttnnaannnntcangctacttgttctttttgcaggatcccatcgattcgaattcggcacgaggtgtcaaatttcttgtcactcttgctcaaaagtgtcctgcagctaaggagtncttcaaggagaattcccaccactggagctgggctgtgcagtggctacagaagaagatgtcagaacattactggacaccacagagtaatgtctctaatgaaacatcaactggaaaaacctttcagcgaaccatttcagctcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccctagaaggtttgggagctgtttggcagtgggagaactccggcatgtggatcaactgtcccgggagcctggtctatatgtggattcacatttctgtggagattttcngaaatgaacccgtggcagacttttttggttncacgaacntccagaatgagccttaaagctn

SEQ ID NO: 5547 - DNA, 805 bp, Homo sapiens; identical to SEQ ID NO: 5534
  misc_feature 2, 3, 4, 5, 6, 7, 8, 14, 16, 22, 23, 31, 44, 178, 265, 275,330, 409, 662, 665, 799, 805: n = A,T,C or G

SEQ ID NO: 5548 - DNA, 707 bp, Homo sapiens
  misc_feature 4, 8, 108, 140, 153, 154, 197, 219, 227, 255, 318, 325, 347,365, 384, 454, 603, 650: n = A,T,C or G
gttnagancagctcttgttctttttgcaggatccctcgattcgaattcggcacgagggctattaaaaatgtaatcagtgtgaaaattcatgccatctgaatcgtacgngtatgtaagggatttgagttccttacagaatnttctgtaatttannacttcaagtgacttataaatgtatatacttctctctcacaaangtgttaggagaaggaaaatctnaaatactngcttgatttcttaatttaataacataanacaattctcataacatgtatcacctaacatgtcactttcactttaaaagtctaaagagttgangtttatntcttttcttttaaagttgatgnttatgttggtgatttccnaaaagatcagatcccccgntatgaaggatcttaaccttgtcttttagatctccatgagaaatgcagtacatgtagcattagccatattncttttttagaggcctatgtaggatatttataacctgtaaaagtttgatgacttcatgctcaggagaaagcaagtaattacctagccaagccaggtgggtgttcaggttagtggtcaacagaaaggagatgttgaaagatttcatatctnaagggtaaaaacacaagagaagtatatagagataaacatgtaaagtntaagactgtaccatagtaagctaccttcgaagtggcacccttgttattatttttctg

SEQ ID NO: 5549 - DNA, 845 bp, Homo sapiens
  misc_feature 2, 4, 5, 8, 9, 10, 11, 12, 13, 19, 86, 87, 89, 92, 101, 103,106, 111, 114, 117, 119, 122, 131, 132, 133, 134, 138, 141,143, 147, 148, 149, 153, 154, 155, 162, 170, 191, 199, 202,212, 213, 224, 226, 227, 231, 232, 235, 237, 239: n = A,T,C or G
  misc_feature 240, 247, 248, 266, 269, 276, 279, 287, 290, 293, 294, 295,305, 310, 312, 321, 329, 334, 340, 341, 345, 352, 354, 358,359, 361, 366, 371, 373, 377, 379, 382, 390, 394, 401, 408,410, 413, 414, 415, 416, 418, 419, 427, 428, 429, 434: n = A,T,C or G
  misc_feature 436, 445, 461, 477, 480, 487, 494, 497, 506, 507, 515, 516,519, 521, 523, 525, 527, 528, 533, 534, 536, 537, 538, 551,553, 555, 573, 575, 579, 580, 587, 588, 592, 599, 610, 611,616, 621, 622, 629, 635, 636, 639, 649, 670, 672, 684: n = A,T,C or G
  misc_feature 686, 690, 709, 711, 722, 725, 731, 738, 751, 762, 765, 767,780, 787, 789, 791, 795, 797, 799, 802, 803, 816, 820, 821,824, 825, 829, 839, 842, 844, 845: n = A,T,C or G
gngnngtnnnnnnttttcnaacgttgttaacatacagctacttgttctttttgcaggatcccatcgattcgaattcggcacgaggnnangcngttctgccnangangcatnctnccncnganatgccaccnnnntgcntgntnaccnnnacgnnncacacgnctacctgngggacatatacttcatgcacnggttatgnccntaccatgaanncctactgacancnnaacnngancngnntgttgannacatgaataacccactgnacnaagaacntantggaatgntanctnnntatgtccttnttccngnggaaggagnggacaacntttancaagtnncagntccaaancnaacnnanccaantatantnaaantnagngctgccantttngtggacnccttgcnanatnnnnanngctctctnnnaccgntngaaattttncataacaccatatgcnccatgattctcattgntgnaagacantcattcnatntaccagatnnatcttggnngcntntntncnngcatnngnnncactaaaaactgntntnctaactaaataggatttntntttnnttatacnngganaaaatgngagttgtgccnnaactntcatnngcgatanttacannaanttgtacttgntaaatctaagaatctaatgcnangacttaaaaaanangccnttagaactatagggagtcnanttacgtctatnccnacatgnattgatncattcacgacttngtccaaaccanatntntaattcctgaaantaaatgntntntttngnanaanntggaaaagcttcncaannttnntaancctaaaaccnggntnn

SEQ ID NO: 5550 - DNA, 775 bp, Homo sapiens
  misc_feature 8, 684, 686, 687, 688, 689, 691, 692, 693, 694, 695, 696,697, 698, 699, 700, 701, 702, 704, 705, 706, 707, 708, 709,710, 711, 712, 713, 714, 715, 716, 717, 718, 719, 721, 723,724, 725, 726, 729, 730, 731, 732, 733, 736, 738, 739: n = A,T,C or G
  misc_feature 740, 741, 742, 743, 744, 746, 747, 748, 751, 753, 754, 755,757, 758, 759, 762, 764, 769, 770, 772, 774: n = A,T,C or G
gcaaccgntggctacttgttctttttgcaggatcccatcgattcgaattcggcacgaggcaaccttcgcctcctgggttcaagtgattctcctccctcagcatcccaagtagctgggactacaggcacgtgccaccacacccagctaatttttgcatttttagtagaggcagggtttcatcatgttggccaggctggtctcaaactcctgatctcaagtaatctgcccactttggcctcccaaagtgctggcattacaggaatggagccaccgcgcccagcctgatttctttttttaggtcttgtcaggaaagatattgattcttttgattcgtgaacatggtttttggtcgtctttaatttgtctcatcagtgcctccatgtgtttttgatgcctttgaactggtatttttaaaatttcaatttctaattgttcattatagaaacacaattgggttttatatattggcattgtattttgcaactttcctaaactcactagtaattctagtagctttttttggtagattcttaaggattttctgtgtaaatagtcatgtcatttgtgaataaagccatttttttttccttttcaaattttgtgccttttatttcttattcttaccatatcacattggcaaagacctccagtatgatattgaataaaagtggtgagagaaaacanannnnannnnnnnnnnnntnnnnnnnnnnnnnnnnantnnnnccnnnnnaantnnnnnnncnnnatncnnncnnnccncntttgnnantnt

SEQ ID NO: 5551 - DNA, 1102 bp, Homo sapiens
  misc_feature 4, 13, 14, 15, 21, 29, 32, 37, 41, 43, 58, 61, 71, 72, 75,80, 86, 92, 99, 108, 113, 114, 117, 121, 128, 140, 141,146, 152, 157, 158, 159, 161, 163, 167, 174, 177, 179, 187,188, 189, 192, 197, 201, 204, 205, 206, 213, 215, 221, 225: n = A,T,C or G
  misc_feature 232, 237, 238, 239, 241, 242, 244, 247, 254, 256, 261, 266,267, 270, 273, 275, 277, 278, 279, 280, 288, 290, 293, 294,301, 303, 304, 308, 312, 315, 317, 323, 327, 329, 331, 335,336, 338, 340, 341, 343, 363, 368, 372, 374, 376, 384: n = A,T,C or G
  misc_feature 386, 404, 409, 411, 413, 417, 426, 429, 434, 436, 438, 442,443, 444, 448, 454, 469, 470, 483, 488, 492, 503, 506, 508,516, 518, 519, 522, 525, 528, 534, 540, 544, 545, 548, 555,556, 558, 559, 560, 563, 564, 569, 577, 578, 580, 582: n = A,T,C or G
  misc_feature 588, 596, 603, 607, 618, 619, 625, 626, 627, 637, 641, 643,646, 647, 648, 658, 661, 668, 676, 677, 684, 688, 689, 695,699, 700, 704, 711, 713, 723, 727, 730, 732, 734, 735, 738,744, 747, 748, 753, 762, 764, 766, 769, 782, 784, 788: n = A,T,C or G
  misc_feature 789, 795, 800, 801, 804, 806, 807, 813, 816, 822, 837, 840,842, 844, 848, 849, 851, 852, 853, 857, 860, 861, 871, 873,892, 896, 900, 903, 906, 913, 921, 924, 925, 926, 934, 939,942, 947, 948, 957, 960, 964, 965, 966, 974, 975, 977: n = A,T,C or G
  misc_feature 990, 995, 996, 997, 1004, 1006, 1007, 1013, 1020, 1021, 1027,1028, 1030, 1033, 1034, 1036, 1040, 1041, 1045, 1047, 1050,1051, 1052, 1055, 1059, 1060, 1061, 1063, 1065, 1068, 1072,1073, 1083, 1085, 1086, 1089, 1090, 1092, 1093, 1100: n = A,T,C or G
gggnttccccctnnnaacccnttggaaanccnctggngctncntgcaggatcccagcnatngcactgagcnntgnggccnacggcngagccntttttcngcgagacgngcccnncanggcnccggggngctcgtgctggnnagccnatgggnagcannnancncaancggcctnccnanaccagagnnncanaacgnaccnagnnngtgggcncnccctangtcnaggacanaatannnanncntancagctgntngggcncgcannaanggnanannnncaggcccncnaanntaagctncnngaancacncgntntatacncccnananaagnncncnngntaacaacgccaggcggagcnttcgngganananccacgagngncccgcctaaggaaatggncgccnanancagnaccccgaanaanagtantngnggtnnntaanccgagngaacgtgacaggcgnnacgcaccgacatngggcnaaanagaatcgcctnggngncacatcgngnnacnagnganaacgtncaacgnacanncgngcacccnntnnnacnngtcanacgaaacnncncncgcatntgagagcncggcgcnctcnctgcaaggggnngcttcnnnacccccgccnaaananttnnnagaaatcccnccnagacgtnttataccnnagacacnaccnngacccngcgnngcantagtcgnanagagaggctnggtnagnananncantgcgcncgnntcccnttcggcgcncnanaanaagcccagcgctntngaanngtggcnccccnntgngnncgcgcnagncacccnggtggcgaaaacacnggnangngccnntnnnaacncannggggggggcnanaacccggggggaaggcgtnaccngcanaanggngaaaacngcccacanttnnnctccgccnggcantanccccnngaacatcgnggngcannncccggcanngnccccggccaggcnggcgnnncccaggnannttacgnaccgganncccggnncnacnncnaggnncccnanacnnnggnaccnnngncnggngggnnacgatggggncnngcnngnnctgccanca

SEQ ID NO: 5552 - DNA, 855 bp, Homo sapiens
  misc_feature 15, 25, 33, 41, 45, 50, 65, 85, 94, 96, 174, 180, 242, 254,255, 275, 282, 291, 297, 314, 346, 354, 411, 421, 465, 489,498, 518, 538, 544, 547, 549, 564, 571, 580, 585, 586, 587,590, 591, 595, 597, 598, 603, 604, 605, 612, 614, 617: n = A,T,C or G
  misc_feature 618, 619, 620, 621, 623, 626, 628, 629, 630, 635, 636, 638,639, 640, 643, 646, 648, 649, 652, 655, 659, 662, 664, 665,668, 669, 674, 675, 684, 685, 687, 688, 689, 694, 703, 705,706, 711, 712, 715, 721, 722, 726, 731, 737, 739, 743: n = A,T,C or G
  misc_feature 747, 751, 752, 755, 757, 758, 763, 766, 769, 770, 772, 779,788, 791, 796, 801, 808, 810, 814, 818, 820, 822, 829, 830,833, 838, 839, 844, 851: n = A,T,C or G
ggtgcttccccctgngaaccctttntacaggcnacttgtantttntgcangatcccatcgactcnaattcggcacgagggcatancccggaatngngtttttgatgcatccagtcgtggcattgcaagaagtctgtctgatgaagctcgggaagcattttgcaatattcccttnggctgngttcctgtgttccctgctcccacttatcttcccctggtttgtgattattaggagagaggttntgcaaagactcnntgctgtgaaagaatcttttnttaattnttatcctanagtcantcacttttattccaggnagtcatgctgatctacttatccaaagccagcnaaccaggntcatcctaccatcctcatggaagactgtgtgtatgaattggagtaacagaactgaantacacttaancagtgacagcactacttcccagggtgggggccatatttctctgngtcctactctgagcaacttctcanagatacganggggctagggttttcccatntggggaaatggggtgaaagnctgcanatngntaaaagcaaatgttngaaccancaataaatnagatnnntcnncatngnncaatnnngcactantnacnnnnntnganannncgtanntnnnctncgncnnctnggnagtntcncnnggnnctctnnattcctcgnnannngatcngcaattggnannttcannatntggatnnacanctatncgtgancnaatnaacntacnntgngnngtacnacnacnntnactatcncatacgcgntcnaaaancgatntcacgtntncacnattngnanatatcannttnctctnncttgntctattnaccg

SEQ ID NO: 5553 - DNA, 843 bp, Homo sapiens
  misc_feature 2, 3, 4, 5, 6, 11, 24, 602, 619, 638, 703, 718, 723, 728,733, 748, 749, 756, 758, 759, 760, 761, 762, 763, 764, 765,766, 767, 768, 769, 770, 771, 772, 773, 774, 775, 776, 777,778, 779, 780, 781, 782, 783, 784, 785, 794, 799, 810: n = A,T,C or G
  misc_feature 815, 826: n = A,T,C or G
tnnnnntttanttttaatatactncagctcttgttctttttgcaggatcccatcgattcgaattcggcacgaggaacattcggactcgagataatcgtcgccttggggagtgggacttgcctgagctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactggtggaggcacatgtctgctctcctgaaaagagacttggtttggggaccccacaaaaggagggaagctgtagctgtttggatgtgaggagaatgaaactacaaaaaaaaataaattgggccaggcgcagtggctcatgcctgtaatcccagcactctgggaggctgaggcggacggatcatgaggtcaggagatcaagaccaccctggctaacacggtgaaaccctgtctctactaaaaatacaaaaaattagcccgggcatggtggcacacgcctgtaatcccagcttcttaggaggctgaggcagganaaatcgctttgaacccnggaaggtagaaggttgcantgagcttgaaaattgcgcccacttgcaccccccttaggcgacaagaaccgaagaacttttgtctnttaaattaaattaanttaanttaanttaanttcccaacctggggnnaaaaaanannnnnnnnnnnnnnnnnnnnnnnnnnnncccttcganccttnttaaaaacttnttagnggaggtcggtntttaccgttaaaatccc

SEQ ID NO: 5554 - DNA, 1501 bp, Homo sapiens
  misc_feature 1, 3, 23, 24, 25, 27, 29, 30, 35, 36, 37, 39, 40, 42, 43,50, 61, 68, 69, 72, 74, 86, 97, 106, 108, 110, 117, 122,131, 134, 137, 139, 141, 142, 143, 144, 149, 153, 162, 166,170, 171, 172, 190, 196, 197, 202, 205, 214, 217, 220, 227: n = A,T,C or G
  misc_feature 228, 229, 238, 241, 243, 248, 250, 263, 266, 269, 272, 273,277, 278, 283, 291, 292, 294, 295, 298, 303, 304, 307, 323,325, 328, 330, 335, 354, 360, 370, 372, 389, 394, 400, 407,409, 425, 434, 450, 456, 463, 464, 467, 472, 474, 482: n = A,T,C or G
  misc_feature 486, 487, 496, 500, 509, 513, 516, 517, 518, 521, 529, 538,539, 541, 542, 544, 547, 549, 554, 555, 558, 564, 570, 571,572, 577, 579, 584, 586, 590, 592, 593, 596, 598, 605, 607,611, 612, 614, 615, 617, 621, 627, 629, 633, 637, 641: n = A,T,C or G
  misc_feature 643, 644, 648, 651, 652, 664, 671, 676, 677, 684, 694, 696,698, 703, 709, 710, 713, 715, 716, 717, 718, 719, 721, 723,729, 735, 738, 739, 741, 752, 758, 761, 765, 767, 771, 773,778, 780, 781, 785, 795, 797, 809, 810, 815, 818, 820: n = A,T,C or G
  misc_feature 824, 837, 843, 848, 851, 854, 857, 858, 860, 862, 864, 876,879, 884, 885, 891, 902, 904, 911, 922, 929, 939, 943, 945,969, 972, 985, 996, 998, 1002, 1005, 1006, 1007, 1008, 1016,1024, 1027, 1037, 1038, 1044, 1046, 1047, 1048, 1054: n = A,T,C or G
  misc_feature 1055, 1063, 1071, 1075, 1080, 1082, 1084, 1086, 1088, 1094,1096, 1098, 1099, 1101, 1102, 1103, 1106, 1108, 1110, 1122,1124, 1132, 1133, 1134, 1140, 1143, 1144, 1151, 1157, 1161,1164, 1167, 1177, 1178, 1198, 1201, 1202, 1203, 1205: n = A,T,C or G
nanggagcaaggccaggtttttnnncngnnctaannnanntnnagaaacnacggcttttgnggtttannggncnaaaaaacccccncaatgcaggcnccagcaganananaaggagncggcncggggaggnggnaananannnncatanaccngacgagagnggancacnnntaacagaagacacaccanaacacnngaacncancacaaagantcncanacctaannngcgacgaanacncnacacntntttttttttcacnaanaanacnnaaannagagngaacgcannannagnacacnnacnaccacgagggggagangnacnanagagnggacaacaagagaagaaanaacaanccaacacgcncngaacaacaacacccccngacancacaanaacacanancgcaccaaacaataanatcagaganacacacagaccaacanaacacncaacacnngcnaaaancnaacgaagnaaanncaaacaacnaaanccacaacgnagancannnacnacacaagnaaaaaaatnnannanaanancaaanncanaaaccnaaaaannncacananaacananaatncnnaancnaaccaancnacannannanaccncacagnantaanaaanaacngnnacanaannacacagagacanacacacnatacnnacaccanacaaaccaanancngacanactacnnaanannnnnancnaaacancgacanagnnanacaaacaaagnacacgnaancatncncacnanagcanannacgnataacaccgnangagaaagatacnnacatnaananctanaaacgcataccgngcgcgncatanaanagnacnnanananataatagcaaanaanacacnnaagcanaaacaacacangncaacaanaacaaaaaganagaatcncacagacagngcantnacgcacacaactagacacacaagnganacaacgacacaanatagataagananaganagnnnnagaaaacncacacganacncaacacgaannacaganannnaccacnnaacacaangagcaccnacancaacnanananancaccancnannannnaananangacacaaacacncnatacaaannnaagacnacnncacacanagatanaaanaanagncgaccgcagnnaaacaccacgacaggaacanaannncnnacnanananngaaanngtananngagggaagcaaangaaannaacacantangnnggaacacaaanaanancanannnccatnaaaganaannacannaacnccnganaaaaanggaaacacanaancanaccgnaanaanancnncnnananannacaaaancaccntagaancncanaanacngaacnaaacacaacnnnancanacaaccgaatnaaannnncancacaaatgnntnanaccaaaganaacnanancannncaaaacnacacncncgaaggntnnnaacnng

SEQ ID NO: 5555 - DNA, 806 bp, Homo sapiens
  misc_feature 28, 29, 30, 97, 144, 153, 218, 224, 248, 260, 268, 270, 276,280, 293, 333, 350, 366, 387, 459, 503, 512, 516, 533, 566,580, 584, 593, 606, 608, 614, 621, 633, 636, 639, 670, 693,694, 705, 712, 719, 753, 769, 771, 786: n = A,T,C or G
tttttaaaacttttaagcccttgtgcannngcaggatcccatcgattcgaattcggcacgagaatagtagaaagggtccccattcctgctcagcacntttcctctctacccccccacagacacacatgctgacacacacatgcngacaacacncatacacacacatgcaggcactcacatgcaggcccatgcacacacacgtgcacacacatgcaganacatgnagacacgcaggcacacatgcacanatgcaaagacangcatgcangnacacgnagangcaacagagacanacatgcagattcacatgcacacacacatacacacactggnccctgtttttctgtggngtcactgggtgccagnaactctgtatattacacctancactaaaacctgggccttaatttctctcccgtccccacccctaaattcctgatggatgaacctaagaacttncctgtacacttcaagccggactgacgtagcctatgggcccaagnaggtccagngccnacgttttaatttctttntaaaaagctttaagtcttgctgggcgcggtggntcacgcctggagtnccantatttttgnggaggccaaagcngntggatnacaacgngcactggttcgngancancctgaacaacatgggggaaaaccctggtttntaattggaaatacaaaaaaaatnngcttgggccanggtgganaggcacnttgtgaactcaacctccaggttttttggggccanaaagcatacccccacnangcccaatttaatttnttaaagggaatccttggtag

SEQ ID NO: 5556 - DNA, 695 bp, Homo sapiens
  misc_feature 408, 431, 438, 448, 451, 458, 459, 460, 461, 467, 527, 547,571, 593, 609, 635, 651, 661, 663, 678, 685, 688: n = A,T,C or G
agattaaagaggaaagcagagactggttaggttattatagtgtcctaggtaacagttttggacaagtgtgataaatgttgaggtgggaggggttagaggttggattcagactctgttttgtaagtagagaagataatgtctgctgatagcttggatatgaggaggaaaaggagaggagtaaaggatgactcagatttttgacctgtcaattgggtgaactctgagattaaattctgttttggctatgttaggttggaaatgctgtgtaggcaattggatatccaagtctggacttcaagagtacaatttgggactagaaaattaatttgggagtcattagggaataaccatgactttggatgagatcacctagtacagctagagaagagaaggtagcaaaagacaganacctaaggtatgccagcattgangaagtanaggagaaganganccatccnnnngactgncaaggacccaccagttgaccttagaagaaaaatcaggagctggtattctggaaaccatcngaagaaaatgtttcacaaanagggaagtagtattgaatggtgtnaaatgttacctatattcctggnaaaaaaaccacttcanctgcttttttaagtaaatgttgatantttgtactgcaaatanctttccatantncttttcaaaacatgntattttnggncctttaa

SEQ ID NO: 5557 - DNA, 998 bp, Homo sapiens
  misc_feature 5, 15, 80, 89, 90, 92, 96, 97, 105, 107, 113, 117, 119, 124,130, 137, 138, 141, 144, 145, 158, 161, 164, 170, 172, 173,174, 175, 185, 192, 200, 208, 211, 216, 221, 231, 233, 243,245, 247, 249, 251, 253, 256, 258, 259, 263, 268: n = A,T,C or G
  misc_feature 271, 275, 281, 282, 294, 297, 300, 302, 304, 310, 315, 319,326, 330, 333, 335, 346, 347, 351, 352, 354, 357, 363, 369,371, 373, 375, 379, 381, 386, 395, 398, 408, 409, 419, 427,436, 437, 445, 450, 453, 456, 457, 459, 462, 466, 478: n = A,T,C or G
  misc_feature 489, 492, 496, 505, 506, 507, 509, 518, 525, 527, 531, 534,538, 547, 548, 553, 555, 558, 559, 562, 564, 567, 591, 593,594, 595, 603, 607, 612, 615, 621, 624, 627, 629, 632, 635,636, 640, 642, 646, 651, 658, 664, 667, 680, 684, 693: n = A,T,C or G
  misc_feature 703, 715, 717, 725, 726, 729, 730, 737, 747, 751, 767, 783,787, 788, 791, 800, 802, 806, 828, 829, 840, 844, 846, 853,863, 864, 872, 876, 896, 897, 898, 913, 914, 919, 924, 929,936, 944, 947, 961, 968, 970, 972, 974, 982, 991, 997: n = A,T,C or G
ggtgnttccccctgngaaacctttatacagcctacttgttctttttgcaggatcccatcgattcgaattcggcacgaggncacattcanntntcannttttgcancnttatancaanantcatngccganacattanntgnctnnaatagtactgcangcncancatctncnnnngatccctgtnaccttgnccctggancactcgtnagncaagntctgntcccagatgncntgtaaccatnantncnananaanannatcnagggnctntttntttccnncaaacagatgcnatntgncncnggctgntgtgntgtngagggcnctangcncnggcaactattnncttnnangcngaagtngttacncntnanggcncncttanctttcaatnagnaccacatgcnnctgccaaatngtgctctnagctaaatnnttggactntgaantanggnncnaanggtnttgcaataacantgtggatctgnaanaagnctgtttggnnngngacctaatnacctcancngggnggnctcnctcttaacnntttantnccnntcntnganagtgattcataccaaggtacccangnnnggtaatanttcnactcntgngatcgnaanttntnccnttnnatcncnttanagagnggtcgtnacccangtntgttcgcttcgcncttnttttggggngaaatgtatntccccatggaancnttgggggnnccnntttgatngccgtaatancatnggaagtcaacttgganttaaacgggtgctcanttannctnagccgaatntngtcnttggcaaacccttgccaatacnnccaattacccnatantngcaaagnaaataggccnngcataccnaagngggaccctttataaattggnnnatggacttccccttnnaagtngaacnttggncttagcnaaaaggcnatnttcttgtatgaagntcgcagnantngnatttattngggttctangggccng

SEQ ID NO: 5558 - DNA, 1523 bp, Homo sapiens
  misc_feature 13, 16, 17, 18, 19, 26, 27, 28, 30, 36, 37, 40, 43, 46, 50,51, 52, 57, 60, 65, 73, 74, 79, 80, 82, 88, 95, 96, 99,101, 105, 109, 112, 115, 121, 122, 128, 144, 160, 162, 164,174, 178, 179, 185, 189, 190, 193, 200, 201, 203, 204: n = A,T,C or G
  misc_feature 210, 212, 216, 222, 225, 226, 227, 228, 239, 243, 259, 274,277, 279, 281, 287, 290, 291, 297, 303, 304, 306, 307, 313,315, 324, 338, 346, 352, 354, 366, 372, 374, 380, 389, 390,391, 392, 394, 396, 397, 400, 401, 408, 409, 412, 416: n = A,T,C or G
  misc_feature 419, 426, 427, 433, 434, 436, 444, 451, 454, 455, 456, 457,459, 461, 469, 474, 478, 483, 484, 499, 504, 507, 516, 518,520, 521, 522, 525, 530, 538, 546, 549, 550, 553, 558, 559,561, 565, 569, 575, 576, 579, 585, 593, 598, 600, 604: n = A,T,C or G
  misc_feature 605, 606, 607, 608, 609, 610, 613, 614, 617, 624, 625, 626,630, 631, 632, 634, 637, 638, 639, 654, 655, 656, 659, 662,677, 683, 689, 691, 695, 699, 704, 706, 707, 709, 713, 714,722, 727, 733, 742, 744, 747, 752, 755, 759, 766, 773: n = A,T,C or G
  misc_feature 779, 781, 782, 783, 784, 787, 790, 794, 796, 797, 799, 802,804, 807, 813, 816, 825, 827, 828, 831, 833, 835, 837, 840,843, 846, 847, 860, 861, 863, 871, 874, 875, 882, 886, 890,896, 915, 916, 929, 932, 933, 934, 937, 940, 943, 944: n = A,T,C or G
  misc_feature 945, 951, 958, 964, 965, 972, 978, 985, 986, 987, 993, 1001,1007, 1009, 1011, 1013, 1015, 1017, 1019, 1020, 1022, 1023,1040, 1047, 1051, 1053, 1065, 1066, 1071, 1089, 1092, 1094,1098, 1100, 1104, 1106, 1111, 1115, 1119, 1120, 1126: n = A,T,C or G
ccccccccccccnacnnnncacccannncnaccccnnacncanacnaatnnncgccncantcacncaccccgnntcganncncccccncctaaannccnancgcnctcnccnggntcgcannccaccnttgaacctttgcaaanactggcaaacccgccncnanagcggggggngganncacacncacnncanatactanncnncccacntncganaacganagnnnncccccccaacnactnaggggcacctcggggnccctcctcctacgcnacncnancacatnacnncctccngttcanncnngacagnancctctcacnccccacgcctgctncctctccncatacncnccccccctcccnatacgncncgacancccacgccnnnngnannctnnctcatcnnacncacngcnctacacnncccacnntncccttctnggcgcancannnncntncatcgccncagcncacnctctnnctcacccccatcatnacctnaanccgtctacntntnnnccnctcanctcacgcnctaaccgncannccncccgnnanactncacnctcaanncanatcganccccctcncaccncnaccnnnnnnncgnnccncccaccnnncaannncngtnnncccacctcgagaccnnncangcnaatacccccgatcanccaccnctctantncagncctncccgncnncncganncacacgangcccncacacnacagcgcantncgncaccncanacangacccanctgcccncagcgngnnnnggncanaaangnncngcncnccnctacantcntccacccancnnccntnancnccntantannaccaagccagtanncncacctcanctnncgaatcnccancacnccacanacgaccgcaccccccaacnncagcactctcacnacnnngancancannntccacnacactcnttctcnntactctntctcantcccccnnnctaacngctcactncacaancnancncncncnnanntagcctacgccaacganacgcacnctanancctacgacaccnntcacnacacctcaccgtaccccnccngntctncnctcnancgacngaancgtnncacgcncancacancactcgagnantcacacgnnacacctncacgantactccgncaccnnnnanntnacnccactngancgcatcntctcncctaacnacacnacntaccncacctcacnccatatccacnctcaccactcacacannaganaagnnnanaccgctctcagcacntactcactancnccncaacncncaccacancncanacgtnanaccnctcngcgnctcacannagcgnctgnnctgcnnnctcccgnatannntcgcaccntgancacncanacntntcccncngccccacgactgagcncncnntctcnagacnncanccactntcnacacnncnngacgcanctacngcnccancncannnctnanngacncacngtcccannccc

SEQ ID NO: 5559 - DNA, 726 bp, Homo sapiens
  misc_feature 6, 8, 10, 21, 26, 61, 63, 66, 72, 77, 78, 82, 89, 98, 104,111, 112, 114, 115, 116, 118, 122, 128, 130, 132, 152, 161,167, 171, 182, 213, 256, 264, 272, 296, 299, 303, 305, 316,324, 330, 338, 339, 340, 346, 349, 357, 366, 367, 379: n = A,T,C or G
  misc_feature 385, 391, 394, 395, 401, 403, 410, 420, 426, 441, 460, 467,505, 511, 512, 517, 521, 538, 540, 543, 544, 558, 566, 569,572, 585, 587, 591, 595, 596, 601, 602, 611, 629, 634, 635,658, 660, 664, 671, 677, 679, 695, 702, 704, 710, 713: n = A,T,C or G
  misc_feature 717, 718, 719, 722, 723, 724: n = A,T,C or G
gttatnancngctcttgttcntgctnctggatctttttgcaggatcccatcgattcgaatncngcncgagtntaggnntganccattgnacccagccnaggttnttaatannannnanagcntgctgntntnaaaagtgaaaagaggccagntgtggtggntactgnctgnggtcccagctnctccggaggctgaggcatgaggatcatttgngcccaggctgcaatgcaatggcactgatcacggctttctgcanccttaacntgctgggngggacacggagtaccctgtttttnaangaanantgcagagtacnccaattgnatatgntatataannncaactntcntaaagganctgtatatnnaatgagtggaancaaatntggcanacnnttaatngnacatatnttgaaactanagctcnttacacttctttganctacaacgggtatatgtcntacttanatgatgcacaaaaggtgcaccatatatatatatgtttntgacgnnggttntganagagtttcactcttgcncncannctggagaatgtacngaactganatnggngaaatgtctccancngggngatnnagatnnactgggctntcgtggaagaatggtgtntaccnnaaaatttggagcctctttaaacnantggngaggacntttacntnggttccccaaattgtngaggggncntttggngantttnnnccnnncc

SEQ ID NO: 5560 - DNA, 1554 bp, Homo sapiens
  misc_feature 7, 9, 10, 11, 13, 14, 17, 20, 21, 22, 23, 26, 28, 30, 36,37, 38, 39, 40, 41, 42, 44, 45, 46, 49, 50, 51, 53, 55,58, 59, 60, 61, 62, 63, 64, 65, 66, 67, 71, 72, 73, 74,77, 85, 93, 94, 96, 110, 119, 128, 139, 141, 142, 144, 146,148: n = A,T,C or G
  misc_feature 149, 153, 155, 158, 159, 163, 171, 173, 175, 177, 178, 179,181, 189, 190, 192, 193, 194, 196, 204, 205, 206, 208, 209,210, 211, 213, 217, 218, 220, 222, 223, 228, 232, 234, 235,236, 237, 238, 241, 244, 245, 246, 247, 248, 250, 251: n = A,T,C or G
  misc_feature 257, 258, 259, 261, 266, 267, 275, 276, 280, 284, 286, 287,294, 297, 298, 299, 303, 312, 313, 318, 322, 323, 324, 325,326, 332, 334, 336, 337, 338, 339, 340, 341, 345, 346, 347,349, 350, 351, 352, 353, 356, 358, 360, 361, 370, 371: n = A,T,C or G
  misc_feature 372, 375, 376, 379, 380, 381, 388, 389, 393, 398, 401, 403,406, 407, 415, 417, 420, 427, 428, 429, 431, 433, 435, 437,438, 440, 444, 447, 448, 452, 454, 455, 456, 458, 459, 461,462, 471, 472, 473, 474, 476, 478, 485, 486, 488, 489: n = A,T,C or G
  misc_feature 490, 491, 492, 493, 495, 500, 501, 502, 503, 505, 509, 510,513, 515, 516, 517, 523, 525, 528, 532, 533, 537, 539, 540,544, 545, 552, 553, 556, 558, 562, 564, 566, 567, 571, 573,574, 575, 576, 582, 584, 585, 588, 591, 592, 596, 598: n = A,T,C or G
  misc_feature 602, 603, 604, 605, 606, 610, 612, 614, 618, 619, 620, 624,627, 629, 630, 631, 634, 638, 640, 642, 649, 650, 652, 653,654, 655, 658, 659, 661, 662, 663, 668, 670, 671, 674, 675,678, 681, 684, 686, 688, 690, 691, 694, 695, 696, 699: n = A,T,C or G
ccacccncnnntnnttnatnnnnccntncnacctcnnnnnnncnnnggnnnantngcnnnnnnnnnnaagnnnnctnatgaactnaataaganntngctggtctgaaatngcctaactngaatagggnctggggggggncnncngncnnaggntnatnncgtntccagtgntntngnnngntctcgganntnnntntaactatnnntnnnnanccannananngtcgngggntnnnnnatnttnnnnntnnatccannnancacanntccttctnntcantccnannaacctcntannnccantcccctatnntcgancagnnnnncccacngntnnnnnngtcnnnannnnnaancnannattcagctnnnacnntannntaacttnncccngcaangancnccnntctcctcngntcnaccggcnnngnantncnngntcancanntatntnnntnntnntctatcctnnnncntntctagannannnnnntnctacnnnntncaanncancnnnccatanantantccnnctcngnnctcnntcctcanncgngnactntncnngctncnnnntatctntnntcnacnncacncnatannnnntctnanantccnnnttcnacncnnnctnatcncnantgcctanncnnnnccnncnnnatgtnanncannatnctntanancngnngcnnnctnntcannnnncacnctnnatcacatntnnctntnnangannnntcnntntccnnancatcnatctncanctctncanntntncnntatccgcnnnnnancctntnntacnntccctncatanantanacnncnctntcctcannnncnnntnantcnntatncnnnannncnctnctctacacncgcnncngcntcnactnncncnctatcnnnnnaanntcncanctcatnacctcnctcntnntnnntncnatcncatntatanacnnanactctctntcgnctatnnnngncnntctncacagtatnccnctnntntncntannancgannctccncnnatataatcactnnacactntactcnnantncttactntnnaccnctctnncatccnnntcncctctnnnctcatatntgnntacnntnnancatctctcncancancnnantacacncnnnatncntannncanantnncntncannncntcnnctnntcngtnnnnctcncactctncacatatatnatctanctnacncacncctnnntnnnnnntnctcannnctcncnnntctatntgctatacatnnccctnntancantatccanngcccncacnatanctcanntatctcntnccttntancnccctncntcctcntcanacccancttactctcttantnncacnctntncntccnccnnnctntnatccnaacncnnnctanttncatccancnctccgtatanctcccntnncnncnngcccnccccntactnctctcanntgnncccntntnncatntcnctntcnnnccaccccttcncnncgnccnttnntnannccncct

SEQ ID NO: 5561 - DNA, 763 bp, Homo sapiens
  misc_feature 592, 641, 717: n = A,T,C or G
tttacatacagctcttgttctttttgcaggatccctcgattcgaattcggcacgaggtctctgcaaaagacccctccgacccgagtgttcgtggaactggttccctgggctgaccggagccgggagaacaacctggcctcagggagagagacgctaccgggcttacgccaccccctctcctcaacacaagcccaaactgctacccgcgaggtgcaagtaagcggcacctcagaagtgtctgcgggccctgaccgggcgcaggtggtggtgcagtgagcagcaccaaggaggcggcagccgaggccaaaaagagcgtttgtcgccgtctagattacatcacgcagagcctccagcagcagggcgtgcaggcagaaaatataactgtgacaaaggattttaggagagtggaaaatgcttatcacatggaagcagaggtctgcattacatttactgaatttggaaaaatgcaaaatatttgtaactttcttgttgaaaagctagatagctctgttgtcatcagcccaccccagttctatcatactccaggttctgttgagaatcttcacggcaagcctgtcttgttgctgttganaatgcgtggcgcaaactcaagaagtctgtaccttgtggccaaaccttangaaaacctttctaatcaaagaagaagaacaaaagaatgggaaggccaatagatgatcaccagtcatccagactctnaagttcattactgtccacaaaaaatcaaaagtgcacaatacttctg

SEQ ID NO: 5562 - DNA, 953 bp, Homo sapiens
  misc_feature 1, 5, 11, 19, 20, 32, 33, 34, 36, 40, 58, 63, 72, 75, 79,87, 104, 107, 116, 118, 120, 131, 134, 135, 142, 150, 156,157, 207, 211, 212, 217, 225, 246, 247, 260, 272, 277, 279,282, 288, 290, 299, 306, 309, 310, 313, 321, 324, 332: n = A,T,C or G
  misc_feature 337, 349, 352, 355, 379, 392, 401, 404, 413, 422, 428, 432,435, 448, 449, 467, 471, 483, 489, 490, 496, 499, 501, 505,510, 515, 522, 528, 534, 535, 536, 546, 550, 552, 554, 556,568, 574, 578, 586, 588, 599, 603, 604, 608, 615, 626: n = A,T,C or G
  misc_feature 633, 636, 646, 647, 652, 656, 667, 668, 673, 679, 682, 689,691, 693, 694, 699, 700, 704, 706, 711, 717, 721, 724, 727,729, 732, 734, 744, 746, 750, 751, 754, 759, 760, 769, 770,773, 780, 782, 791, 792, 793, 795, 802, 805, 819, 821: n = A,T,C or G
  misc_feature 828, 832, 833, 834, 837, 842, 845, 850, 851, 860, 870, 873,876, 889, 891, 894, 898, 901, 902, 913, 916, 918, 919, 923,929, 930, 931, 932, 937, 940, 941, 947, 948: n = A,T,C or G
nggtncaccgnaacaacgnngaatcccccaannncncganacagaaaggcaggggtgnggccngagagccgngcncacngggcacancagcgaccttttaggcnttnctgcactgncngncccactgccgnaannggcactnccccacgnacgagnntgcaacgagacatccgtacgtgctggacaaccttggagagaagccgtatncacnncacangataaaancgccatggaccacgagtgccnngggcactaccgangagccgcctccnggaancnttnccaagngngagcgcccnaccgacngtnngcngatcaganacnggagaggnggagngagaagactccngcngcncgggcccccctggggagcccccgntccagggctcgcnccaggaccngcngcacaagangactagctngcagcnaccngcnttccccagtccannctgaaaaactacaaaatnaaangcgggaaaagcnctgtanngagaanggncntccncgcanctccnaggaggnaaggcnggagannnccccgctcgnaaangnangnagcaagggaaanccccangggncgggcccncnagaaggccccncccnncaanaaagaangccacaacaanccaagangcnagcacgggcnngcccngcanaaaaccccccnnacacnggaaanacncccgcgnananngcaannaacngnatacnggaaangcanagngcncncananaacaagcgcncncccnnacnagggnnacacaaaannccngagcgcncncgagcgcgnnnanacacaangcnagcacagggacacncncagacgnaaannnggncacanacncgggnnagaacccancacgaaaccnacnacncacgagggagagngnacnaaanaanncgcccccacgnganannaaanccaacnnnncgaanacnnacggannacgcc

SEQ ID NO: 5563 - DNA, 860 bp, Homo sapiens
  misc_feature 3, 5, 7, 8, 59, 60, 66, 68, 69, 70, 72, 76, 77, 89, 91, 95,97, 103, 111, 115, 118, 120, 123, 126, 128, 131, 133, 140,143, 144, 147, 151, 155, 156, 157, 158, 171, 172, 174, 182,184, 185, 187, 192, 193, 195, 196, 200, 209, 215, 233: n = A,T,C or G
  misc_feature 234, 251, 255, 257, 258, 265, 270, 271, 276, 289, 297, 320,323, 342, 345, 350, 354, 357, 358, 364, 365, 369, 375, 376,380, 381, 387, 389, 395, 415, 429, 431, 438, 442, 444, 445,452, 459, 461, 465, 466, 470, 471, 477, 481, 482, 490: n = A,T,C or G
  misc_feature 494, 497, 498, 501, 503, 504, 510, 512, 513, 517, 539, 541,547, 548, 550, 552, 554, 556, 557, 561, 567, 570, 582, 584,585, 589, 590, 593, 597, 607, 611, 617, 619, 625, 626, 629,634, 635, 643, 649, 654, 657, 659, 661, 667, 668, 671: n = A,T,C or G
  misc_feature 672, 673, 683, 690, 693, 697, 703, 706, 707, 709, 717, 722,723, 730, 736, 748, 750, 761, 763, 774, 776, 779, 784, 789,790, 802, 822, 835, 841, 843, 855, 857, 859: n = A,T,C or G
ttnantnngtcattcctgtaccagctacttgttctttttgcaggatcccatcgattcgnngatatngnnngnctanncaaagtgggaanancttncnggctgngaaaacangctntangnccnaananccngntttacangtnnaanactntgtnnnntttgagcatgttnncnggtcttangnngntattnnanngtanccactttgnagaggngtatctggcaacttttcnncttatggttcaattagntccngnntgcacantgagnntgatnattacttgtgagntgagctcntgcgttttaccgacttctggctnggnactggtgccattagctatnaanaggcntttngtnncataannttcnggtaanntganngatctntnaagatncccctttaattcgttagtantaccattacgtagncnaatttangatncnnattcccnaattttnancatnnccanntgtaanatcnntgaattancagnacnnccnanngccctntnnaggnttgatttctcgatatttgactncntctggnngnananannggcnaagaanttnaccattggctangnnaaannagngtgntgttagggtnaaantcaccntntttttnnacnaatcnntggaacantttacnatcanttngnanaaaacnntannncttttgcccnatggganctntttnttaaanccnntncctttttntaacnnttttttnaacccntggaaaaaattngntaaataaaatntngccctttaaananttnttcgnaattnngaatatcttaanggcccttttaaaaatatggnccccgtttatggngaaaantnattgccagccantncnt

SEQ ID NO: 5564 - DNA, 714 bp, Homo sapiens
  misc_feature 1, 6, 13, 23, 24, 600, 619, 640, 648, 663, 690, 706, 713: n = A,T,C or G
ngtctnttaacgngctcttgtcnngctacttgttctttttgcaggatcccatcgattcggtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggcacagtgaacgtagtttacnatcttgaaatgaaacttanattttctggggaaatgttcanatcagttntgtgaactgtaaatnaaaataccttttctacagttatctttnattttctgcaaattangaacctnt

SEQ ID NO: 5565 - DNA, 868 bp, Homo sapiens
  misc_feature 5, 6, 15, 27, 30, 31, 36, 40, 41, 45, 52, 53, 69, 74, 76,80, 103, 109, 111, 123, 127, 130, 131, 133, 135, 152, 153,156, 159, 162, 166, 167, 170, 173, 181, 183, 184, 187, 190,195, 201, 203, 204, 205, 206, 208, 212, 215, 217, 222: n = A,T,C or G
  misc_feature 223, 224, 230, 231, 234, 238, 243, 245, 247, 250, 251, 258,261, 263, 267, 270, 271, 272, 274, 275, 282, 294, 300, 301,302, 303, 305, 308, 310, 311, 313, 316, 320, 322, 324, 326,328, 334, 335, 336, 343, 347, 349, 350, 356, 363, 365: n = A,T,C or G
  misc_feature 368, 373, 375, 376, 377, 378, 383, 390, 393, 394, 395, 398,399, 400, 401, 402, 403, 404, 406, 408, 413, 419, 421, 426,431, 432, 433, 434, 438, 439, 441, 444, 446, 448, 452, 454,456, 457, 458, 460, 465, 469, 477, 479, 480, 484, 485: n = A,T,C or G
  misc_feature 486, 487, 488, 490, 491, 492, 496, 498, 500, 502, 506, 508,509, 517, 523, 528, 529, 535, 536, 538, 541, 545, 546, 550,552, 553, 561, 563, 566, 569, 570, 571, 573, 577, 578, 579,584, 586, 587, 589, 590, 592, 599, 603, 605, 609, 610: n = A,T,C or G
  misc_feature 614, 615, 619, 628, 629, 631, 632, 634, 642, 647, 651, 655,658, 666, 667, 669, 677, 687, 689, 691, 692, 693, 695, 699,700, 702, 707, 712, 713, 714, 715, 716, 724, 725, 730, 743,746, 747, 749, 752, 755, 757, 763, 775, 780, 783, 791: n = A,T,C or G
  misc_feature 794, 797, 801, 802, 806, 812, 819, 821, 825, 838, 841, 845,848, 851, 859, 860, 866, 867: n = A,T,C or G
tttcnngtttaaacncctttaaaaatntgnnacttngatnnagtntaaagtnncccctctatatattgnagtancncctntaaaacatcaggaaaattaaggnggtctntngggggggtgatnttcnatnncnantgaataatgatccaagnntcntantangaannaangcnctatatananntantantactntttggntnnnnanctantanantctannntactcnntanatantatcncnangtnngcatacnatntnatcnttnnntnntttactncattatctctanatattnnnncnttntnntntancatncntncnanctttcnnncttattnatantnntttaantttttcntntcncttcncnnnncattnataattnatnnnttnnnnnnntnanttctntcaatntntcatncctcnnnnctcnnanctntntncctnantnnntntccantttnccatttantnnctannnnntnnnctcntntntntttntnnctcctaancctctnttttnntctcanntnttnttcnncttntnntttatttntntcntcnnncnctcnnnctttncnncnntntctttcnatantntctnnccanntctncatatcttnntnncnccttaatnttacncttncccnctnccccctcnnancattttcnttctccttanantnnntncttnntnttaanatatnnnnntttatttnnacttntttgtttgtactnctnntnacncanantcaatnacacatttatcncattncanatctttcnaantcnctcnnattncacttnattcacnantctncaattcctacatnctntatnctnacntcatattnnctcccnnt

SEQ ID NO: 5566 - DNA, 1612 bp, Homo sapiens
  misc_feature 3, 4, 13, 22, 24, 28, 34, 39, 43, 62, 73, 86, 98, 99, 102,105, 107, 108, 121, 131, 132, 134, 136, 138, 139, 140, 141,148, 149, 154, 157, 158, 160, 161, 162, 166, 168, 170, 172,177, 179, 180, 185, 186, 203, 209, 210, 211, 215, 216: n = A,T,C or G
  misc_feature 217, 218, 226, 230, 235, 237, 241, 242, 245, 246, 247, 248,260, 262, 263, 265, 266, 272, 276, 282, 285, 289, 292, 295,299, 305, 309, 310, 313, 316, 319, 327, 328, 330, 331, 348,351, 352, 354, 361, 362, 366, 370, 371, 374, 375, 377: n = A,T,C or G
  misc_feature 382, 384, 386, 389, 390, 392, 401, 408, 409, 410, 413, 427,430, 436, 441, 442, 444, 445, 451, 452, 453, 454, 456, 464,465, 471, 473, 474, 478, 485, 487, 496, 497, 504, 506, 508,510, 521, 527, 530, 531, 534, 535, 536, 537, 543, 544: n = A,T,C or G
  misc_feature 545, 552, 556, 558, 563, 573, 575, 576, 577, 578, 580, 581,582, 588, 590, 592, 593, 597, 601, 608, 618, 621, 623, 627,629, 634, 643, 645, 646, 652, 660, 662, 671, 676, 678, 682,683, 687, 701, 706, 709, 710, 711, 719, 720, 723, 727: n = A,T,C or G
  misc_feature 728, 739, 740, 749, 750, 754, 758, 766, 771, 772, 774, 779,783, 789, 792, 799, 801, 806, 807, 813, 815, 819, 825, 828,830, 834, 836, 848, 850, 855, 857, 858, 868, 869, 881, 883,886, 893, 903, 908, 909, 910, 912, 914, 917, 918, 927: n = A,T,C or G
  misc_feature 928, 933, 937, 942, 949, 954, 955, 956, 957, 959, 964, 970,971, 976, 979, 981, 987, 993, 995, 997, 1002, 1006, 1011,1012, 1017, 1020, 1026, 1027, 1033, 1034, 1035, 1036, 1039,1048, 1051, 1057, 1066, 1072, 1076, 1078, 1079, 1082: n = A,T,C or G
gtnnctcaaatcngcagcacgnanagtncaaagngaagnggcnctctacatatgagaccctnaaacatcaganattagggggtctngggggggcctcnncanatncnngaatactatccgnggcccttttnngntnannnntagaganntgggnggnntnnncggngntntntctancnnattcnnctttcatctcctactcngggggnnnactnnnnactctctnacanccctncnttcnntcnnnncctacctccctntnncnntcccgnactnaacacnctntccnacnttncttncactcnatannccnccnacnctcttacnntnnccaccacgtatctcctnccnncnctctctnnaccnttannatnntnactcncncnctnncnttcctatanctcagcnnntcnactccgcccgtcantcngctacngtccnncnntctctnnnnangcttcctnnacttcncnntcancacaatntncctcatctnnccacttntntncnatatctctcancctctnacnntcnnnntcatcnnnacaaatntctncntccanatccatcttntnnnnannnaccatntnanntagntccnactactntcccacgtanacntntctntntcccncatctcacntnntctatnatactctncnctcctcacnctatnanatcnnatanctatcctatcactnttacnaannncctcacannctntccnntctctctctannaccttcacnnttcnttcnatattatntactnntnaccanatancacacnacnctccccncntatanntacacntncacncactanacnanctcncnctcatactctantntcctncnntcttatatcnntctatcatatantnacncaagtcnctctctcatntaccnnnantnctnncccactacnnctccnctanctacnatacatncacannnnanatcanataccnntctcnatncnctctcntctctntntntcacnctanattcnnatatnccnctatcnncttccnnnntgnctcctactnctncctccncctctctcntcactntctnanntanctnnntctnttncttctcctcncacngtaccnctcnatatcatntntcatcnctcntccatanatncgnnacancntatatctctcctntntnccctannatncatctnctccnntncnncatctcatannnccnnctgtcanacnnangctctctcnactntccanctcctcnnctcgcnacngactnnatcncnattcctctnttngactccncctantcatcnccccctacnaccaacaccannatactnntcnnntcncctctnaatntcacacacantncannncaccntancttatctcanttctgntnacncatcactactcttctcatctacacatnantnnancctnattncttctacnctctcnttctcncntnatnannctntacangnctctnccatntctcncccctcctnctntntnnntcancnntcacncnaccantcannnctanccgcatctatattatnctcatatcctctanacantatcctcanatctcactnctannnatancnacct

SEQ ID NO: 5567 - DNA, 1503 bp, Homo sapiens
  misc_feature 13, 21, 24, 26, 27, 28, 29, 36, 47, 62, 73, 76, 83, 88, 103,106, 109, 112, 114, 115, 121, 125, 126, 130, 136, 140, 141,148, 151, 156, 160, 165, 171, 176, 182, 186, 187, 192, 195,197, 203, 204, 206, 210, 213, 216, 218, 222, 227: n = A,T,C or G
  misc_feature 229, 231, 235, 249, 250, 256, 260, 265, 266, 274, 279, 281,282, 284, 286, 291, 292, 297, 302, 303, 305, 307, 309, 312,318, 321, 324, 326, 330, 333, 334, 335, 337, 343, 346, 347,350, 352, 356, 366, 368, 372, 373, 374, 380, 382, 384: n = A,T,C or G
  misc_feature 388, 395, 398, 401, 402, 405, 407, 412, 415, 421, 435, 451,458, 459, 462, 463, 469, 470, 473, 476, 484, 485, 489, 491,494, 495, 503, 506, 507, 513, 514, 516, 524, 527, 531, 533,536, 544, 545, 546, 549, 550, 552, 558, 561, 564, 566: n = A,T,C or G
  misc_feature 568, 574, 579, 583, 584, 589, 590, 594, 595, 597, 607, 615,618, 621, 624, 630, 638, 656, 661, 665, 668, 672, 673, 685,686, 693, 698, 700, 706, 712, 713, 716, 721, 723, 732, 737,741, 744, 745, 746, 749, 750, 755, 757, 759, 760, 763: n = A,T,C or G
  misc_feature 765, 767, 786, 788, 789, 791, 793, 795, 796, 799, 800, 805,807, 814, 816, 823, 825, 829, 838, 839, 841, 842, 843, 850,853, 854, 862, 865, 869, 873, 874, 876, 879, 892, 894, 901,906, 907, 911, 913, 915, 917, 922, 925, 929, 930, 941: n = A,T,C or G
  misc_feature 944, 950, 951, 953, 954, 955, 958, 961, 970, 972, 975, 978,982, 989, 1001, 1003, 1007, 1011, 1013, 1017, 1021, 1023,1024, 1029, 1032, 1038, 1048, 1050, 1061, 1062, 1066, 1068,1069, 1071, 1073, 1074, 1075, 1083, 1084, 1085, 1086: n = A,T,C or G
ctaaaattgtctncgtaaatnctntnnnntgtacantaggaacggcnctgacatatgagacncttaaacatcnganatagggngtctngggggggcgcttgcntanccntgnanntgactnacgnnccanttgaantaannctttaanganattanggcnttttncgcgcntctcnctcaanctcnntattncantntaacanngngggngcntcntntcancatcnancncttnctacttcctttatnncttctnctcncttcnnactacttntactntnncntncaccnnaccancattnnantntncancctccntcntancnttcnctnnncncatccnttnnccncntcantcctctaacncnctannnctcctntntnccanattcatnccnttnnttnanccttntcntccttntctatcattctacnctatcctctcctaacnctttttnntcnnctcacnntcntcntacactcnnccancnacnnaaccaccntanncctctnncnttcctctntantacntntcnatcttccnnncanntnattctnacntantntntcattnacacnctcnncctanntatnntnttatctctancccctcantanatntcntccatnctcaactntctcacctctccctctanatccncctnttntagnnactcctctgttnnctgctantattncntatacntctccnntcntactntnttttatatntacanctcntcnnnctnncctcncntnnacncntnaataccctcatcttatatntnntntncnnctnntatcntnatcttanancctacantnttcntcataatcnnannncactctntanntgcacatntanactncccnncncanctctttatacctntnctatacntcacnntctntnantnactcnatnactnncatacactcanatncacctnntnnnatntcnccatatatntntantanctcntctctcnatattatatatntntctntctntncctnctcngnnctctnctntatcanactctctatncncaccaactatnnttcnanntncnnnctttcacnnnntnaccantcnttcnnancnctatcntctctcctatccacttnnatcntaactctctcatatacncnantcatntcnnntncnacnctcntntntctcncancctcttnnctactacnnttatctactcactctatntctctnnnctctacantctcnctntcgtntccacnttatctnnnnncactatctctntcactctnancntaaacctcctccttntncatntcacntctctatnccatttctcaatancactcncncacncattcctctntcncatctatctcttncccanctcntctntctcannnantngttnctctatcagnactcctatatantntatctcnatncttnatatcacanncatnnncttctcnnactcatatnntnctntantntactatcttnttcct

SEQ ID NO: 5568 - DNA, 1309 bp, Homo sapiens
  misc_feature 3, 7, 10, 12, 23, 32, 33, 37, 38, 42, 44, 65, 68, 69, 70,84, 96, 97, 98, 116, 117, 126, 127, 128, 132, 146, 147,148, 152, 159, 161, 163, 172, 174, 181, 184, 187, 188, 196,198, 203, 211, 212, 214, 215, 217, 220, 227, 230, 231, 232: n = A,T,C or G
  misc_feature 233, 234, 238, 243, 256, 258, 259, 260, 268, 277, 279, 284,292, 294, 298, 301, 303, 304, 306, 309, 310, 320, 328, 332,335, 337, 346, 348, 349, 353, 355, 358, 363, 365, 370, 372,383, 384, 391, 393, 402, 406, 407, 411, 414, 416, 418: n = A,T,C or G
  misc_feature 419, 423, 426, 428, 431, 433, 438, 441, 443, 453, 455, 458,461, 469, 472, 483, 484, 485, 486, 487, 490, 491, 492, 495,499, 502, 503, 508, 509, 511, 513, 514, 516, 517, 519, 521,523, 527, 531, 533, 536, 538, 539, 541, 544, 545, 546: n = A,T,C or G
  misc_feature 548, 552, 553, 557, 558, 565, 568, 571, 577, 581, 592, 594,597, 600, 603, 606, 609, 612, 613, 615, 619, 620, 625, 628,632, 634, 635, 637, 640, 646, 650, 651, 652, 653, 656, 657,659, 664, 666, 670, 677, 680, 681, 684, 686, 687, 688: n = A,T,C or G
  misc_feature 693, 696, 702, 703, 704, 709, 714, 715, 718, 729, 730, 731,733, 739, 742, 751, 752, 754, 755, 756, 762, 764, 773, 779,782, 784, 785, 788, 790, 791, 795, 802, 803, 815, 824, 826,827, 828, 829, 835, 836, 839, 844, 850, 852, 855, 861: n = A,T,C or G
  misc_feature 862, 863, 865, 866, 870, 887, 897, 899, 913, 925, 926, 927,933, 954, 955, 956, 957, 974, 981, 985, 989, 992, 993, 997,998, 1006, 1008, 1017, 1018, 1022, 1023, 1029, 1032, 1033,1036, 1038, 1052, 1059, 1071, 1074, 1077, 1081, 1086: n = A,T,C or G
cantggnaantntcccgacctangactaggtnnaccnnccangnggggaaaaaagccccccaganagnnngaggtttggagggngggaaaaaagannnccggggggaggggggggnnttggaaaannngganacgggggggcacgnnngcgngcgcacncntntttttttcncnccccgcnccnttnntttccccncnccgcncggagtgnncnngnagnggggggnggnnnnnaganaaganggggggggggaanannngttggggnggggggggncnagagngggggggncnggcnganannangcnngggggggggngagcagangganggngncaagggggngnngggngnggngaggnanagcangngagggggaggnngaagagngnggagagggnaggnnaggnggngngnngggnagnancgngngaggnagnanaggggaaggngnagnggngggggggngangagggggacgnnnnnggnnngcngagnagnnggggnngngnnanncnangncggnggangnaangnnanggnnngnggcnngcgnnaagaggnganaangggagngcgngggggggcggngngancgnggnagnagnganngnggcnngaganggngagngnngnggngcgaangggnnnnggnngnggggngngggncgagagnggnnggngnnnggcangtnaaaggnnnagggnagaannggnacacggaccgnnngnggagancgnggacgaaanngnnnagacgngnggacgaganacgcgnggnanngangnngggntggggannagaggagcgcgngagaacgcncnnnnggagannganggagngagagngnggnacgggnnnanngcgngcaagagagagacgagngacgcggagngngagagagagagacngaggagagagannnaagacngacggagagcacggcggaggnnnncgcgacgacagagaggnaggacgnaganaggnganncganngagagggncncaccggaannacgnngagacnacnnagngngcgaggaacacggngcgcganaggaggagaacncgnganggangacgncgngnancggnngacacgnangcgngagagannnagagagggacgcacgaagnncggaagagcngangggaagannannancgagnnngagaancggagngagcanaagggaggangggtcagangagaganagcacaancgngagaggnngannnaggacgacggnggagagagaancangngggnagaagnncngancaggaagggcgngggnaggngcgc

SEQ ID NO: 5569 - DNA, 1359 bp, Homo sapiens
  misc_feature 19, 20, 26, 27, 29, 35, 46, 47, 50, 51, 56, 60, 61, 69, 75,76, 77, 78, 80, 86, 87, 89, 93, 96, 97, 101, 102, 128, 144,148, 158, 159, 160, 161, 162, 163, 164, 165, 166, 167, 168,169, 170, 171, 172, 173, 174, 175, 176, 177, 178, 182: n = A,T,C or G
  misc_feature 183, 184, 185, 186, 187, 188, 190, 191, 193, 194, 195, 196,197, 198, 199, 200, 201, 202, 203, 204, 205, 206, 208, 210,211, 212, 213, 214, 215, 216, 217, 218, 219, 220, 221, 222,223, 224, 225, 226, 227, 228, 229, 230, 231, 233, 234: n = A,T,C or G
  misc_feature 236, 237, 238, 239, 240, 241, 242, 243, 245, 246, 247, 248,249, 250, 251, 252, 253, 254, 255, 256, 257, 258, 259, 260,261, 262, 263, 264, 265, 266, 267, 268, 269, 270, 272, 273,274, 275, 276, 277, 278, 280, 281, 282, 283, 284, 285: n = A,T,C or G
  misc_feature 286, 287, 288, 289, 290, 291, 292, 293, 294, 295, 296, 297,298, 299, 300, 301, 302, 303, 304, 305, 306, 307, 308, 309,310, 312, 313, 314, 315, 316, 317, 318, 319, 320, 321, 322,323, 324, 325, 326, 327, 329, 330, 331, 332, 334, 335: n = A,T,C or G
  misc_feature 336, 337, 339, 340, 341, 342, 343, 344, 345, 346, 347, 348,349, 350, 351, 352, 353, 354, 355, 356, 357, 358, 359, 360,361, 362, 366, 367, 368, 369, 370, 371, 373, 375, 376, 377,378, 379, 380, 381, 382, 383, 384, 385, 386, 387, 388: n = A,T,C or G
  misc_feature 390, 391, 392, 393, 395, 396, 398, 399, 400, 402, 404, 405,406, 409, 410, 413, 414, 415, 416, 417, 418, 419, 420, 421,425, 426, 427, 428, 429, 430, 431, 432, 433, 435, 436, 437,438, 439, 441, 445, 446, 447, 448, 449, 454, 456, 457: n = A,T,C or G
aaaaaaaaaaaaacccccnngggggnnancccctnctaaaaaaatnnagnnacctnctgnnaagggcgnaaaacnnnncnccctcnnancaanatnncagnnccccccctaaaaaccatccagggaanaattaaagggggcgtncctntggggggggnnnnnnnnnnnnnnnnnnnnncccnnnnnnncnnannnnnnnnnnnnnncncnnnnnnnnnnnnnnnnnnnnnncnncnnnnnnnncnnnnnnnnnnnnnnnnnnnnnnnnnncnnnnnnncnnnnnnnnnnnnnnnnnnnnnnnnnnnnnnncnnnnnnnnnnnnnnnncnnnncnnnncnnnnnnnnnnnnnnnnnnnnnnnncccnnnnnncncnnnnnnnnnnnnnncnnnncnncnnncncnnnccnnccnnnnnnnnncccnnnnnnnnncnnnnncncccnnnnnccccncnnnccnncncnnnccnccccncccancnnnncnccncnnnnnacnnnccnncnccnaccnnnnnnnccccnncnnncnccnccncnncncnncnccnnaancnnnccnncncnncncnncncnnccnnncccnncccncnnccncncnnanncncnnnnnnccnnccnnccnnnnncnannannncnncnnnnnnnnancccccnacnccncnnnccnccccnnncnnnncccncncncnncnnncananccnnnncncncncnnnnncnccncncnncnnncncncnnnancnnnnccnncncnccnnnncncnnaccnnncncnccnncnacncnnanccncncncnccncnncnnnccccnnnncnccccnnnnnncccncnnccnnnnnnnnacnnnnnnccnnnccncnnnncnnncnnncccnnncccncnnccnnccnnnnnncnnnnncncnncnncnnanncnnnnnnnncncnncnncncnncnncnnnnannccncnncncnnnnnnnnnnnnnnncnnncnnnccnncnnannnnnncncnnnnccnnncnccnnncnncncnnncacnccnncnnnnnnnanncnccnnnncnccncncnnnncnnnccnnnnnnnnnnnnccncnnnanccnnnncnnnnncnccccncncncnnnncncnccccnnnnnncnnnnncncacnccncccccncnnccnnnnccanncacacnccncnccncccncncnnnnncncncnccncccncnccncnnnncncnncccnncnccanannnncnnncncccnnncccnccncannncnncancacncnnncncncncnncnncccncnnnanccnccncnaccncccnnnncccccnaccnnnnnccnncnncncnccnccancct

SEQ ID NO: 5570 - DNA, 10 bp, Homo sapiens
  misc_feature 1, 2, 3, 4, 5, 6, 7, 8, 9, 10: n = A,T,C or G
nnnnnnnnnn

SEQ ID NO: 5571 - DNA, 789 bp, Homo sapiens
  misc_feature 1, 2, 8, 10, 14, 15, 16, 19, 22, 31, 36, 38, 40, 41, 43,45, 48, 49, 69, 73, 74, 78, 130, 133, 139, 146, 147, 148,152, 155, 173, 180, 185, 186, 188, 205, 230, 296, 303, 305,330, 334, 340, 356, 357, 358, 366, 375, 380, 390, 403, 418: n = A,T,C or G
  misc_feature 428, 433, 445, 487, 507, 542, 548, 557, 561, 574, 607, 623,629, 646, 663, 673, 679, 684, 686, 687, 692, 720, 762: n = A,T,C or G
nngctctncnattnnntgnggncttgctcgntaccncnanncngnggnnaatcgattgggcccgaggtngatnnatgnatactactcctgcgcgtcagttctcactttttggggccctgccggctggatnacngtacancctaaannngganctnctacctggccctctacangcagatnatcanncnggacaagctaggctgcncgcgcacggcgctggagtactgcangctcattctgagtctcgagccggatgaggaccccctctgcatgctgctgctcatacgaccacctgnccttgcngncccggaactactagtacctgatccncctnttccanaagtgggaggctcatnnnaacctgtnccagctccntaatngtgccttctntgttccactggcntatttcctgctgagncaccagacanacctncctgagtgtgancagagctatgccaggcagaaggcctctctcctgatacagcangcgctcaccatgttccctgnagtccttctgcccctgctcgagtcttgcaagtgtncggccngacgccagngttnacagtcaccgctnctttgggacccaatgctgaaattaagccaaacncctgcccttgacccanatggtnaaccttgtacctttggnaaggtcacacttttttnttggaaaaanaacccnggcancnnttgancttggctggaaggaaaaacgtccccgangatcttcaaagcaaatggatgccggggaacccaaaccctggnaagcctggggagaaacccgggggaaag

SEQ ID NO: 5572 - DNA, 789 bp, Homo sapiens; identical to SEQ ID NO: 5571
  misc_feature 1, 2, 8, 10, 14, 15, 16, 19, 22, 31, 36, 38, 40, 41, 43,45, 48, 49, 69, 73, 74, 78, 130, 133, 139, 146, 147, 148,152, 155, 173, 180, 185, 186, 188, 205, 230, 296, 303, 305,330, 334, 340, 356, 357, 358, 366, 375, 380, 390, 403, 418: n = A,T,C or G
  misc_feature 428, 433, 445, 487, 507, 542, 548, 557, 561, 574, 607, 623,629, 646, 663, 673, 679, 684, 686, 687, 692, 720, 762: n = A,T,C or G

SEQ ID NO: 5573 - DNA, 1064 bp, Homo sapiens
  misc_feature 2, 10, 11, 13, 14, 23, 32, 34, 40, 109, 133, 134, 148, 211,219, 250, 254, 269, 273, 277, 284, 285, 287, 291, 293, 308,311, 312, 316, 317, 323, 324, 329, 331, 333, 346, 348, 352,353, 354, 355, 356, 357, 359, 360, 368, 369, 375, 382: n = A,T,C or G
  misc_feature 384, 385, 386, 387, 390, 391, 392, 393, 394, 395, 399, 400,401, 403, 407, 410, 413, 417, 419, 427, 435, 436, 437, 441,442, 444, 445, 446, 447, 452, 453, 454, 460, 462, 469, 474,483, 488, 499, 501, 511, 512, 514, 516, 520, 533, 535: n = A,T,C or G
  misc_feature 541, 542, 543, 544, 547, 548, 550, 553, 559, 561, 565, 571,572, 575, 582, 590, 597, 604, 605, 607, 609, 610, 614, 617,619, 621, 625, 626, 628, 636, 639, 651, 659, 663, 669, 671,688, 706, 707, 721, 727, 730, 734, 740, 751, 755, 758: n = A,T,C or G
  misc_feature 764, 767, 771, 781, 782, 787, 797, 804, 805, 806, 811, 815,823, 827, 828, 830, 832, 837, 841, 844, 848, 849, 853, 855,858, 865, 871, 872, 876, 878, 882, 884, 888, 892, 899, 903,911, 913, 927, 928, 929, 931, 936, 939, 941, 943, 945: n = A,T,C or G
  misc_feature 947, 954, 960, 963, 967, 970, 971, 972, 973, 990, 1003, 1004,1007, 1012, 1013, 1016, 1017, 1024, 1027, 1029, 1038, 1039,1051, 1054, 1056, 1062, 1063: n = A,T,C or G
cnttactaanngnntgctatcgntctttccgnangagccnagcgattcgagtggctgagtggaggcgcccagacctgggcaggcagcaggctcaggcccacacctttgngatttttgaaaccaaagcccagannatgatgtttacttntctctccctggctctgcccttcttactgcaaaccatgctgtgccttagggcccttctcatagntgttcctnatggccatgactggaacagggatgcaacctntttntacacaagcacagantagnttgngtgaagnntntttntnactccgtttacaccngtnnttcnnttctanntgccnanancttcatccaatcngntcannnnnntnnctcactcnnacccanccatccnannnntcnnnnnnaacnnnanttcnctnctntacntnccctaacncatcaatnnntttnntnnnnattannntctctnantatattnactcnatatcctcncactntttcatactcncnattactcttnncncntacnctcatcacatacncnttaatnnnnccnntnctntatacnancatnttcttnncantctacancgactatnatagtcntctatcnncntnnaagnctntntnaatnntntctctganacncctcttacgtgntcttactntacntcaatntngctcatcatcactctcnaacggtatacttcatttnngtgtatatatcccncatctnctntcancactcntctctctactntatntcncacttncgncacncacgatatannatctnctacactcanaatcacnnnttatnatcnttttatanctcnnantntaacngtcnttntctnnatcntnctntttcganatctcnncacntntctntntatncttnttcttcntctntaatatcnantcatcttagtctcnnnanccaanatntnancntncactctntctacnttntctnctnnnnacacttctactatctcnaatatatatcttnntancatannacnncacctanatnantcctctaanntaacttcatctnctntntactannt

SEQ ID NO: 5574 - DNA, 915 bp, Homo sapiens
  misc_feature 3, 4, 6, 8, 10, 13, 16, 23, 27, 28, 29, 30, 35, 37, 39, 41,43, 44, 45, 46, 48, 54, 55, 57, 63, 64, 65, 66, 68, 72,73, 74, 75, 76, 87, 110, 115, 118, 119, 123, 127, 131, 135,140, 154, 155, 157, 158, 161, 162, 174, 177, 178, 196: n = A,T,C or G
  misc_feature 207, 214, 245, 257, 282, 295, 322, 329, 333, 344, 348, 356,368, 380, 382, 385, 386, 401, 407, 415, 418, 423, 426, 434,441, 456, 457, 458, 459, 460, 470, 480, 482, 507, 509, 518,521, 531, 532, 537, 539, 542, 552, 553, 554, 556, 557: n = A,T,C or G
  misc_feature 559, 560, 569, 575, 576, 578, 579, 583, 589, 594, 596, 597,600, 601, 604, 607, 610, 613, 615, 619, 620, 628, 632, 648,650, 651, 654, 661, 663, 670, 674, 676, 677, 680, 683, 692,694, 712, 717, 722, 724, 729, 731, 732, 733, 735, 737: n = A,T,C or G
  misc_feature 739, 741, 755, 760, 761, 762, 766, 769, 775, 780, 782, 786,787, 794, 799, 804, 807, 812, 816, 827, 837, 838, 844, 847,856, 861, 864, 870, 873, 876, 881, 885, 888, 889, 893, 896,897, 900, 903, 908, 911, 913, 915: n = A,T,C or G
atnnanancntanaanctaaacnattnnnntatantnancntnnnncncttttnncnatactnnnntntccnnnnnttttttaagcnttctaaatgcttggcaatcgccncctantannggcntggngatncgcnccagnacctgctatagttnngnnacnnaccacacccttncannaaatcttaacaagggggnggggataaaanaaaaacntccacaattaccttaaaagggactcttatgntttcaactacanatagttgtaaaggatcatacacaanatattgatgatanttgaaatattcttagaaggggtgtgtntgtctanctgngtctaccatgngtantgtattcntgacaagcactntaaaatacctgntnatnnttctatacattacgnataatngccataanganttaanctncatatatntcatcanccctaattgaatcannnnnaaatattttnattgcccatnanatctaatttcacttatactatcccnanaatagtaanacnactacagctnnttacncnatntaaacctttnnnanntnncacaatatnatacgnnannccanttatcnattangnnttnnaanaancanaantncaannatttcctnatcnaaatcacaattttctncnnaancaaatantncattccnaccncnnatnccncagaaaatntncacctcctatcaatatancaatntattnanaccangnnncncnantncaatgttttctcancattnnncttntantctatntactncnttcnnttaacanatatnttcanaantccanattncatttcacttntactacaccnnaacaanacntcaaaatanaagtncanatacanccnaantcccncatntannactntannacncantattnccntncn

SEQ ID NO: 5575 - DNA, 1479 bp, Homo sapiens
  misc_feature 14, 18, 21, 29, 30, 31, 33, 36, 42, 44, 58, 62, 64, 81, 98,104, 107, 108, 125, 129, 131, 132, 133, 137, 139, 148, 152,159, 162, 168, 173, 174, 175, 185, 186, 188, 189, 190, 194,195, 198, 199, 200, 209, 210, 221, 226, 231, 232, 235: n = A,T,C or G
  misc_feature 236, 238, 241, 250, 260, 277, 288, 292, 294, 298, 302, 310,315, 319, 331, 335, 342, 344, 349, 350, 362, 364, 365, 368,372, 373, 374, 384, 385, 387, 391, 398, 403, 404, 417, 436,439, 440, 442, 443, 447, 449, 450, 451, 452, 454, 466: n = A,T,C or G
  misc_feature 467, 473, 476, 481, 482, 484, 486, 489, 492, 496, 500, 501,504, 510, 515, 517, 518, 527, 532, 542, 544, 548, 554, 558,560, 561, 562, 565, 566, 574, 575, 581, 585, 590, 600, 603,604, 605, 606, 607, 608, 613, 617, 619, 620, 621, 622: n = A,T,C or G
  misc_feature 625, 640, 641, 644, 647, 648, 649, 652, 653, 658, 659, 660,666, 669, 674, 676, 683, 686, 688, 692, 693, 694, 698, 701,703, 707, 708, 712, 721, 724, 729, 731, 735, 736, 743, 746,751, 754, 755, 756, 757, 762, 763, 765, 766, 767, 768: n = A,T,C or G
  misc_feature 769, 771, 777, 780, 786, 802, 803, 808, 816, 820, 822, 823,829, 848, 853, 860, 861, 863, 876, 885, 886, 888, 890, 892,898, 902, 909, 914, 921, 931, 938, 940, 945, 946, 947, 951,955, 959, 967, 971, 972, 975, 976, 987, 988, 999, 1002: n = A,T,C or G
  misc_feature 1003, 1017, 1018, 1021, 1022, 1028, 1032, 1033, 1040, 1045,1053, 1064, 1067, 1068, 1072, 1073, 1074, 1082, 1086, 1089,1091, 1094, 1105, 1106, 1107, 1109, 1110, 1117, 1148, 1150,1159, 1171, 1173, 1177, 1180, 1198, 1208, 1213, 1223: n = A,T,C or G
agcctcttaaactncaanttntaacttcnnnangcnaaacgncnctctatatatcgcngtancnccttaaaacatcatganattatgggggtcttttngggggngcnnactaccatctatcatcnctcncnnntacnangaccccttntacnactactntcnctcttnatgannngctccgtctnncnnnctcnntannnttatctacnnctctcttctcncctcntcatnnctnncnaancattcctcncctcatatcnactccctctcaattcanccatctatatntctnanatcntcancattacgntattntacnacacactctcgnaacncgctctntnagatnntctctcactacncnntancatnnntcatcatcanncnatantcttcanacagnncccttcctctccngcatctccttcctctcatnctnncnnattnannnncntcctactcactnntccctntcncaccnnancntanccncccntatnntcncccccntgccntnntactccctnccccnttcatccccntntccnactttntcancnnnctnnccttactnnatctcntctntatcnccccattatnctnnnnnncctangacncnnnnctntcaattttccccatnnccnccnnnttnncgctnnnctttcngcntctcncnttacccnttntnctannnctcnttnanctcnncccnccctctttncantcgancnatcnncccctcnacnatctntannnncttcnncnnnnncntatcantcncctccncactcatccatctacnncaccncactctanactntnnccactncctccactctctcctctancctcnctctcanntnatccttctcctcntctcattannantnanctcccntttnaaatccntcacncatactnaccatcttcnccaactntntcttnnntccnattncatntcctcccntaanntanncaatctctctnnttcactcacanctnnacactccattctcnntannctctcnacanncactcancttcnactcatanactcacactanccnntttnnntcttacantccnacncntanatttctctccnnntnnatcacanaaccacatctatctactatcttatcactccntntctcacgtntctctctcaccntntatnctnaactctatatcactcaanccatactctnatcanatcttgctcncacctatatnctctctcncaccctactcnctcctacatgtcnacatcttccntcnctntataccacncanttactnactnncnccanactcngccntacnctactacactgcantctctatctcntcnctcgacacncncttctngcnccccactctcntcttntctcnnnctcnactctctctntcnantcnactctcccncacatctatatntattctctctcctatctccnctcccctcctactcanaccccg

SEQ ID NO: 5576 - DNA, 1764 bp, Homo sapiens
  misc_feature 2, 8, 27, 31, 32, 34, 46, 48, 49, 53, 54, 60, 61, 67, 74,82, 87, 102, 116, 124, 132, 135, 138, 139, 142, 147, 152,158, 166, 169, 173, 176, 191, 194, 196, 199, 205, 208, 210,211, 214, 215, 223, 225, 227, 234, 235, 236, 239, 241: n = A,T,C or G
  misc_feature 243, 244, 260, 262, 263, 276, 277, 278, 280, 282, 284, 292,294, 296, 297, 298, 300, 302, 304, 310, 318, 320, 326, 332,339, 340, 341, 348, 349, 352, 361, 364, 372, 376, 388, 391,392, 397, 398, 407, 411, 412, 416, 420, 423, 432, 433: n = A,T,C or G
  misc_feature 437, 438, 439, 442, 456, 457, 468, 475, 491, 496, 501, 508,514, 518, 523, 526, 528, 534, 541, 545, 547, 550, 552, 561,571, 581, 588, 590, 592, 595, 596, 597, 598, 602, 603, 614,617, 620, 623, 631, 632, 658, 671, 674, 678, 680, 682: n = A,T,C or G
  misc_feature 690, 691, 695, 700, 705, 710, 711, 717, 718, 720, 721, 725,732, 733, 737, 739, 743, 747, 748, 753, 760, 763, 773, 782,789, 797, 799, 801, 814, 826, 829, 836, 841, 852, 854, 864,866, 870, 874, 878, 882, 883, 885, 890, 892, 898, 901: n = A,T,C or G
  misc_feature 903, 908, 909, 917, 932, 938, 939, 940, 956, 964, 965, 972,975, 977, 978, 982, 985, 993, 999, 1003, 1005, 1011, 1012,1022, 1024, 1025, 1027, 1030, 1035, 1037, 1039, 1058, 1059,1061, 1062, 1063, 1074, 1075, 1082, 1084, 1086, 1094: n = A,T,C or G
  misc_feature 1097, 1098, 1100, 1119, 1120, 1125, 1127, 1130, 1131, 1136,1146, 1147, 1151, 1154, 1181, 1187, 1209, 1219, 1221, 1227,1237, 1245, 1256, 1260, 1262, 1266, 1269, 1272, 1275, 1279,1287, 1291, 1292, 1294, 1296, 1299, 1312, 1317, 1336: n = A,T,C or G
cnaccctncaaaaaattcatataccanacanntnaggcctcttggnannggcnnccttcnnaacatnaattgcnagtacccnccttnaaaaaaccatcatgnaaaataatgggggngtcttttngggggggnggnacnnaantcaantcaancccatnaaaccacnaanttcncgnaccccttaaaccgtnaananatncactancanannatnncctaagtnancnttcctgnnnctncncnnacaacctaccctctantnntcccctcctattnnntncntnctcccacnancnnncncncntcctcncctacatntnttccanataacncctcacnnnccctacnnccnccacatctntanaaccccancacncctccccacctncanncatcnnacctactcnactnnacantccnccncctttctcnnctcnnntanttcactacctcttnnactaccccaanatctacntccccctctctccacncacanttacnctctcancaactnccanccatnccncnccatanacacctnaccncnccntnttctccccntaaccaaatnacctccctcnattcatnantnatnnnnaccnnctatcccaccncantanacntcccaccnnactaactccaccacctcccactactntctctcctaatcnacnctancncntccaccanntcantcctnctcantctcnnacaccnntnntacnatccatnnctcnanaccntctnntccanacccctnctntcaatcactnctacatatncccatcnctatatantntnctctctcatctcnatccaatcctcnccncatacanctctntacatctctcncnctcatcactnantctnctcnctcnactnntntcacncnacactnacntntcacnnactatccnacaccatacattctnctccannnctaatcaccacatctntaactacnnccacacncancnncacnacncccatacnctcctncacncnctcatnnaccaactccncnncntancatcncncnacactacacaaccatcaannannntcctctcatannacacctntntntcaccacntcnntntcactacactcactataannctctntncanntctancatacctctnnactntcnaccactctccctcactcactctccacnatcacntctctcacactcatatcatccnctactctacncnttaacnctcttatcancatacatntcatcacttcnaacncntctntcncancanctancatactcncctnntncntcncactctctatccntacanctcaatccaattcccactncnctcatncatntcncctcacnanctcacctcattntactcactataanncctcacctcacccnacactccccttantcccnnctctcctactcacactctcactcactctcncctcnacatcctcancnnttcncanctcacnctatcnncnatatatntcnctaatcatcncctntcacanactnctntcacactacacncaccctnctcanctnctnntntccctctctactcttctntccancacatctctctcactanacacncatntccntccatcanancanatcananacncctatacacnntncatactctntntatcaatatcccctntcaaactcnctcttcttannactacnctatcactntcnctctcaactnctactatatctcactcantctcnnacnctacantntcnncnt

SEQ ID NO: 5577 - DNA, 953 bp, Homo sapiens; identical to SEQ ID NO: 5562
  misc_feature 1, 5, 11, 19, 20, 32, 33, 34, 36, 40, 58, 63, 72, 75, 79,87, 104, 107, 116, 118, 120, 131, 134, 135, 142, 150, 156,157, 207, 211, 212, 217, 225, 246, 247, 260, 272, 277, 279,282, 288, 290, 299, 306, 309, 310, 313, 321, 324, 332: n = A,T,C or G
  misc_feature 337, 349, 352, 355, 379, 392, 401, 404, 413, 422, 428, 432,435, 448, 449, 467, 471, 483, 489, 490, 496, 499, 501, 505,510, 515, 522, 528, 534, 535, 536, 546, 550, 552, 554, 556,568, 574, 578, 586, 588, 599, 603, 604, 608, 615, 626: n = A,T,C or G
  misc_feature 633, 636, 646, 647, 652, 656, 667, 668, 673, 679, 682, 689,691, 693, 694, 699, 700, 704, 706, 711, 717, 721, 724, 727,729, 732, 734, 744, 746, 750, 751, 754, 759, 760, 769, 770,773, 780, 782, 791, 792, 793, 795, 802, 805, 819, 821: n = A,T,C or G
  misc_feature 828, 832, 833, 834, 837, 842, 845, 850, 851, 860, 870, 873,876, 889, 891, 894, 898, 901, 902, 913, 916, 918, 919, 923,929, 930, 931, 932, 937, 940, 941, 947, 948: n = A,T,C or G

SEQ ID NO: 5578 - DNA, 1046 bp, Homo sapiens
  misc_feature 4, 7, 11, 21, 28, 41, 42, 43, 45, 48, 53, 59, 60, 63, 65,67, 70, 72, 73, 81, 82, 83, 85, 90, 92, 102, 111, 115, 116,128, 135, 140, 141, 162, 171, 184, 186, 188, 189, 194, 197,198, 200, 208, 211, 213, 221, 223, 233, 236, 244, 246: n = A,T,C or G
  misc_feature 265, 272, 276, 278, 280, 286, 289, 292, 296, 301, 303, 311,314, 317, 318, 319, 321, 323, 325, 326, 327, 328, 331, 332,333, 335, 336, 338, 341, 343, 351, 352, 355, 357, 359, 368,371, 381, 382, 392, 398, 399, 401, 404, 405, 408, 412: n = A,T,C or G
  misc_feature 414, 426, 440, 444, 448, 449, 454, 455, 464, 465, 468, 473,475, 478, 479, 480, 481, 483, 484, 487, 491, 494, 496, 497,502, 510, 511, 512, 514, 515, 516, 520, 524, 527, 528, 529,530, 533, 534, 535, 536, 542, 543, 553, 561, 564, 565: n = A,T,C or G
  misc_feature 570, 575, 577, 578, 581, 585, 586, 590, 593, 598, 600, 602,614, 623, 624, 638, 640, 641, 653, 662, 663, 670, 672, 675,678, 681, 683, 686, 687, 688, 689, 700, 711, 715, 718, 734,735, 736, 737, 743, 744, 749, 761, 763, 771, 772, 780: n = A,T,C or G
  misc_feature 781, 782, 794, 796, 802, 803, 806, 811, 814, 821, 822, 824,829, 833, 834, 839, 840, 843, 846, 851, 852, 858, 865, 867,868, 869, 872, 873, 874, 880, 883, 888, 892, 896, 901, 903,907, 909, 910, 913, 915, 921, 922, 923, 932, 936, 938: n = A,T,C or G
  misc_feature 940, 942, 943, 945, 948, 951, 952, 955, 958, 960, 971, 976,980, 982, 983, 985, 990, 996, 1001, 1004, 1006, 1009, 1017,1020, 1021, 1023, 1027, 1032, 1035, 1037, 1038, 1044: n = A,T,C or G
gtanctnattnttttgatggnctaaatngccctaaataggnnngngtnggggncatacnncancnangtncnnaaatactnnngntacananctatggtcancaacatctnactnnaaacccttatgntaaaaanaaacnncttgccttcagccttcaagcnattatatcngctctcatccctncngnntacgncgnnantatatgtnccntnccaccacnanccagttaatnctnaagtatcnanatactaccagcatgggtantcacaanctgntncnccagcnatnctnaatntctcngngacctccnganccnnncncntnnnnctnnnanngngcngncattacannccntnanccactgttnccngacctcaacnntcttaccaanaatgtnntnccnntgnatgnanttttacatggcnataacactattgcntttncaanntcccnnacctcttcnntanccaananttnnnntnnctngtcncananntgtcncctcattnnnannnctcntgtnacnnnntcnnnntactanntagcactatnattatacngtnnatctntacanannctncatnnctanatnttacncnanattccctctttngctcacttnncatatacttctcancnnactctcgccgangtctctcgnnatatctnantanctnatntntgnnnnagcatcatatntgctactctanaaantcnatgagtaggaatactnnnncttcannctcanaaacactctatntncacatctnncacacacnnntagtgcatatanantcctcnngangatcnaantctcctnnanctcgnctcnntcgtnnctncanacgcnntcactngattctntnnntannnacaaanacnatacngcanaatnacatncnatanannctntntcacgnnncatcgtatntctnantntnntncgncannctnctncntgctacacatntatancatntnntnatcantctatncagancantnttncatcaaanacnntncctncagcngtnanncacctnct

SEQ ID NO: 5579 - DNA, 1337 bp, Homo sapiens
  misc_feature 4, 5, 15, 16, 19, 27, 38, 59, 60, 65, 69, 78, 79, 84, 85,86, 87, 96, 97, 99, 102, 103, 106, 107, 108, 109, 111, 112,120, 144, 155, 157, 158, 161, 168, 169, 172, 173, 174, 175,176, 177, 178, 179, 180, 181, 182, 183, 184, 185, 186: n = A,T,C or G
  misc_feature 187, 188, 191, 192, 193, 194, 195, 196, 197, 199, 200, 201,202, 203, 204, 205, 206, 207, 209, 210, 211, 212, 213, 214,215, 217, 218, 220, 221, 222, 223, 224, 225, 226, 228, 230,231, 232, 233, 234, 235, 236, 237, 238, 242, 244, 245: n = A,T,C or G
  misc_feature 247, 248, 249, 250, 251, 252, 254, 255, 256, 257, 258, 259,260, 261, 262, 263, 264, 265, 266, 267, 268, 269, 270, 272,273, 274, 275, 276, 277, 278, 279, 280, 281, 282, 283, 284,285, 286, 287, 288, 289, 290, 291, 292, 294, 295, 296: n = A,T,C or G
  misc_feature 297, 298, 299, 300, 301, 302, 303, 304, 305, 306, 307, 308,309, 310, 311, 312, 313, 314, 315, 316, 317, 318, 319, 320,321, 323, 324, 325, 327, 328, 330, 331, 332, 334, 335, 336,337, 338, 339, 340, 341, 342, 343, 345, 347, 348, 353: n = A,T,C or G
  misc_feature 355, 357, 358, 359, 360, 361, 362, 363, 365, 366, 367, 368,369, 371, 372, 374, 375, 376, 377, 379, 383, 384, 385, 386,389, 391, 392, 393, 394, 395, 396, 398, 400, 401, 402, 403,404, 405, 406, 407, 408, 415, 417, 420, 421, 423, 428: n = A,T,C or G
  misc_feature 429, 430, 432, 436, 437, 438, 439, 440, 441, 444, 450, 452,453, 454, 455, 456, 458, 459, 460, 461, 470, 471, 472, 473,474, 475, 476, 477, 479, 480, 485, 486, 489, 491, 497, 502,504, 521, 525, 526, 531, 532, 536, 541, 543, 545, 547: n = A,T,C or G
cccnnaaaaaaattnnaanccccccgncgttaaaaaanccctcttaaaaaaaatttggnngcctnctgnaggggggcnnaaacnnnncccccctcnnancannatnnnngnncccccccnctaaaaaccatccagggaacaatnatgggggcctncnnttnggggggnnccnnnnnnnnnnnnnnnnnccnnnnnnncnnnnnnnnncnnnnnnncnncnnnnnnncncnnnnnnnnncccncnncnnnnnncnnnnnnnnnnnnnnnnncnnnnnnnnnnnnnnnnnnnnncnnnnnnnnnnnnnnnnnnnnnnnnnnnncnnncnncnnncnnnnnnnnnncncnnccccncncnnnnnnncnnnnncnncnnnncncccnnnnccncnnnnnncncnnnnnnnnnccccccncnccnncnccccnnncncccnnnnnnccncccccncnnnnncnnnnccccccccnnnnnnnncnnccccnnccncncccccnccccncnccccccccccccccccncccnnccccnncccnccccncncncncccccnnncccnnccccnccnnnnccccccnccncccccccnnccncncnccccccnccccccccncnnnccccccnccncncccccccccccccnnnnccccccccccccccccccccnncnccnccccccccnnccnncncccncccccccccnccccccnccnccncnnccccccnccccccnncccnnnccccncccccnncccnccnncncccnnccnccnnccnnccnccncncnnnnnnnccccnccncnnnncnncnccccncncnccnccnnnncncnccnccccnccnnnnnncncncccnnncncnccnnnccncnnccnccnnccnnnccccnnncnncnncnnnccccnccnncnccnnncncnnnccnncncnnnnncnncncnnccnnnnnncnccnnnncncncnnnncncnnnncnnnnccnnncncnncnccnncnncncncnnnnnccnnnnncnncnncnnnnnnnnnccccncnnccnnccnccnccncnnnnnnctcncccncnncncncnnncnnccnncnncnnncnnnncncncncncncncccccnnccnncnncnncnccnnnnnncncnccncnnnnnncnncnnnnncnnnncnccnncncncncncncnnncncnnncnnnccncnncncncnccncncnnnnnnncncccncncccncccncnnncnnncnnncncnccncnncncncncnnnnccncnnnncncccncnccnnnncnnncnccnnnccnccnccccncnccncncncnccnnnccccc

SEQ ID NO: 5580 - DNA, 1312 bp, Homo sapiens
  misc_feature 5, 19, 22, 26, 35, 36, 37, 38, 39, 40, 41, 42, 43, 71, 72,79, 84, 85, 86, 88, 94, 95, 97, 103, 116, 129, 134, 152,154, 155, 156, 157, 159, 161, 162, 164, 165, 167, 169, 170,173, 175, 176, 179, 181, 182, 186, 189, 192, 193, 194: n = A,T,C or G
  misc_feature 196, 198, 202, 203, 204, 205, 206, 207, 208, 209, 211, 212,214, 215, 216, 217, 218, 219, 220, 221, 222, 223, 225, 226,227, 230, 231, 234, 235, 237, 239, 240, 242, 244, 245, 246,247, 248, 249, 253, 254, 258, 259, 260, 268, 269, 271: n = A,T,C or G
  misc_feature 272, 276, 280, 282, 284, 287, 288, 289, 290, 291, 292, 293,295, 297, 302, 305, 306, 307, 308, 310, 311, 317, 318, 319,322, 324, 325, 326, 327, 329, 331, 333, 336, 338, 340, 348,349, 350, 351, 354, 355, 356, 357, 360, 364, 366, 371: n = A,T,C or G
  misc_feature 373, 375, 377, 383, 386, 389, 390, 400, 401, 403, 404, 413,417, 419, 420, 425, 427, 430, 431, 433, 434, 437, 440, 442,448, 455, 456, 457, 459, 460, 462, 464, 465, 467, 468, 471,474, 475, 477, 479, 485, 487, 488, 489, 490, 491, 492: n = A,T,C or G
  misc_feature 493, 496, 498, 500, 501, 502, 508, 509, 512, 513, 514, 515,517, 519, 520, 521, 522, 523, 526, 527, 528, 529, 530, 531,533, 535, 537, 538, 540, 542, 545, 548, 549, 551, 553, 556,557, 558, 560, 561, 566, 567, 568, 569, 570, 571, 577: n = A,T,C or G
  misc_feature 580, 581, 582, 585, 587, 588, 589, 590, 591, 593, 596, 598,599, 600, 601, 603, 605, 607, 609, 610, 611, 612, 614, 615,618, 619, 620, 621, 622, 623, 624, 625, 626, 628, 631, 632,633, 635, 636, 637, 639, 640, 643, 645, 646, 647, 648: n = A,T,C or G
ccctnaaaaaaaatttggnggncccncgggggggnnnnnnnnnccctttaaaaaaatatggaggcctctgnnggggagnaaacnnncnccctcnnancatatncaggacctcctcnaaaacatcagganaaaangggggtctgggggggggncnnnncnanncnncncnnacncnngcnanncctnaanccnnnananactnnnnnnnncnncnnnnnnnnnncnnncannccnncncnngncnnnnnnaccnncccnnncccaaccnncnncccncccncncnccnnnnnnncnancctcnccnnnncnncctccnnncancnnnncncncnacnancnccacccannnnacnnnnccncccncnccccncncncnccccancanccnnccccccaccnncnnccccccccnccancnncaccncnccnncnnccnccncncacccnccccacnnncnncncnncnnccnccnncncncccccncnnnnnnnccncncnnncctacnnccnnnncncnnnnnacnnnnnncnancnncncnacnaannancnacnnncnncccannnnnncaacanacnnnccncnnnnncnccncnnnncncnanannnncnnacnnnnnnnnncnccnnncnnncnnacncnnnnccncncnannnnncnnnnnnncnnanncncncncntncncnancnncnnncnncnnnnnnnncnnannnnncnacnnncncncnancnnnncnccncnnacacccancncanncannncntnnnnnnnncancnncncnccnnncnnnncnnnncnanccncncncncncncnnnnncnnnnncnnnnnnnncnnnnnccnnnnccnncannnnnnaccnnnncnnncnnnncnncanncnncnccncaanncacnncncnncncncnnnncncacacncnnannnnancnnanannnnncnnannncnannccnccnnnnncnncnacncnncncanncccncnannnccnnnnnncnnncacctncnnnnancncnncnnncnnncnnncnnnnnnncncacctcnccaacnnccnccncncaacnacnccctancnanncnncccnannncncccnccncncanncnantccnnntccncacncntcncacccnanccacncntcccncncannanacaccncccccnccncccnccnnancnncnnccnanaacccccnaccnacccctncaccccncccccnacnccctcanncccacancccnccnccncannccccnacanccccacnnntccnnccctccnancnccncccccncc

SEQ ID NO: 5581 - DNA, 715 bp, Homo sapiens
  misc_feature 3, 9, 12, 14, 15, 43, 62, 75, 76, 77, 81, 83, 88, 90, 92,94, 104, 115, 120, 123, 126, 139, 142, 145, 151, 165, 187,191, 192, 193, 195, 198, 221, 223, 228, 231, 238, 239, 243,247, 248, 249, 255, 260, 266, 270, 295, 326, 361, 378: n = A,T,C or G
  misc_feature 403, 406, 411, 425, 428, 435, 441, 453, 478, 480, 489, 490,493, 507, 508, 516, 526, 528, 546, 553, 554, 573, 576, 611,617, 640, 642, 647, 661, 670, 678, 700, 705: n = A,T,C or G
gtntttatnccngnnctcttgttctttttgcaggatccctcgnttcgaattcggcacgaggnactaggctcgcgnnntgtntnttttntntntntgatattacnccataggtttngggtnacnatnaatgtttgcattnctnttnaaagcntagctcttactaancattctttaacaaaagctaatnatcnnnanatnatttgccataccgaaactatctncncaaanaanactttannccantatnnnaagctnaaganttaganaaantacaaaacactgctatgagtcaatngaactgctatcattgaatttgctgcatttanaatgacataaacatactgaacatcaaaacaatggnatggatttattctatangactagccttaagaatgacatacanttngcganttcctttaaaaatnatnttttacnacagantccatttgaacnaagggtctttttttcccctcatttnangggaagacnntcnatgtttcccaaacnnatcctccnttcatactanantagcaaactgtggcctcnatctccnnttccagatgctacttatanatnacttttgcataataacttaaattagaattactttncttggnaacagtgtcacggccataaaatnantccanttttaaaaaaacanacttcaagngcaaattntagaaaacttcctttaaagaantaccnaacccagccc

SEQ ID NO: 5582 - DNA, 706 bp, Homo sapiens
  misc_feature 1, 668, 706: n = A,T,C or G
nctaatgctggctacttgttctttttgcaggatcccatcgattcgaattcggcacgagggccgctttccctctggaccacctcccgctgcgtttcctactcagagaaacagcaagggcggggtcaagacacgggatgacgggaagcaggaagcggggcagcagcacagcgtggggtcctggcactgcaggccaggccaggatgcccaccccgccctctacacggccccttggggcctgcgcccgtgaaactggtgccagggagcactgccagcttgccagtttctgcccagcaaaagcacgtatgcttcaggggccttctgagaccaccttccccactgagccccagctgctgagaaggccttgagggaagtagaggctgggagcaaatgccccatgcggtgagaggatgaggggagcctacgcctcaggcatgtggtgagaggatgagggggagggagcccacgcctcaggtggagtgggcagaggtgcaagagagggatgtactgaagcttcttcccgtcctgccacagacacttctcctgccttcccaccctgacccggcagaacccaccaagtgcctgtgtgcagcctcctgtgcctcacccagggcctgaccccagagtggtcccaacaacccggtctcatgcccactccccatccctgcttnccaaaaattgcactgtgtgcagtttgcaacaaagaatn

SEQ ID NO: 5583 - DNA, 706 bp, Homo sapiens; identical to SEQ ID NO: 5582
  misc_feature 1, 668, 706: n = A,T,C or G

SEQ ID NO: 5584 - DNA, 1446 bp, Homo sapiens
  misc_feature 5, 15, 23, 24, 27, 35, 40, 60, 67, 70, 73, 74, 78, 79, 84,106, 110, 117, 118, 127, 130, 133, 136, 138, 142, 147, 149,150, 151, 153, 154, 156, 157, 159, 160, 161, 162, 167, 180,181, 187, 189, 191, 199, 201, 205, 208, 213, 215, 216: n = A,T,C or G
  misc_feature 218, 232, 235, 240, 241, 248, 250, 251, 253, 255, 262, 264,281, 285, 286, 290, 300, 304, 317, 321, 325, 331, 341, 347,351, 358, 359, 368, 369, 370, 375, 378, 380, 381, 383, 385,387, 398, 399, 402, 403, 413, 414, 415, 416, 417, 418: n = A,T,C or G
  misc_feature 419, 423, 428, 432, 434, 436, 444, 447, 449, 458, 459, 472,475, 477, 479, 482, 485, 486, 487, 488, 489, 491, 494, 499,505, 508, 510, 512, 517, 519, 520, 524, 531, 532, 534, 535,536, 540, 545, 548, 550, 553, 559, 561, 567, 571, 581: n = A,T,C or G
  misc_feature 585, 593, 597, 605, 607, 616, 618, 623, 626, 629, 644, 647,649, 652, 654, 656, 657, 659, 665, 672, 679, 682, 688, 689,694, 700, 702, 704, 711, 715, 725, 732, 735, 737, 738, 746,747, 757, 761, 765, 770, 773, 782, 785, 788, 799, 801: n = A,T,C or G
  misc_feature 807, 809, 810, 816, 818, 821, 827, 845, 849, 854, 859, 863,864, 874, 875, 888, 894, 898, 907, 910, 912, 918, 921, 923,928, 932, 937, 942, 945, 946, 949, 954, 957, 961, 962, 965,974, 978, 982, 983, 986, 1007, 1009, 1012, 1013, 1015: n = A,T,C or G
  misc_feature 1018, 1032, 1038, 1042, 1043, 1046, 1055, 1066, 1071, 1073,1075, 1086, 1091, 1100, 1117, 1121, 1124, 1134, 1135, 1138,1150, 1156, 1157, 1167, 1168, 1181, 1188, 1191, 1207, 1210,1213, 1216, 1218, 1228, 1240, 1251, 1253, 1258, 1264: n = A,T,C or G
cgggntttaaaactnctaaatanntgngcttccantaggngaaaacgtgcacccttaaanatatttnagnccnncctnnaaaanatcagggaaattatgggggtcntttnggggggnntctcagctntantcntanantatntatanannncnncnnannnntacanaagctcaatatgnnatactncntnttcacgtnantatnacncatantnncnatactacttcatcntcnacaanntccgcantnncnanattattntnttcttcataatatccantatnntctncattaatcanttcncatacttttactnatcncttnctctcntctatacttntccatnctantctactnncccttcctnnnaaatntantnntnantncctcaatacannccnntcatccttannnnnnntccncatanacantnanctttactnccncncacctttcnncaataattcttanacntnanacnctnnnnntnatncatanatcacntcntnanctttnannatcntaccacnnannncttntactnctnanacnttattntnatcttnctcnatatacttcnacanatttctcnttanttttatcnanactattcancntactnatnatnttcctattctcactnaananatntntnncntcaatntcatatnctctctnttnctcttnntctcntactantntncatcatncctnatctaacatntctctcntananncactcatnnctttattatnatanactntattnttnctaatactntantcnatctctatctntntcactncnnatcttnanctntatatnctatatcatctactctcnccantaccntcctnaacnntatctattanncacacatcatctnttctanactntctctattntancntaatcntcncncatanactngtttntatcnctnnctnctcantcnctcnncanactatactntatngctnntanctactaatactctctatcctncnctnnanatntaacagtcactctnatatantatnnttntacactcanatcacctctcncttanantntcacacacatnttatntataatatntccatatcacaagcatntacnctntacacacatnntantctcatactcanctctanntcacttcacnnatgactctcagtnctaccanctncctcaattcaatcatncgncanctntntatcacttcntaattatatatntcttaagtccnanatgtnactaantgactatntnaatctntcatnntctaacntccatatcacatntctactatcaatatatacttanaatctcaagtctctanatcccctcaacacctacgntnctactatatatcatnttnacntacannnntctatatnntcacaactatatntanannttanntacnctgntntatnnanat

SEQ ID NO: 5585 - DNA, 1446 bp, Homo sapiens; identical to SEQ ID NO: 5584
  misc_feature 5, 15, 23, 24, 27, 35, 40, 60, 67, 70, 73, 74, 78, 79, 84,106, 110, 117, 118, 127, 130, 133, 136, 138, 142, 147, 149,150, 151, 153, 154, 156, 157, 159, 160, 161, 162, 167, 180,181, 187, 189, 191, 199, 201, 205, 208, 213, 215, 216: n = A,T,C or G
  misc_feature 218, 232, 235, 240, 241, 248, 250, 251, 253, 255, 262, 264,281, 285, 286, 290, 300, 304, 317, 321, 325, 331, 341, 347,351, 358, 359, 368, 369, 370, 375, 378, 380, 381, 383, 385,387, 398, 399, 402, 403, 413, 414, 415, 416, 417, 418: n = A,T,C or G
  misc_feature 419, 423, 428, 432, 434, 436, 444, 447, 449, 458, 459, 472,475, 477, 479, 482, 485, 486, 487, 488, 489, 491, 494, 499,505, 508, 510, 512, 517, 519, 520, 524, 531, 532, 534, 535,536, 540, 545, 548, 550, 553, 559, 561, 567, 571, 581: n = A,T,C or G
  misc_feature 585, 593, 597, 605, 607, 616, 618, 623, 626, 629, 644, 647,649, 652, 654, 656, 657, 659, 665, 672, 679, 682, 688, 689,694, 700, 702, 704, 711, 715, 725, 732, 735, 737, 738, 746,747, 757, 761, 765, 770, 773, 782, 785, 788, 799, 801: n = A,T,C or G
  misc_feature 807, 809, 810, 816, 818, 821, 827, 845, 849, 854, 859, 863,864, 874, 875, 888, 894, 898, 907, 910, 912, 918, 921, 923,928, 932, 937, 942, 945, 946, 949, 954, 957, 961, 962, 965,974, 978, 982, 983, 986, 1007, 1009, 1012, 1013, 1015: n = A,T,C or G
  misc_feature 1018, 1032, 1038, 1042, 1043, 1046, 1055, 1066, 1071, 1073,1075, 1086, 1091, 1100, 1117, 1121, 1124, 1134, 1135, 1138,1150, 1156, 1157, 1167, 1168, 1181, 1188, 1191, 1207, 1210,1213, 1216, 1218, 1228, 1240, 1251, 1253, 1258, 1264: n = A,T,C or G

SEQ ID NO: 5586 - DNA, 734 bp, Homo sapiens; identical to SEQ ID NO: 519
  misc_feature 2, 24, 25, 35, 38, 45, 66, 74, 115, 190, 397, 433, 447, 457,487, 490, 529, 532, 535, 608, 629, 644, 646, 653, 655, 656,667, 672, 679, 680, 691, 696, 699, 712, 715, 717, 722: n = A,T,C or G

SEQ ID NO: 5587 - DNA, 1226 bp, Homo sapiens
  misc_feature 1, 2, 9, 12, 23, 26, 27, 28, 32, 34, 35, 38, 40, 45, 58,60, 61, 64, 71, 74, 78, 84, 95, 119, 129, 131, 133, 139,140, 141, 146, 150, 151, 155, 161, 167, 169, 170, 171, 174,192, 193, 197, 199, 203, 206, 207, 215, 216, 226, 246, 254: n = A,T,C or G
  misc_feature 263, 268, 269, 280, 283, 289, 300, 302, 305, 310, 313, 317,318, 327, 335, 339, 341, 351, 355, 357, 362, 378, 386, 387,388, 390, 391, 392, 395, 399, 406, 415, 418, 420, 421, 422,423, 424, 425, 426, 429, 436, 441, 447, 449, 452, 456: n = A,T,C or G
  misc_feature 458, 460, 462, 463, 466, 467, 468, 470, 471, 472, 477, 479,483, 485, 486, 489, 491, 492, 495, 499, 501, 504, 505, 507,508, 510, 513, 514, 515, 518, 521, 523, 524, 527, 532, 537,538, 545, 546, 552, 556, 558, 560, 570, 574, 577, 580: n = A,T,C or G
  misc_feature 587, 589, 591, 599, 600, 601, 604, 606, 607, 609, 611, 615,616, 618, 620, 625, 636, 638, 641, 643, 644, 647, 650, 657,658, 659, 665, 668, 673, 685, 688, 692, 700, 707, 710, 714,715, 722, 723, 725, 726, 733, 755, 758, 761, 764, 775: n = A,T,C or G
  misc_feature 776, 778, 779, 780, 781, 791, 796, 814, 817, 837, 840, 848,854, 861, 883, 888, 890, 899, 910, 923, 924, 932, 943, 950,961, 968, 988, 999, 1002, 1012, 1020, 1031, 1032, 1033,1041, 1043, 1046, 1048, 1062, 1076, 1083, 1091, 1099, 1102: n = A,T,C or G
  misc_feature 1103, 1104, 1109, 1113, 1116, 1117, 1123, 1128, 1135, 1136,1140, 1144, 1148, 1155, 1156, 1160, 1169, 1170, 1175, 1177,1180, 1182, 1184, 1185, 1190, 1192, 1201, 1209, 1214, 1218,1225: n = A,T,C or G
nnggggttnacncttctaaaatnttnnncttncnntgngncaaangggggcccctctnannatnttcaganccncctnaaaaanatccagggaanattttggggggtctttttgggggnctcctttatnancnatccannnatatncatnnttcnctctanatgctnannncanatatattcaagatcttcnnctcncntcanctnntctcatanntacttaactnataatatcatattacactcntagtcttnctaccacanccttnnctcatttaatnacncctaantcactctattntnccntcatntanattnnatcatcatncactcttntttntnttatctctanctanancatcntatatttctactcaanaattatcnnncnnntantcanatcaccnctcataatnttntnnnnnnnttnccctaanacctntactantncantctnantncnnctnnncnnnttccntnctcntnnttntnntantcantntcnncnncntcnnnttnctntnntanatcanccatnntcttgcnnatttcnaccnantncatatcccancctntanatntacatcncntnttctactnnnctncnntntncctnnantncttancatatatttantnctntnncanatnatattannnttcctnttnatatntcttactattcnctntccnatattcanttctatnacntcanntactcanntnncttatgntttatcctcttatctctatctntcncanaantctctacactnncnnnnttatctatcntctancactcttactctatatcnttntatttatcactcattccacnctntcctcttntctcanatctatncactatctacctatatatatcntattntncttataccncctatattctntaatcattcatanntaccaacntacatcattcncaccttntatacctcatnatctatnctattctactctacatacanctcatagtcantantctatctcanctcctcancatctcactcnnnatctaacntncantntatctatctctccnatctatattctacnctatacnacactacnctctcttnatnnnctctntatntcnntcttantattntctctanntccntatntatnctcatcnnacanatatccatnnttgcncnacncnannatctncnctctctctnttatctanactgntctntctacanc

SEQ ID NO: 5588 - DNA, 747 bp, Homo sapiens
  misc_feature 2, 3, 4, 5, 6, 10, 16, 17, 21, 22, 23, 24, 25, 26, 37, 39,50, 68, 69, 86, 88, 110, 113, 116, 117, 137, 147, 158, 159,174, 178, 180, 184, 196, 206, 212, 216, 222, 226, 236, 237,253, 255, 258, 268, 273, 274, 282, 283, 285, 292, 299: n = A,T,C or G
  misc_feature 326, 339, 342, 357, 366, 367, 372, 373, 376, 380, 382, 386,388, 391, 393, 397, 403, 407, 411, 414, 422, 431, 446, 453,457, 459, 463, 469, 473, 474, 476, 479, 486, 488, 507, 508,531, 554, 563, 567, 574, 579, 582, 597, 599, 626, 627: n = A,T,C or G
  misc_feature 629, 631, 639, 641, 643, 647, 653, 663, 664, 665, 677, 682,684, 690, 707, 708, 709, 711, 712, 717, 721, 726, 727, 728,731, 736, 745: n = A,T,C or G
gnnnnngagngggggnntttnnnnnnaccgaagaacncntggaaaccccnttgaattcaaaaccatgnncacaagctacttgttcntngagcaggaacccatcgactcgnaanttnnccgaggggaggaggaccacnggcgcccggncagccacaccnngaaatgggggagcancgcncngggnaggggggcccanccgaaaatgnggcagnccgnaagganaaanacgcaagganncagagcaggcccaacngnggngaaagggaanagcannagccgcanngngggccgnaacgccncgcacaaaaacatgcggagcaagagcncccatggagaacnganggggccccgcaaagnagcgctagnncaagnnagnacgnanaacncncangngaangtggcngcangagnacnacagaaancgactgggnacccaaggccagccngacaacnccancnaaanaccganctgnnangcngcagagnangaactgggatgaaacaaannaggaagggcggtggcgaagaggncaactaggcagcgaacaaaaccnccaccaagnggancaaggangccanggngagacgccagacgcntntgcccagatcaggaaacgaaagggacnnangncgacatcnanancccnagaagngaacaggagnnnacgcaagccccncgacnanagaagngagatgggctgaacagnnnannatgtnatgngcagnnnaanagagngctcaacgnaa

SEQ ID NO: 5589 - DNA, 1064 bp, Homo sapiens; identical to SEQ ID NO: 5573
  misc_feature 2, 10, 11, 13, 14, 23, 32, 34, 40, 109, 133, 134, 148, 211,219, 250, 254, 269, 273, 277, 284, 285, 287, 291, 293, 308,311, 312, 316, 317, 323, 324, 329, 331, 333, 346, 348, 352,353, 354, 355, 356, 357, 359, 360, 368, 369, 375, 382: n = A,T,C or G
  misc_feature 384, 385, 386, 387, 390, 391, 392, 393, 394, 395, 399, 400,401, 403, 407, 410, 413, 417, 419, 427, 435, 436, 437, 441,442, 444, 445, 446, 447, 452, 453, 454, 460, 462, 469, 474,483, 488, 499, 501, 511, 512, 514, 516, 520, 533, 535: n = A,T,C or G
  misc_feature 541, 542, 543, 544, 547, 548, 550, 553, 559, 561, 565, 571,572, 575, 582, 590, 597, 604, 605, 607, 609, 610, 614, 617,619, 621, 625, 626, 628, 636, 639, 651, 659, 663, 669, 671,688, 706, 707, 721, 727, 730, 734, 740, 751, 755, 758: n = A,T,C or G
  misc_feature 764, 767, 771, 781, 782, 787, 797, 804, 805, 806, 811, 815,823, 827, 828, 830, 832, 837, 841, 844, 848, 849, 853, 855,858, 865, 871, 872, 876, 878, 882, 884, 888, 892, 899, 903,911, 913, 927, 928, 929, 931, 936, 939, 941, 943, 945: n = A,T,C or G
  misc_feature 947, 954, 960, 963, 967, 970, 971, 972, 973, 990, 1003, 1004,1007, 1012, 1013, 1016, 1017, 1024, 1027, 1029, 1038, 1039,1051, 1054, 1056, 1062, 1063: n = A,T,C or G

SEQ ID NO: 5590 - DNA, 1471 bp, Homo sapiens
  misc_feature 5, 6, 15, 17, 19, 22, 24, 25, 26, 27, 30, 34, 35, 41, 57,58, 59, 62, 64, 65, 66, 67, 68, 77, 78, 81, 82, 83, 85,86, 88, 96, 97, 98, 103, 108, 112, 116, 117, 119, 121, 122,127, 128, 129, 131, 132, 133, 135, 137, 140, 141, 144, 146: n = A,T,C or G
  misc_feature 148, 153, 154, 155, 156, 159, 164, 166, 168, 169, 174, 177,178, 179, 184, 191, 194, 195, 196, 201, 202, 203, 204, 212,213, 214, 215, 236, 245, 258, 259, 269, 290, 298, 314, 315,320, 322, 323, 324, 326, 333, 339, 352, 365, 378, 382: n = A,T,C or G
  misc_feature 386, 387, 388, 391, 396, 397, 399, 405, 406, 407, 410, 413,414, 415, 416, 417, 419, 425, 443, 445, 448, 451, 452, 458,459, 461, 465, 466, 468, 469, 470, 471, 477, 485, 486, 491,492, 494, 498, 501, 502, 503, 506, 507, 512, 516, 517: n = A,T,C or G
  misc_feature 522, 524, 525, 527, 529, 530, 531, 532, 534, 536, 539, 540,542, 544, 545, 546, 547, 548, 550, 555, 556, 557, 558, 559,560, 561, 562, 563, 565, 566, 567, 568, 569, 570, 576, 578,580, 585, 587, 588, 589, 591, 592, 593, 595, 601, 602: n = A,T,C or G
  misc_feature 609, 611, 613, 614, 615, 616, 617, 618, 622, 623, 624, 626,628, 629, 640, 641, 642, 643, 644, 645, 647, 648, 649, 650,651, 653, 655, 657, 659, 662, 663, 667, 670, 671, 677, 678,679, 680, 683, 684, 687, 690, 691, 694, 696, 698, 699: n = A,T,C or G
  misc_feature 704, 705, 707, 709, 712, 713, 716, 717, 722, 724, 727, 728,729, 732, 735, 738, 741, 745, 747, 748, 752, 756, 759, 761,765, 766, 768, 772, 774, 776, 778, 781, 791, 792, 801, 802,805, 807, 810, 811, 812, 814, 815, 816, 818, 821, 823: n = A,T,C or G
ccccnngcacacaangncncanannnncancganngagcgntgcagagacagcgcgnnnacncnnnnncacagccanncannngnnancacgacgnnngggcnggagnacgnaganncncnnacacnnngnnngnanaannacngnanacacnnnnggnacgcngncnncgagnacnnngaccncagcganagnnncatannnnggggggcnnnnagagggagatccgcgcacagnattgggcantccttttttgggnnaaaacccggnttgggagaaaaaacccccatnacgacagngagacagaggagaganngcgcncnnngnacccagncacgtncgcgacgtccgancagccccgacgcnggagcgaggagcntagnaacnnnccnccacnncncacgcnnnaanacnnnnnangggggngacgatataagcaccgancngcncannatctcnnantcannannnncacacnccagcaanngcccnncngcgncannnaannccagnaacnnaggcncnnanannnncnanccnncnannnnngnggacnnnnnnnnngnnnnnngcgcanancncccgngnnngnnngngaccanncccgccncncnnnnnnaaannnanannctaacaaactnnnnnnannnnncncngncngcnnaagnacnncaggannnncanncancannccncnanncaccnngncnccnnaanngaagnantcnnncgncanctnacngcancnnacgnccangcncnacannancgcnanancntgncgagacatanncgacgaganncantngcnnntnnncntantntacannncgcccganagcntcngacagncgntncgtcgacagcntnncgcacacnntggntgantccngagncatatagaatcagcgnnnangcagacacnacanagagnangncanctcnacgacganacaacatcgcgnngantcannnnggngacgantccnaannancagnngnncntacgcaganccccaccncgaaannnatncanctanncagctngcnanggacanacacgcgngnnggcacaagacgagccagacngcannacgcgngngccncactngnctcacgccacagaacannntacacnagcgccngcnagagcncacacagnggtnagananggncncgcncntnnatgccatgngaaccacgnagacgcaccgagacatnnnacaangcgctcgcgcagagncnanncncnagacggccgtatnagnagngagncacancnanngnnngagcagcnnnancgcanagngagagagcacncagngganacacgccgtagaccnnnntcnggncgcncccgcncnggnagcanntnnnnccnntntagacanncagcgntgnnngacatanngnaccatcatgtacncagccagcnnantagagntncncanacggcagcnagcagcacnnnc

SEQ ID NO: 5591 - DNA, 915 bp, Homo sapiens
  misc_feature 11, 16, 40, 75, 86, 87, 89, 90, 114, 125, 127, 146, 151,155, 160, 161, 172, 179, 184, 190, 195, 200, 202, 203, 205,208, 216, 228, 234, 239, 243, 247, 251, 252, 254, 257, 262,266, 269, 277, 288, 304, 312, 328, 353, 361, 363, 367: n = A,T,C or G
  misc_feature 371, 378, 391, 394, 395, 398, 401, 406, 420, 425, 438, 447,452, 455, 466, 474, 488, 494, 500, 503, 505, 507, 512, 518,519, 524, 530, 531, 532, 537, 538, 558, 565, 567, 576, 591,593, 597, 608, 616, 628, 639, 644, 648, 656, 674, 685: n = A,T,C or G
  misc_feature 686, 688, 689, 704, 706, 715, 720, 721, 722, 723, 731, 736,740, 744, 762, 764, 767, 768, 773, 778, 779, 783, 786, 793,800, 807, 811, 812, 816, 817, 818, 821, 823, 825, 826, 831,840, 841, 848, 858, 862, 867, 868, 871, 874, 882, 887: n = A,T,C or G
  misc_feature 896, 898, 899, 907, 908, 911: n = A,T,C or G
cgaccagaacngcctngaaatcccacaaacgaggagcaancgacgcgaagacggcacgagagcgcgaggcaacgnccccgccattnntnnccacgctgggaagaccaacacccnccggagcgcgnancagcacccccacggcggangcaancgangaccnncggacagcacncacgggncgganccaggnacgcncgccncnngngcncggaaccnggaccagccaanagcgcngctgngccngacngagnncnccnaaggncganaancccgagcncgcagaagaanccccggggaacgagcngacggganccgcaaaaaggcaccnaagacacaaggcgcaccacgaggcncggaccgngncccngcangcccganagccaacacaggncannggnagngacgnacagaaccggaaancaacngccacacaaaggngccaaccgnacgcnacnggggggccccnacaagggnaaagacccaggaanccaagnggcccnggncnanccccnggaaanngaccnggcaannngggcnngaagaaaaaaccaaaggccnagcgaancngaaacccangcagccagagcacgnanaggnaagcggcaaanaaccgganaggccccagganggaccgaaagnaccgngggngccccaangcccaggcccaaaacgcncagaaaaaggnnannaaccaaaggcccagngngccccgaancaccnnnncagcaccnagganaacnaganagaaccgcgaccaacccnanaannccggncaaannacanaanccatccncaggggngaaggancacnngccnnnccncnanncaaanccaaagccnncacaaanggccacaggnccanagcanncgnacnaccgccanacaangcccagaananncgggggannggngccg

SEQ ID NO: 5592 - DNA, 789 bp, Homo sapiens
  misc_feature 5, 7, 8, 10, 318, 323, 358, 406, 408, 417, 418, 420, 425,429, 431, 436, 438, 444, 454, 456, 469, 470, 473, 475, 476,481, 484, 486, 522, 525, 532, 535, 539, 541, 542, 543, 547,555, 562, 567, 578, 579, 584, 585, 598, 599, 619, 622: n = A,T,C or G
  misc_feature 627, 628, 635, 643, 644, 645, 647, 648, 661, 663, 664, 665,668, 674, 684, 687, 688, 692, 696, 706, 708, 711, 720, 731,738, 739, 740, 741, 742, 743, 744, 745, 746, 748, 749, 750,751, 752, 753, 754, 755, 756, 758, 759, 760, 761, 762: n = A,T,C or G
  misc_feature 763, 764, 765, 766, 767, 768, 770, 771, 772, 773, 774, 775,776, 777, 778, 779, 781, 782, 783, 785, 786, 788: n = A,T,C or G
gtttnannancagctcttgttctttttgcaggatcccatcgattcgaattcggcacgaggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatnagatnatgggaacattatgatccagaaacacgatggcatnacggtggcagtgcacaaaatggcctcttgatgctcatatctggtcttnancaacctgtnntntgaantcgngnacccncnatgtgnaaatcccctntntaacttctcaagnntcncnngtttnggncnttcttttaaggtgccctttggggccttttctggggnaanttttaanaangcanannngcgntttttaanagggctnttttnggccccccctnnttttnnaaaaaattttttnnttaaaaaaggggggattccnttnttttnnaaaaaanccaagggnnncnnccgggggccaacntnnnggnattaanaaaaattttnggnnggtnatancaaataaaantnttnttttggganggaaaatttgnaaaaaannnnnnnnntnnnnnnnnntnnnnnnnnnnntnnnnnnnnnntnnnanncnt

SEQ ID NO: 5593 - DNA, 10 bp, Homo sapiens
  misc_feature 1, 2, 3, 4, 5, 6, 7, 8, 9, 10: n = A,T,C or G
nnnnnnnnnn

SEQ ID NO: 5594 - DNA, 749 bp, Homo sapiens
  misc_feature 7, 8, 9, 10, 15, 18, 41, 56, 338, 350, 380, 611, 626, 638,644, 674, 676, 691, 697, 705, 709, 712, 713, 715, 719, 722,731, 741: n = A,T,C or G
gagaggnnnnttttnaanatcagctacttgttctttttgcnggatccctcgatttnaattcggcacgaggtcacacggggccacatctgctggtgcccgtcgtgctcctctgcagcaagcccagcctggccattgctggaggtcctggagcccacagtgccttggccttaaagagctcacttgagaaacggcttgttccggtggggtggggggtggattgaagactctgagacgagcagggaactcagaacactgagtccctatttgatgttaaaatatgaccgttaaacttctgggtaagataatgaatggcactatggtttatactgtttctgttntatgggctcttncagagacgtgaactggaaaaggctctgcantgtctgggattcgctcaatgctgcaggggagggcaggtgtgaggggaatggccctggagggtgatggggctggggcatccgatgcagctttatagttctgtaattaccacttttaaactttttattacgaaaaatgtcaaggaccctggaattaccgtgaggtaggcaggataatgggcccccaagatgcccgtgttgtgacccccaagacctttgtgagtgcctcacatngggaaattggcctangtcatcttgcangcccanggcaagccccattggcccttaaagcttganancctttcctgctggantttganagatgccngaancannanaagntanaaacccctnggaagggccntacttcct

SEQ ID NO: 5595 - DNA, 708 bp, Homo sapiens; identical to SEQ ID NO: 5521
  misc_feature 2, 9, 10, 13, 14, 346, 480, 568: n = A,T,C or G

SEQ ID NO: 5596 - DNA, 737 bp, Homo sapiens
  misc_feature 3, 4, 8, 10, 17, 18, 20, 76, 78, 82, 85, 86, 90, 96, 99,100, 108, 109, 123, 128, 129, 133, 134, 135, 137, 141, 142,145, 147, 150, 151, 153, 155, 161, 170, 172, 173, 179, 180,184, 185, 188, 192, 196, 206, 210, 216, 219, 220, 225: n = A,T,C or G
  misc_feature 226, 234, 237, 247, 249, 254, 260, 263, 266, 267, 272, 275,276, 278, 279, 281, 289, 302, 305, 318, 325, 327, 328, 354,360, 365, 381, 394, 397, 398, 399, 404, 412, 413, 415, 421,430, 431, 433, 435, 437, 438, 441, 442, 448, 460, 463: n = A,T,C or G
  misc_feature 473, 474, 478, 479, 485, 489, 498, 515, 541, 546, 558, 565,567, 569, 571, 580, 589, 594, 597, 604, 612, 619, 620, 624,636, 656, 660, 664, 667, 676, 681, 686, 708, 709, 722, 725,726, 732, 737: n = A,T,C or G
ggnntttnantctacanncnactggctacttgttctttttgcaggatcccatcgattcgaattcggcacgagcttntntggnctnnccgnctattntgnnatcagagnngctgggacagttgntgctnncctnnntnacgnnagngnttnnangnatgatntctatgtgnannacatcnngaannagnctangaanaatgttgacnccantgtttnttnnatgannactcgaanatncatatatggnantaaangcaaanctntanncttgnganngnngnctagtatnactcacgcgcccngcnaagaccctgctcntcgcagnannatacagtatgctattctggacttacngagtcngttcnagcataatggattccnttgcctcgctacntgnnncaganaatctcanntnctgttnaccaacctnncnangnnatnnccctanttacgcctcganagnatgtgatatnntaanntgaatnatanatctgatgnactactgacagcttctngatgcctgctcaggataatgcctggngcatntgacatcaatancaacctngntntnaggctctantccttgaangactntgntaatgcntacaatgnttataannttgnccatccacaatntgaaaatcaggagcttgacngcgntatnggncaacaactnctacngaacntagtgaacattggatgaatatnntaaagcctggtangcnnatattnggatn

SEQ ID NO: 5597 - DNA, 795 bp, Homo sapiens
  misc_feature 6, 9, 10, 12, 15, 19, 26, 34, 35, 38, 40, 41, 42, 43, 44,414, 417, 461, 488, 592, 679, 686, 688, 698, 726, 749, 752,757, 765, 774, 775, 779, 780, 791, 793: n = A,T,C or G
tgtacnaannantgnggtngctcgtnctttctcnnaanannnnngcttggcgaattcggcacgagggaaagagggaagaaagagaagctggttatttctagaggatgtcgtaatctacatcacaggcagaactgatggctcagtggctgagtggccagtatattgtctttttttttttgagacaaggtctcgttttgtcacccgggctggagtgcagtggcgccatcttggcacaacctccacctcctgtgttcaggagaattgcttcaatctggaaggcagaggttgcagtgagattgcaccattgcattccagcctgggcaacaagagggaaactccgtctcaaaaaaaaaaaataaaagtgccttttaggccggaaaaaaaaaaaaaaaaaaaaaaaaaaactcgagcctntanaactatagtgagtcgtattacgtagatccagacatgataagatncattgatgagtttggacaaaccacaantagaatgcagtgaaaaaaatgctttatttgtgaaatttgtgatgctattgctttatttgtaaccattataagctgcaataaacaagttaacaacaacaattgcnttcattttatgtttcaggttcagggggaggtgtgggagggtttttaatttcccggcccgcgccaatgccttgggccccggtacccancttttgntnccctttagtngaggggttaaattgccccctttggcgtnaatcatgggccataacctggttnccngtggngaaattgnttattccgnnttcnnaatttccccananct

SEQ ID NO: 5598 - DNA, 751 bp, Homo sapiens
  misc_feature 8, 9, 10, 15, 41, 54, 56, 65, 72, 74, 76, 89, 97, 106, 107,109, 113, 124, 125, 128, 135, 136, 150, 151, 154, 156, 157,160, 165, 168, 169, 179, 192, 202, 205, 217, 248, 267, 275,297, 303, 313, 315, 339, 356, 364, 371, 396, 398, 410: n = A,T,C or G
  misc_feature 413, 414, 415, 418, 423, 428, 436, 442, 446, 461, 462, 473,475, 478, 483, 491, 495, 505, 508, 513, 515, 517, 531, 546,547, 549, 565, 571, 603, 605, 616, 624, 635, 637, 638, 645,648, 649, 650, 652, 653, 659, 660, 669, 671, 674, 675: n = A,T,C or G
  misc_feature 678, 680, 686, 690, 691, 693, 696, 713, 716, 725, 726, 730,733, 741, 742, 744, 750, 751: n = A,T,C or G
gagagggnnntttcnaatgccagctacttgttctttttgcnggatccctcgatntnaattcggcncgaggcncncnctgcgctccgtgnctcaacanggcatgccnntntctncgtacactatnnagngagattnntagggactatggtnnagnanntcngtacntgnnaaaggggganctattgcatctanaaacttaatnatntaaaattgactnatttagactagactcaagaatgtatatgctnttggtaattaggaactctngagaatanaggctgctgattgttgccatancatgtnctacaaaatngnatctctatgggatgtactggcaantgtgtcataaaatgctnctgggttnattcatncattccataagaaacttaataccancnaatgcattaaanccnnngcnagttnccatnaactgtanctatgnaacntttgtttaaggatcnntctgatggtcntntangagcnatcttagntctnagtcattggnccnatccntntnctgtgagtaccagnacataccgaacttgnntnccctgcttccactaantccagntgtgaccaaaatctaacgtgacatcatacganangttatagacanaagactantgagatctaananntcctgcnttnnngnnaacccnnctacaaaanantannatngngggaanaatnntnttnccctttggaccatttgnccntcaaatatnngccnccngaatgaanntnaacccnn

SEQ ID NO: 5599 - DNA, 963 bp, Homo sapiens
  misc_feature 2, 5, 6, 12, 13, 15, 27, 31, 33, 34, 35, 55, 246, 368, 394,399, 407, 411, 442, 449, 453, 458, 460, 470, 479, 480, 491,495, 553, 573, 583, 587, 589, 590, 593, 594, 602, 608, 614,619, 634, 636, 639, 650, 654, 669, 693, 702, 703, 704: n = A,T,C or G
  misc_feature 706, 709, 710, 712, 719, 721, 730, 732, 734, 737, 739, 742,747, 749, 751, 760, 761, 764, 774, 776, 778, 781, 794, 796,800, 807, 821, 834, 845, 847, 849, 856, 878, 880, 881, 882,885, 888, 890, 898, 902, 903, 905, 907, 910, 911, 912: n = A,T,C or G
  misc_feature 913, 914, 918, 919, 922, 924, 928, 938, 940, 952, 956, 960,961, 963: n = A,T,C or G
cnaannagtganngngtcgccttgccnaacnannnaggcgggggcgtcttggttntctagcctttagaaaaaaaaaatctagtcttggtaaagaaaatgttcattttaatcaagctccagtacagcttgtgtcaagacctagtaagaccacctttaatgtgttcctggatatgacattaaaaactaacttgaaaattgttaggatatttccttgttccctacttttattgtaaaatctactacatncttaagaattaaaaaacgccatttcagaagagatgatagttttatcttgccaaggaattatcttcttagtagcctatattggcttattccaaaaaaggcgttaacctccatcaaaacatctnctgcgcctctctctcagcatatgctntgatntttgaagngtgnaatagattggagctatcagtcacttatttcnaaaaaantgtnttctntnttcttcatancctgtgaannagggatacccnaggnaaagttcctttctgctgtcctccctcctttggtaatgcttatccttatggaaccactnaacctgcacaaaacccttcnccttaaaaanccangnnaanntggccaanttcttnaattangccancttattttatccccncnggntcattaaaccnaatntcttaggcctggctntggggccttcgggggggccttttnggccttgcnnntngcnntnttaaaantncaggccttncnanaanancanctctntncntctaccgannaanaaccctctcnananggnccctcttcttcananaacncttcttnagctcggagagggncccgaccaatttnaaccgcttctntntntcccccncggtgtcacctttggcttttcncnnncantcncncatctttntgcnnantnacnnnnnattnntgngngcanacacaacaancncccaactccacnctcntgtnnan

SEQ ID NO: 5600 - DNA, 707 bp, Homo sapiens
  misc_feature 9, 10, 11, 595, 640: n = A,T,C or G
gttttaatnnntcagctcttgttctttttgcaggatcccatcgattcgcaagattgggctatggaattggaaggcctgttttggagtactctaaattaaaaaaaagttatatttgtaaaataaccaccacaagattgcctgattcacagttcttctgagtattggcgtaggtaattatttaagatgtttgataaattgtaaaatgctttttacattttttaaggaatcaattgaactactggaaaccagtatgtagtattcttggcaggtctaggtttcataatcctaatttctttgcagcccactattcagaaatgtagtgattaacagagtcaagaatgtttcaggatatttttggctacaagtaacaatacctaactaaaagtgacttaaataataagcagtttgttatttcacagaatgagaagctcagagccagagagttacagggttggttcagcagttcagtttcatcaagaacataagacttgcttactttaaagctcctctgcatgtcagcagagggctgccccaattttagataccaacatctggccaaagaagagcagggaatgcttctttaagtacttattanggagcaaaacttccttaaaagtctcataggaggtttttccttagnctcattggatctcaatggctcttgcatactagaaaaaggccacattccttactctggcatttaagtt

SEQ ID NO: 5601 - DNA, 707 bp, Homo sapiens; identical to SEQ ID NO: 5600
  misc_feature 9, 10, 11, 595, 640: n = A,T,C or G

SEQ ID NO: 5602 - DNA, 707 bp, Homo sapiens
  misc_feature 7, 10, 14, 15, 17, 27, 41, 45, 50, 77, 78, 85, 92, 96, 103,130, 135, 137, 142, 189, 235, 254, 343, 371, 449, 489, 501,505, 553, 560, 577, 603, 605, 632, 653, 671, 672, 677, 695,705, 706: n = A,T,C or G
atgcggnccnaatnntnggctactcgntctttccgcaagancccngcgantcgaattcggcacgagatttgggagtnntaatatngacattnctgngatgctnatatatgtaatgtcttaattgagattnctgtnanggcanaaataattaggctagggctcttagttttcattcctattgcccaagtnttgtcaaactatggtataattttaatgttactttaaaaatccatantctgctagttttgcatgtncttatatgaaaacagtgcagtaagttgaaaactcagtgtctatggaattgataaatgtcgatctggtgtagtatattttatcgcatttncttatattaaaaaatgtctgcatgattncattttatttcctttgtaatttacatttcagaatagtgtattgctatatgggtgccaagattgaatatgaagaacccnagtgtttgtagtattatagttttaagcaaatctgtgtggngatacagccatnagantggggcttatataaactctgaacatgtaagattttgtacagagaatcnttaactntataaattgtatatgancatgtaaatcttttaaaatgtacatnanatactgtatttcattaccttgtgtgtnatagtctagtcattgcctgtnaatataatttattacgtnntctgnagcataaacccatacatngatgacttannt

SEQ ID NO: 5603 - DNA, 842 bp, Homo sapiens
  misc_feature 2, 3, 4, 6, 7, 9, 10, 12, 13, 15, 17, 19, 21, 22, 24, 25,26, 27, 31, 32, 33, 34, 38, 39, 40, 42, 44, 46, 48, 49,56, 57, 58, 65, 66, 67, 68, 69, 70, 72, 74, 76, 77, 78,79, 80, 82, 84, 85, 90, 96, 97, 105, 106, 111, 121, 124,138: n = A,T,C or G
  misc_feature 139, 146, 191, 210, 222, 285, 321, 333, 359, 363, 373, 391,417, 430, 469, 482, 483, 488, 493, 495, 501, 511, 519, 521,522, 544, 571, 580, 581, 593, 598, 599, 604, 605, 607, 612,616, 620, 627, 639, 651, 665, 666, 672, 677, 690, 692: n = A,T,C or G
  misc_feature 694, 707, 709, 718, 723, 731, 737, 747, 748, 751, 752, 757,760, 764, 772, 776, 787, 792, 799, 803, 807, 809, 810, 819,821, 841: n = A,T,C or G
annncnntnnannantncntnntnnnnatcnnnntctnnntncntntnnatttaannntttatannnnnntntnannnnnantnntaatnatgttnntctaatgnnggctnctactcttgntgnttgtgcagtacccnnggattcnaatacggcacgaggcaagttccagtgaaccacaagtatggcaaancttatccaattttatgctnggggcagtcagnacataccagtttctgatgtttcaggcatgagtggggtaaataagtgtgaccacttaaagctgntcgttagcatggaagacttctccattctatctttgnaaaacagacaanatatgcacttgacatattagcaaatnggtnctgaattatncaactgtttgctatttantaaactagcaaatgatgcatgtattntgtttttcatgtnctgggcaatatgagtaaaatctgtccctttttccccctntgaatgaggtctnncatgnttgangnaaagtnttgcactatngcatatantnnggggacacagattttcataatntccattttttgggggcttaaggatttntttttttcnntgtgaaacagtnataanncttanncnatatnatancttnaaatatntaccaggaaaantcctttttgganttttcaaagccttnnattaantctantttttaaagaaancncntatgttatatttntnaaaaggttnttttncccccaanccttanttttacctgnnaanncttgnttncccntttaatantatntttaccaaatntcccnatttccngganaatntnncccttcccntnccttgaaaaacattgttttnc

SEQ ID NO: 5604 - DNA, 843 bp, Homo sapiens
  misc_feature 4, 10, 18, 21, 25, 28, 37, 43, 45, 49, 54, 79, 92, 112, 115,126, 130, 131, 138, 140, 151, 152, 256, 304, 305, 308, 322,338, 348, 360, 369, 370, 371, 377, 383, 395, 409, 441, 447,448, 451, 462, 465, 471, 482, 485, 515, 516, 520: n = A,T,C or G
  misc_feature 523, 525, 526, 540, 541, 544, 547, 550, 559, 560, 565, 567,579, 586, 597, 598, 602, 613, 614, 616, 620, 628, 633, 642,660, 661, 663, 670, 676, 679, 685, 702, 705, 712, 713, 715,718, 722, 726, 728, 729, 730, 734, 739, 741, 747, 749: n = A,T,C or G
  misc_feature 768, 772, 784, 790, 796, 799, 809, 810, 812, 813, 815, 816,830, 833, 839, 840, 841: n = A,T,C or G
tganctcatntctcaagnagnctanatngccctaacnagaatngngctnggggnaattcggcacgagctagcagtaggnaacaaagtataanaatgacagcagatgtgtggncanaaattattcanggcnnaagacantngaactgaaaannaaagtaggtcaatctagaattctatacccaacacaaatatccttcaaaaatgaaggtgaaataaacactttttgatggacaaactgaagttgagagaattcgtnaccagcagacctgtagtacaaaaaatgttgaggcaagttttttaggcnnaanaaaaatgatactanatagaaatttgggctncacaaaggantgaagaggcttncaaatggtnnnattatntggaancatatgaaagtnatcttttctcattntcaatcccttttgagaaactgcttaaagcaanaatatnnacnaggtactatgnagncttaanaacatacatanaancaaaatgtatgacaaaaactactaaagttnnccangantnntggtgtgtgcctgnngcnccngcntgtcttgtnnggctnanatggggacgatncattctnacccgagcccnnatangtcctaacctnntntganctgttgantggtntcactcacnccctcctgggctacacanntngaccctntcctgnaanccaaancccctctcaaccttccnccnttcttcnnanctnttanctgnannntccnttatncncccctnantccccccaccttcctccgnatcncctctcctgcancttttngctccncancctcccaacnntnngnnaatttcctcactgncanacacannnct

SEQ ID NO: 5605 - DNA, 718 bp, Homo sapiens
  misc_feature 2, 4, 7, 8, 9, 12, 17, 18, 19, 23, 542, 613, 617, 620, 645,668, 695, 701, 702, 708: n = A,T,C or G
gntnttnnnttntatannnacangctacttgttctttttgcaggatcccatcgattcgaattcggcacgaggcttctgtgtcaaaaaacaacaaaaaatggatattaggaacgttttgttgtttaaaaaaattactttgtttttacactttggtagaaaaaacttaaggaatatttcaaacataatacaaagtgagcagaatagaatagtgagcttttatgtaaccattcttttttttttttttctgtaaaaagagacaaggtcttgctctgtcacccaggctggagtgaagtggtgctatcataacttgctgctgcctcagactcctgggcggaagtgatcctcctgccttagcctgccgagtagttaggactacaggtgcacaccaccacacctggctaatttttaaatttttaattttttttgtggagacgggatcttactgtgttgcccaggctggtcatgaacttttggcctcaagcagtcctcctgctgtggcctcctaaagtgttgggattgagccactgtgcccagcccattgnttttattattttttaaaggtttatttttaggtgaagtttacatatattgaaatgcacaaatcttaactgtncagntgntaataagttttattgagatataatntatatactattagttatatggtncataattcacatgccttctttgaaagngtccannttcaantgaatttttt

SEQ ID NO: 5606 - DNA, 718 bp, Homo sapiens; identical to SEQ ID NO: 5605
  misc_feature 2, 4, 7, 8, 9, 12, 17, 18, 19, 23, 542, 613, 617, 620, 645,668, 695, 701, 702, 708: n = A,T,C or G

SEQ ID NO: 5607 - DNA, 768 bp, Homo sapiens
  misc_feature 5, 6, 13, 20, 43, 44, 74, 80, 83, 85, 86, 92, 94, 95, 97,99, 111, 115, 117, 123, 130, 135, 136, 139, 150, 155, 160,161, 164, 179, 194, 195, 196, 197, 200, 202, 209, 213, 214,218, 221, 223, 225, 230, 245, 252, 253, 261, 280, 291: n = A,T,C or G
  misc_feature 298, 308, 313, 319, 322, 323, 328, 333, 337, 346, 348, 352,355, 357, 358, 359, 360, 361, 374, 375, 391, 399, 412, 422,428, 430, 431, 435, 439, 444, 450, 451, 457, 458, 460, 466,471, 473, 481, 483, 492, 514, 517, 538, 550, 552, 555: n = A,T,C or G
  misc_feature 556, 566, 572, 595, 597, 600, 602, 606, 612, 616, 625, 626,644, 645, 649, 651, 660, 687, 697, 702, 706, 711, 717, 724,734, 738, 758, 760, 761, 763, 767, 768: n = A,T,C or G
gttanncctttcnaatgctnggctacttgttctttttgcaggnncccatcgattcgaattcggcacgagctganttgccngananntaatgngnngngncaagagactctnccantntgtaantggctanttagnntgnctagctgagcntaatnaaagnnagnaaacttttataactnattaatattctgagnnnncangngcgccantacnntatnccntnancttgnatctatgaccatatnaatatanngcataatnccgcttctatcatgagtanctactagaggnatgcatngcgtgtaatngtgangtaatncannttacngaaanttangtcttgcangnatanggntnnnnnactaatattttannatatagatatgacatntgtggaangagcactagagcntgcatctttnatatgntnnttgnctanatgancagcanngtatgnngntcaaanttatnanaactcatncnagtgtctgntcattcgaaccctacctgatantantctaacttgggaaaaaaaaantggtctgaatgntncannttttaagtgnctatcnccagagttggaaataatgccaanangcntnggtnattagnttcncacatgtanngttaggttttttggactnntgcnangcttactanttggggggaagaagaattcagaagccntggaaaggtnggtcngaanttaangaaatngtaaaanaaagcttggnaaanttttacccttggcaaggatngnntngccnn

SEQ ID NO: 5608 - DNA, 768 bp, Homo sapiens; identical to SEQ ID NO: 5607
  misc_feature 5, 6, 13, 20, 43, 44, 74, 80, 83, 85, 86, 92, 94, 95, 97,99, 111, 115, 117, 123, 130, 135, 136, 139, 150, 155, 160,161, 164, 179, 194, 195, 196, 197, 200, 202, 209, 213, 214,218, 221, 223, 225, 230, 245, 252, 253, 261, 280, 291: n = A,T,C or G
  misc_feature 298, 308, 313, 319, 322, 323, 328, 333, 337, 346, 348, 352,355, 357, 358, 359, 360, 361, 374, 375, 391, 399, 412, 422,428, 430, 431, 435, 439, 444, 450, 451, 457, 458, 460, 466,471, 473, 481, 483, 492, 514, 517, 538, 550, 552, 555: n = A,T,C or G
  misc_feature 556, 566, 572, 595, 597, 600, 602, 606, 612, 616, 625, 626,644, 645, 649, 651, 660, 687, 697, 702, 706, 711, 717, 724,734, 738, 758, 760, 761, 763, 767, 768: n = A,T,C or G

SEQ ID NO: 5609 - DNA, 1475 bp, Homo sapiens
  misc_feature 11, 17, 18, 20, 26, 32, 36, 40, 42, 43, 44, 45, 46, 53, 54,58, 60, 62, 67, 74, 77, 87, 93, 95, 108, 115, 121, 122,124, 125, 128, 129, 133, 139, 144, 151, 158, 170, 176, 179,190, 193, 200, 203, 220, 223, 225, 228, 232, 233, 244: n = A,T,C or G
  misc_feature 248, 253, 254, 255, 262, 263, 267, 272, 274, 277, 278, 285,293, 301, 304, 310, 312, 314, 320, 323, 332, 349, 353, 356,357, 360, 362, 363, 365, 368, 370, 372, 381, 382, 394, 410,417, 424, 426, 433, 439, 440, 447, 454, 455, 456, 465: n = A,T,C or G
  misc_feature 469, 470, 472, 477, 480, 484, 487, 498, 504, 505, 510, 518,519, 520, 521, 525, 526, 541, 543, 550, 571, 576, 583, 584,593, 594, 608, 611, 614, 615, 616, 624, 630, 645, 649, 651,656, 665, 666, 667, 671, 680, 691, 693, 694, 709, 712: n = A,T,C or G
  misc_feature 714, 715, 729, 731, 739, 742, 745, 747, 760, 768, 771, 780,787, 800, 802, 805, 809, 813, 817, 829, 832, 833, 838, 842,843, 853, 854, 859, 866, 867, 868, 870, 874, 877, 901, 909,913, 915, 916, 941, 942, 943, 950, 952, 954, 956, 958: n = A,T,C or G
  misc_feature 962, 965, 971, 981, 985, 986, 989, 992, 997, 999, 1002, 1003,1020, 1025, 1029, 1033, 1037, 1041, 1044, 1052, 1055, 1056,1063, 1064, 1078, 1079, 1080, 1082, 1083, 1086, 1087, 1089,1094, 1097, 1099, 1124, 1125, 1126, 1132, 1137, 1142: n = A,T,C or G
  misc_feature 1152, 1154, 1163, 1165, 1173, 1183, 1185, 1188, 1189, 1190,1196, 1197, 1198, 1203, 1206, 1212, 1223, 1229, 1230, 1238,1252, 1255, 1257, 1265, 1268, 1283, 1288, 1307, 1308, 1318,1327, 1340, 1341, 1343, 1344, 1350, 1351, 1352, 1360: n = A,T,C or G
actaactatcncacacnncnacgccnaaaatngccnaacncnnnnnaaagctnngggncnanacctncaccacncancacccaaaanaacaancnaaacaacaacagncccctcncacctnnannccnncccncataantacancctcccnatagctntcacccacacancacacnccntcaacccccancancctcccnacnccccacccaacccaaanacntnacntaannccacccccacnaaanacccnnncaacacnncacnacacncncanncctcacnccaacccncccacccnccncaaccnancnccctancanacccacccncaccccccccccaaacncaanccnncancnncnacnananctcaacccnnaccacccccccncaccaacaccctccanaccccanacccctnanacccccncaaccnnccacacncatcacnnncacaacatntacnncntcacncancaanacnaacacccaccncacacnnacacncacatcannnnatgnnctcacacccactcantntaccaanctaacaaccacacccatacgntatcncacacanncccacaacnncacatcacacccanccntcnnnaacccacnacaccnacacactccatacanccancncacancacaccaannnccancaaaaaccnacacaacacanannccacaacactctctntancnnacactctaatatcncntaaacatnacnctnanacccacactaccncaaccatnatnccatacacncacacanacacatcacaacncnctncctntcantctncacctacacacnatnncacanaacnncaccaccctnntaacnaacacannntncacnacncacaccaccacatacacccaacanctccctcnctcncnncacaccacaccaccaaaatcacccnnnacaactntncncntnaatnctnatatcnctccaccacnaatnntanccnacacncncannctctcacaacactctcncacanatantctntccntctngantcacacancannacaactnncccacatctcacannncnntanntnacctntcnanccaccacacatcacacacctcacannncctacntcacnaccanccacaccacnanaccccaatncnctctccanacacaacacnanacnnncctcannncatcnacncacatncatcaccaccnaccacnnaacacctnctcactacaacacncancnatcacccnacnccatcacacaccacncacancacaccctcaccacccaanntcacacactnctctccccnctctctccacccnncnncaatcnnncaacaccnncccacccacaccctctacnncncntacnntatctatcaccaccanacncacacatattcatnnncacacntcacctnttannaacttcacacaactatcnatncncnnntncct

SEQ ID NO: 5610 - DNA, 798 bp, Homo sapiens
  misc_feature 4, 5, 9, 21, 24, 28, 32, 35, 41, 45, 64, 69, 74, 80, 82,85, 100, 102, 115, 122, 134, 136, 139, 140, 147, 161, 163,165, 168, 170, 178, 182, 185, 188, 193, 194, 195, 204, 207,212, 214, 221, 225, 234, 237, 251, 252, 255, 256, 263: n = A,T,C or G
  misc_feature 270, 272, 275, 278, 282, 283, 288, 289, 294, 295, 297, 301,305, 308, 311, 324, 329, 342, 343, 354, 355, 363, 374, 388,393, 402, 404, 411, 413, 416, 424, 434, 449, 469, 470, 475,493, 509, 515, 516, 522, 529, 531, 534, 539, 542, 545: n = A,T,C or G
  misc_feature 549, 556, 558, 565, 573, 577, 582, 586, 605, 608, 613, 620,622, 630, 631, 632, 633, 640, 646, 649, 659, 679, 684, 685,687, 697, 699, 702, 708, 712, 718, 723, 726, 727, 728, 734,737, 744, 746, 747, 752, 753, 764, 772, 787, 792, 794: n = A,T,C or G
  misc_feature 795: n = A,T,C or G
ggtnnatancagctcttgtcntgngccngatnccngtgaanatantctctctagctcacttgtntaaantgganagtctntnatnatcggtatgaacccntnaaggagccatgtntaccggnctagctatactngnccnngggaagnccctgcctgtgtgnantnccntnctgggatncttnaanagnaaacnnnacgctctcncanattcntnagatgcncagntagcttatnagncatgggattgccanntgnnccatctnctgtctnanggnctnccanngcacnngtttnncngacnaacnggnccnctgtgtaaatagnaggcngagaaatgatacnntgctgtggaannaccaaccnactatggaccngaaacttgctggcnaaatnaattatctncnacaaacngnaangtggctcngagattgatngttggctataatatngaagcccctgccctgtgacnntgatnctagtgattattgcatgnctcctcatctgtatantgaaanncatctnattaggnanagngtttnganacntttngaaaggncntactggnaatttacnttanaattntttnccattgtccgaccacaaanttncaagnttttccngncacatttnnnnacttaanggcccnggnacctggaagngctttgaaaaggcgcctttnaaaanngngatttagccngnttnatttancccnttttanaaacnggnnntcaggnccnccaattncnngaaanntaacctttagncctttttnaaaactttttggggnggtcngnnatc

SEQ ID NO: 5611 - DNA, 1861 bp, Homo sapiens
  misc_feature 1, 4, 6, 9, 10, 28, 29, 30, 33, 35, 43, 44, 47, 49, 56, 58,59, 62, 64, 68, 69, 72, 73, 76, 77, 78, 79, 80, 81, 84,86, 91, 94, 98, 100, 101, 102, 103, 107, 109, 115, 118,119, 120, 121, 124, 125, 135, 137, 140, 142, 143, 152, 155: n = A,T,C or G
  misc_feature 159, 160, 161, 165, 167, 172, 175, 178, 182, 184, 186, 187,189, 190, 193, 197, 198, 199, 208, 209, 212, 213, 218, 219,223, 224, 226, 228, 230, 231, 232, 234, 237, 238, 247, 248,253, 254, 260, 265, 267, 269, 273, 278, 280, 281, 289: n = A,T,C or G
  misc_feature 299, 300, 301, 303, 306, 308, 311, 316, 317, 323, 327, 328,329, 330, 334, 336, 341, 342, 343, 351, 354, 355, 360, 361,362, 363, 365, 367, 369, 373, 376, 380, 386, 397, 405, 406,407, 413, 414, 426, 427, 429, 433, 439, 441, 442, 443: n = A,T,C or G
  misc_feature 445, 450, 458, 462, 464, 466, 467, 472, 474, 476, 483, 484,489, 492, 496, 502, 503, 505, 507, 514, 518, 519, 524, 526,528, 534, 541, 542, 548, 551, 552, 562, 563, 566, 571, 575,579, 581, 596, 599, 600, 603, 611, 613, 614, 615, 626: n = A,T,C or G
  misc_feature 627, 633, 634, 636, 644, 650, 651, 653, 655, 658, 663, 665,670, 674, 682, 683, 689, 696, 705, 711, 715, 717, 720, 729,733, 735, 738, 741, 742, 749, 752, 753, 755, 756, 763, 767,777, 780, 785, 787, 794, 795, 797, 800, 809, 810, 811: n = A,T,C or G
  misc_feature 815, 816, 822, 826, 832, 836, 851, 852, 859, 860, 862, 869,872, 873, 876, 883, 886, 888, 892, 896, 901, 915, 923, 925,934, 935, 937, 940, 942, 945, 951, 958, 962, 966, 967, 968,970, 971, 982, 985, 990, 999, 1003, 1006, 1010, 1012: n = A,T,C or G
nacngngtnngtgaggcctaaatagctnnnctntngtgtattnnggngnaggtgcntnnatncngccnnagnntannnnnnggntnggagnttngggngnnnnctancnctatanccnnnnacnnaggggggggncnttntnnttccttttnctnctcnnngtgntnttctntgnccntttncncnntnncantctnnncctcacgtnnttnngttcnncccnnantncnnntncgnncatcctttnnttccnncccttncttcntntncaancactntnnatatgccntatatactcnnncncgncnacnctatnnctatcncctnnnntctncnctacnnnctcagtanttnnctctnnnngncntnctanctnctgngtctcncatcatatatncgcacgtnnncattanncctccagtcctnncntctnactctnannnangtctntccgtctnttcnanannctctntntnctatctnnattangtnacgnctctgnncncnttcacangagnntatgncncntttgtncatctcnntactcngcnncacgacttcnnatntctcnattnacangntcactgctaactcanctnnatntctctctncnnnagcgaacgatnntcgcannanacagcctntctgcnnananacntcgcncntcgtntagngcgatctnncagttnattcttnatcctcgtnttgtantatntntangaatacatnatcntncangcnncacttancanntnncatgacnactntgctctctgntancacanangctttcnngnctntcttacgannntgcnngcgcanatcntgactntctnatgtcgtctctcatnnatatttnntntacatanctnnctntctcctncantnttgnctanctcgntgattctctatatngctcactntncatatacanntntgnanacnattgtnactcaangtcntcgnnnannttctacgctcnctntgacnttccaatangganatntctntntcacnnctgtntatnccangtccttganccgannatanatcnnnatatcgacgacnngcnannnatantctctcagcgnatatncatcngnnctctaancncanactgctattcnantagnncncntntctctatncgcncctcctantacannattnggnntnnntcgctancnntntcgnctctnnttnnntatannntnnagctcacnnncnctgcgccatntntacntcatncnnngtctccatanacatntactntctatnaangtaccctntntctctcganancncnnatnnattgntcatnanatcanaaatntnnacntctctgatgacgcntctcantatactgncactcttcnnattattatnnagttcatgattctntctctcananaanntcngncnnnnctctctnaccatntcnancgntagtgncatgcanctanntcnccacntntatntgcgccaccatntactctatngatctccntganctatntnangnatnatctntncnccnnatntcnctgtntantcnancncanacatncgctctcatctanagtctcntangancncgnnacananctctcacanaagatnnntagcntattaatatganannttcctcnanntccttnnnnncctatntnatanncncagnanngactcncgacatntnatcatntctntcncnaacnctnttctannngtntnaatcntgnannctcgtantcnnnncanttcnntntcatgcacattgcgcannntctntncatcaaaacatactntatnctnagacgactnnagctncnatactctctcnnctnnanctngccnctnt

SEQ ID NO: 5612 - DNA, 1522 bp, Homo sapiens
  misc_feature 3, 10, 16, 24, 29, 35, 40, 45, 49, 52, 59, 72, 79, 86, 90,91, 92, 94, 96, 98, 99, 102, 106, 109, 111, 112, 113, 117,121, 122, 125, 132, 135, 141, 145, 155, 156, 158, 160, 161,165, 168, 176, 184, 193, 200, 206, 210, 221, 229, 232: n = A,T,C or G
  misc_feature 235, 238, 240, 242, 249, 251, 254, 261, 270, 279, 292, 293,300, 302, 303, 309, 310, 312, 325, 329, 330, 334, 335, 336,348, 349, 352, 354, 356, 366, 367, 376, 379, 382, 388, 393,394, 420, 421, 424, 426, 429, 435, 436, 437, 444, 445: n = A,T,C or G
  misc_feature 446, 458, 461, 463, 464, 491, 494, 499, 505, 512, 523, 524,530, 534, 546, 553, 554, 558, 559, 560, 561, 570, 572, 573,575, 576, 577, 580, 585, 588, 590, 591, 594, 600, 605, 607,615, 617, 618, 620, 622, 629, 631, 637, 641, 642, 653: n = A,T,C or G
  misc_feature 658, 660, 662, 667, 668, 679, 681, 693, 699, 702, 709, 713,719, 720, 724, 728, 729, 730, 732, 734, 735, 747, 756, 760,763, 768, 775, 780, 792, 796, 803, 806, 815, 820, 824, 829,834, 848, 856, 858, 861, 863, 866, 869, 870, 875, 879: n = A,T,C or G
  misc_feature 881, 885, 893, 896, 898, 906, 908, 917, 935, 940, 944, 946,949, 951, 954, 963, 964, 971, 978, 980, 982, 984, 985, 991,992, 997, 1000, 1002, 1004, 1006, 1009, 1021, 1027, 1031,1032, 1043, 1047, 1052, 1057, 1059, 1066, 1078, 1079: n = A,T,C or G
  misc_feature 1083, 1097, 1100, 1102, 1103, 1109, 1115, 1119, 1120, 1132,1135, 1149, 1153, 1155, 1158, 1173, 1174, 1175, 1176, 1177,1180, 1182, 1184, 1194, 1197, 1205, 1214, 1220, 1223, 1233,1234, 1242, 1245, 1252, 1256, 1257, 1261, 1266, 1279: n = A,T,C or G
ctnttaactnctaatncttcttcntggcnacggcncttantatgngccnctnaaaatcngaataggggtctnggggggnctactcnaccnnncncncnncgncctnatnannncctnaagnntgnctttccngcncttaantccncctctcaccnncntnnccgncgnggttttcncccctctnccctccttnccctatnctcttncccntccctctcctntccccccnttntcnatntncntccctcntnccntatctcncccctcccncccccccanccatccttttctnnctccccncnnctctcnntnccctcaccttttntccnntccnnnttctccctcacnnccncnantcctacatcnnctctcttcnccnttnttctcnccttnnacactctctatcatttatcctcccanntantnttnatcccnnnctacctnnntctacctttccncananntcttcatctttccctctcactccatanctnacctnatcccnacttctntaatctcttcnntcactnctcnctcactctcttntctctcnnccannnnttcacactntnntnnnctntcctntcnanntcnttcatnctcancnctcctctntnntntnttctctntntccccntacnncctccctatcnctctncncncatcnnactcctctctntnctcaccctcctnctctcnccntttatancacncttacnnctcncctnnncncnntctcactcactngctccatcnctcnttntatanatccccnctctntctgatctctcncctnacttccncanactctactnacttntctncactntctancctcttctcctcanctctcgananctntntcncanntcatntccnancttntataccancgncntctacctntntccctcacnaccttcctctcccttcgnatcanctcncnccntnctnctcacactnnctcactnactcatncntntnnatctcnncttantcncncncnctntcactctctcanatactntctnntctatcttctntcantcttntcttncncactatncactcccctctnnatcntacccctcaccatnctntnnaatccnctcagntacnntctacatcattnccntccatctcctgctnacantntcnccacatctctctctnnnnnccntntnactcctctcnccncctcctanctcatcacntccatntcnctctctctcnnactctacnctntccctcnactnntcanccccncttatccatctcnccnntctatctaccncactaactctctccctaccnnctnttcntccntntntctncttcacatcantctactactcctncctntnctctatnntcttnctcttctnaccattatcnccntcctcntnncctncncnntctatntcntntacatcctcccntcacttactctcacnncncttncctcctacctctctcaccctctactcntcnttntctcnncatactannctctcnccatcct

SEQ ID NO: 5613 - DNA, 1411 bp, Homo sapiens
  misc_feature 3, 6, 13, 14, 15, 16, 17, 23, 24, 25, 26, 29, 30, 31, 32,33, 34, 37, 38, 39, 42, 43, 46, 48, 49, 50, 51, 52, 53,54, 55, 58, 59, 60, 62, 65, 66, 68, 69, 70, 71, 72, 73,74, 75, 77, 78, 79, 80, 81, 82, 83, 84, 85, 86, 88, 90,91, 93: n = A,T,C or G
  misc_feature 94, 95, 97, 98, 99, 100, 101, 102, 103, 105, 107, 108, 109,111, 112, 113, 114, 115, 116, 118, 120, 121, 122, 123, 124,125, 126, 128, 129, 130, 131, 132, 134, 135, 136, 137, 139,140, 141, 142, 145, 146, 147, 152, 153, 154, 155, 156: n = A,T,C or G
  misc_feature 157, 158, 162, 163, 164, 165, 166, 167, 171, 172, 173, 174,175, 176, 177, 178, 180, 184, 186, 189, 190, 191, 192, 194,196, 197, 199, 201, 202, 204, 206, 207, 208, 209, 210, 211,212, 213, 214, 215, 216, 230, 231, 232, 233, 234, 236: n = A,T,C or G
  misc_feature 237, 238, 239, 240, 241, 242, 243, 244, 245, 246, 247, 248,252, 259, 260, 263, 264, 269, 274, 275, 279, 280, 282, 285,302, 303, 319, 323, 324, 325, 333, 341, 342, 344, 347, 357,364, 366, 367, 368, 376, 377, 381, 387, 389, 392, 398: n = A,T,C or G
  misc_feature 399, 402, 407, 409, 410, 411, 414, 415, 416, 417, 421, 422,425, 426, 428, 429, 430, 432, 434, 436, 440, 441, 442, 443,444, 453, 454, 455, 456, 457, 461, 464, 466, 468, 470, 473,477, 478, 482, 483, 504, 506, 507, 514, 517, 518, 528: n = A,T,C or G
  misc_feature 531, 533, 535, 536, 537, 542, 544, 548, 550, 568, 570, 582,593, 595, 596, 604, 609, 610, 615, 617, 624, 627, 628, 629,630, 640, 643, 656, 657, 674, 675, 678, 679, 682, 684, 685,696, 700, 701, 702, 704, 706, 708, 709, 710, 711, 716: n = A,T,C or G
ccncanccccccnnnnnaacccnnnnccnnnnnnccnnnccnnccnannnnnnnncannnancannannnnnnnncnnnnnnnnnnancnncnnncnnnnnnncncnnncnnnnnncntnnnnnnncnnnnncnnnncnnnncannnccccnnnnnnncccnnnnnncccnnnnnnnntnccancntannnntncnnancnncncnnnnnnnnnnnaaaaagaagaaggnnnnncnnnnnnnnnnnnnaaanagaaacnnacnnggggncgcgnngggnncncgnttttttcccttaaaaannaggacccttggggcgnacannngcctcacncatcgtcnncnganacacgagacnttgcggngnnngatttttnnaaanaccgantnccncatacnnacnacgcncnnncgnnnnaaannccnnannnangnangtannnnncgaaccccnnnnnaaancancncntnagnaagnnccanncagcactcgctgcggtacctncnncagccgncgnnccaatcaccnacngntnnnaccancnctcnangaccagctaaacctccananagccactctgancctcctacctntnnagaccacngaacnnattcnancaggacncannnncctcaacacnacnatcccctcactgnnccccctcccagacaaanncanntcntnnaagcgccatcncccnnnanancnnnnatccnanncannttcntanccccatantcccccacacaccccccngnncgnncantnacnnnaacanncnccgtagccccnntcctnaaccancctancatannacctctncnnnccctctctgcnccncacaacnnatnanctncaaacaanncnncancancacntaanncnncnncccacaacncccncgncgaacatncccnncacnnagnacccacacataananaccnncacccnactnatatatccacaancnaanccnntnnnnnccaanaanccccnnatcaacancacnacnaacanntcncnccntacnntatcnannatcannnncacccncnccttannannnnnnnntnacancgtanaaaacgnganaacnncannncnntctaacctnnaanccacnncncncacncnnantanccctccngnanncnnncanccnnacccnccttnanncnnnnccccttnaanacnantcancncnacanccnnncnnancgacncantaanncccaatcanctaaaacnnctctcncnnancnaacacatcnannacgancntccnacanatncacgancncnannaantcnacncananangcntcnacntatctnnaaacnnaannatnctcactancacacaaatctnncacnantaananccnncacgnaatcancaanataccncc

SEQ ID NO: 5614 - DNA, 1349 bp, Homo sapiens
  misc_feature 1, 5, 12, 13, 14, 21, 22, 31, 37, 38, 79, 80, 81, 89, 94,96, 104, 105, 107, 108, 109, 112, 114, 122, 123, 129, 131,132, 137, 139, 150, 153, 162, 163, 165, 170, 171, 172, 179,183, 184, 185, 186, 192, 193, 199, 225, 227, 228, 230: n = A,T,C or G
  misc_feature 231, 244, 247, 254, 257, 268, 270, 274, 277, 283, 293, 294,301, 311, 340, 343, 347, 349, 353, 355, 356, 357, 376, 378,381, 394, 395, 398, 399, 411, 413, 418, 421, 429, 430, 433,436, 445, 446, 447, 459, 465, 467, 470, 488, 492, 495: n = A,T,C or G
  misc_feature 498, 499, 504, 510, 514, 519, 537, 541, 546, 558, 559, 560,565, 577, 579, 582, 590, 591, 592, 598, 603, 604, 608, 617,627, 650, 651, 654, 655, 672, 675, 679, 681, 690, 695, 696,706, 711, 717, 729, 735, 747, 752, 766, 769, 781, 784: n = A,T,C or G
  misc_feature 786, 790, 797, 800, 805, 806, 807, 811, 817, 834, 837, 839,842, 857, 870, 872, 878, 880, 881, 886, 895, 896, 899, 902,908, 912, 914, 915, 919, 920, 922, 924, 938, 948, 951, 965,973, 976, 978, 984, 989, 990, 999, 1003, 1014, 1027: n = A,T,C or G
  misc_feature 1032, 1035, 1041, 1043, 1046, 1047, 1048, 1051, 1060, 1070,1071, 1088, 1095, 1100, 1101, 1104, 1113, 1114, 1121, 1122,1128, 1131, 1138, 1140, 1144, 1146, 1148, 1151, 1152, 1154,1158, 1168, 1170, 1175, 1179, 1186, 1190, 1204, 1209: n = A,T,C or G
  misc_feature 1220, 1221, 1223, 1232, 1240, 1251, 1261, 1262, 1267, 1272,1275, 1277, 1282, 1283, 1292, 1297, 1301, 1304, 1306, 1318,1320, 1325, 1332, 1335, 1337, 1349: n = A,T,C or G
ncctntaaaatnnnaaaactnnctttgggcnaaaacnnccccctcaaacatattcagacccccttaaaacatcagggannntatggggntcttntngggggccnntnnncantntcatatcnnatacanannccccntntctacacatcnctntctacttannanctctnnnctcatcnctgnnnnctatanntatctnctcccactcccctacttcacctctcncnncnnctcctcttaccanccntataccncancacccaacacncnaccnccnacctancacctatcanntcctcanattctccctntctccccttccctcctctcattcctcccncanctcnanaccncnnncacctcattctactacacncnccnctcccctctcccnnacnnctctccatcctncnccccnccnccttcccnnttntcnccctcctannncaacactccacnacaccncntcntctcctcactcctactcnctanccncannctcanctccanactntcctnacataactaccccactcntacnctctncatccacctcannntcacncatccactctcntntcnctctcttnnnacctcncatcnntctnacacctctnccccttctcnttctaccattcactcctactctnnctnnctcactctctcatttcntcnaccntncatcactcnttccnntaccctatcnctctntatctntcaccatatccncactcncgcacactctanctacnctctacctatactntcntctcatcactanatntntacntctctcnacncttannnctcnactacncactctcttctccactncancntanacacactccctactncacctcacatatntnctctcncnntcatnatacctctnnatntantcctcntctncnncacnntntncctcacacacactntctcacactnacnctctctctctcctntctcctcntcncnctatanacctnncactctcantcanccctactaccnctcttctctcctnctccnctntcttcnanatnnnccnctctacacnccacttacannaccacacatcactcctncaccctncatcnntcncttcactanntaccacnncactcncanatctccntntctntncntcnntnaccnctcaccatcntntcctnctcnctcaccntctnccactctcacctcnttcanaaccatactcnntntccactccncccttcanctcctccaccnacataccccnncaccncactnacncntccannccacattcnacacntccntcncncccttcctttcncntcctnccccctntcntncaccccttcccn

SEQ ID NO: 5615 - DNA, 791 bp, Homo sapiens
  misc_feature 2, 3, 10, 11, 12, 13, 15, 19, 558, 607, 608, 609, 610, 611,612, 622, 629, 632, 641, 649, 650, 655, 657, 658, 672, 688,693, 712, 713, 717, 724, 728, 743, 770, 771, 774, 777, 786,789, 791: n = A,T,C or G
gnntttagannnncngccncttgttctttttgcaggatccctcgattcgaattcggcacgaggttatggtgggaggagccgatactgagcttcttcctatttgccatgggcttcactgtataaataggagaggatgagagcccagaggtaacagaacagcttcaggttatcgaaataacaatgttaaggaaactcttatctcagtcatgcataaatatgcagtgatatggcagaagacaccagagcagatgcagagagccattttgtgaatggattggattatttaataacattaccttactgtggaggaaggattgtaaaaaaaatgcctttgagacagtttcttagctttttaattgttgtttctttctagtggtctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaanaagctgttgtcatttatgatttaataaaataattctaaaaaaaaaaaannnnnnaaaaaaactngagcctntanaactttagngagtccgnnttacntnnatcccggacctggntaaggataccattggntgaantttgggccaaacccccaannttgnaatgccntggnaaaaaaaatgccttnattttggggaaaattttggggaaggcnnttnggntttaatttnggnan

SEQ ID NO: 5616 - DNA, 750 bp, Homo sapiens
  misc_feature 7, 14, 16, 18, 50, 51, 67, 71, 78, 84, 85, 89, 96, 102, 103,111, 128, 135, 139, 148, 159, 181, 189, 193, 197, 198, 200,212, 219, 221, 224, 226, 237, 251, 253, 254, 258, 263, 265,271, 274, 276, 280, 281, 285, 288, 289, 290, 296: n = A,T,C or G
  misc_feature 300, 308, 314, 317, 318, 320, 327, 334, 335, 340, 342, 351,357, 359, 391, 392, 395, 396, 402, 406, 421, 423, 426, 436,441, 442, 450, 457, 459, 460, 467, 471, 472, 475, 477, 478,481, 489, 494, 497, 500, 501, 513, 516, 517, 518, 524: n = A,T,C or G
  misc_feature 548, 550, 551, 558, 559, 563, 564, 581, 584, 585, 594, 597,604, 606, 617, 620, 621, 622, 623, 624, 634, 635, 640, 643,646, 647, 650, 660, 669, 674, 675, 680, 681, 682, 688, 692,696, 699, 700, 713, 714, 716, 722, 723, 726, 732, 737: n = A,T,C or G
  misc_feature 744, 749: n = A,T,C or G
cggtttnagaatcnancnctacttgttctttttgcaggatccctcgatgnngaattcggcacgaggntacntgcaatnaccatnntggnatcagtncactanngcctctcntagaaaaaaggggaccnagagacnggtnttcaccatntcgcccatgcnggtctcacactcctgagctcangccatccnactncctnnanctaccaaagtgnttccgtnanagncnaactcattttnattcaatggccatngnntctnacacncnattganatntnagcnnaccntannncagttntcanataccacntggcgnatnnanaaccccnggatgcnngaccntngtgaaccanatgctnanatgccattcaatcaggaagatgccaaaaatgnnctnnttattntaanataagtacttaagtnancantattcagaantgacnntctcatanggaagcntnnttatctncttnnatnannganattgttanaatcnttnccnntaatccaccttnatnnntacccntttgtttattaaggcaaaagattncnnttatccnnctannaatgcttcatgaaatcnaanntaatatttnttnaagctantntccaccattanttnnnnntgtacatttnntaatntgnaannccnatcttgtatnaaagaaccntaatnnccaannnttcctnaatnatgnttnnattccacctttanncnatatannccnaacttntcttntcttttnttccnc

SEQ ID NO: 5617 - DNA, 979 bp, Homo sapiens
  misc_feature 6, 10, 19, 27, 34, 58, 59, 62, 70, 71, 79, 83, 94, 95, 100,106, 115, 116, 117, 118, 120, 122, 176, 183, 184, 193, 211,221, 241, 266, 283, 298, 301, 302, 312, 314, 315, 326, 330,334, 335, 344, 352, 353, 354, 357, 358, 360, 364, 380: n = A,T,C or G
  misc_feature 393, 408, 409, 413, 414, 421, 425, 429, 431, 432, 436, 442,444, 447, 453, 454, 464, 470, 478, 482, 485, 486, 487, 491,496, 500, 506, 507, 512, 516, 525, 536, 539, 540, 544, 545,547, 550, 557, 568, 570, 576, 583, 584, 588, 590, 595: n = A,T,C or G
  misc_feature 596, 604, 606, 611, 614, 620, 622, 627, 639, 640, 643, 644,645, 652, 653, 657, 663, 667, 668, 669, 672, 676, 680, 699,701, 703, 704, 705, 715, 722, 724, 726, 727, 729, 732, 738,739, 740, 744, 746, 753, 760, 761, 774, 775, 777, 779: n = A,T,C or G
  misc_feature 781, 782, 783, 784, 789, 793, 795, 796, 801, 805, 809, 810,816, 818, 820, 824, 826, 827, 829, 830, 831, 834, 835, 838,842, 845, 847, 851, 853, 858, 859, 860, 861, 864, 865, 866,868, 879, 880, 883, 888, 894, 895, 897, 898, 901, 907: n = A,T,C or G
  misc_feature 912, 914, 917, 920, 922, 924, 925, 930, 939, 946, 949, 950,955, 958, 961, 967, 972: n = A,T,C or G
gtaccnattnatgtgctantctgctcnttctttntgcaatatcccatcgattcgaatnnggnacgagccnncctggtcnctgncaggattgacnnattgntagctntttctagannnngngnatggtggtgcatggccgagtcttagtatggtggagcggatcatgaaagcccagncacttgnnggacaactncaccatgggctatatganggccaaaaancacctggagatcaaccctgnccaccccattgtggagacgctgcgncagaaggctgaggccgncaagaatgataaggnagnnaaggtcctgntnntgctgctgctngaanccgnnctgttatcntctggctnnnccnntnaggntccccatacccactcnaaccgcatctatngcatgatcaagctanntctnngtattgntgantatnannctgncaccanangancccacnncttgcaactnctgatnagatcccntttntcnnnggcnacgangatncatttnntcctngaanaagtccatntagtcactttnccnntccnntntcnaaccctnttcttccctanancttacnttttccnnatcntncctcnncatctcgncnattcnccncatctncnccccntcctcatctccnntgnnnctatctnncccncccccnctcnnnttntctnattntacttctccctctctctcncntnnncattttctancctctcntncnntnctnttactnnnctcncntactacntcactcnnctccttactcttnncnantnnnnctctncctntnncctcnctcntccnntcactnancnctcntnntnnntcnntcnaccnctntnctcnanctcannnnctnnntncatcatcatannctntctcnccttanntnnctntcctcntctcncnctnttncncnnctcantctttctcnctctctntcnntctcnttnctntcaccntcctntctctct

SEQ ID NO: 5618 - DNA, 741 bp, Homo sapiens
  misc_feature 1, 2, 10, 17, 42, 44, 45, 46, 48, 55, 58, 62, 73, 75, 83,85, 91, 94, 105, 107, 115, 119, 121, 124, 126, 129, 131,145, 166, 179, 181, 188, 193, 196, 200, 213, 214, 217, 219,235, 240, 255, 256, 269, 270, 271, 280, 282, 290, 294, 298: n = A,T,C or G
  misc_feature 302, 307, 329, 330, 340, 342, 365, 381, 402, 430, 435, 442,451, 453, 454, 455, 461, 463, 465, 467, 473, 475, 476, 477,483, 487, 491, 497, 498, 499, 501, 502, 504, 506, 509, 511,516, 521, 523, 525, 534, 537, 538, 539, 540, 541, 554: n = A,T,C or G
  misc_feature 555, 556, 562, 564, 570, 571, 576, 580, 585, 588, 592, 593,605, 612, 620, 621, 628, 633, 635, 637, 656, 660, 661, 682,687, 688, 692, 704, 711, 719, 721, 735, 741: n = A,T,C or G
nntaaatcanctcttgnctttttgcaggatccctcgattcgngnnnangtcgagnacnttcntagggggcctnantctaatangngccttntgnctgtcatgatngncaattganaagnanttnantancncatttagaatctantgactagcctcctctctggtngctggtggcattnanggttcanaccanccntaantgctggtgctgtnnaanangtctcacgtggctgcntgtcntggctcatgcctgtnntcccaacattctnnnaggcccacncngtagaacngctngagnccangagtncagaatcagcctgcgcaacatnncaatactccntntcataaaaattcataaataacangtctcacgtgaccaanggctcctgaagctagaaccangtttggatacaagattgaagatccacangccantcttgcntctgagccntnnngcctantngngncatgtntnnnaattgntcanggcnagagcnnncnntntngcntnatacnggaangncngcttaattngcnnnnnttcagtccaaatnnnatactntngggacnntaacntgcnctatnctntatnnccagagactacngtcttantcatccannaaatgancgatngntnattattcccatggcacctntatnnaaatccagagttcttcgcagnctttnngctntttatatgtgtnccaaatnttaaaccntnataattattgggcntctgan

SEQ ID NO: 5619 - DNA, 711 bp, Homo sapiens
  misc_feature 5, 24, 598, 660: n = A,T,C or G
aatcngctgcttgctactcgtgcngatccctcgattcgaattcggcacgagactttatgagaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcganagagagacctattttgcaatcagtgacattgatttttagattatttatttaaaattcctatnaagatcagccctttgtacagaaaaatgtgtctataaaaattatgtgttatt

SEQ ID NO: 5620 - DNA, 858 bp, Homo sapiens
  misc_feature 15, 16, 18, 20, 55, 59, 61, 63, 64, 69, 73, 74, 78, 80, 87,88, 89, 95, 100, 106, 111, 116, 119, 120, 129, 135, 136,138, 141, 145, 188, 205, 211, 229, 236, 240, 241, 258, 267,304, 336, 351, 368, 370, 386, 391, 400, 405, 406, 418: n = A,T,C or G
  misc_feature 431, 454, 462, 495, 506, 507, 508, 512, 517, 518, 522, 526,527, 544, 550, 558, 560, 567, 569, 571, 581, 585, 590, 594,604, 610, 612, 617, 618, 626, 630, 639, 647, 649, 665, 667,670, 674, 675, 680, 682, 685, 697, 703, 704, 710, 714: n = A,T,C or G
  misc_feature 716, 719, 724, 729, 730, 735, 738, 743, 745, 750, 755, 759,763, 770, 780, 790, 801, 804, 808, 809, 819, 825, 829, 832,834, 838, 842, 844, 845, 846, 852: n = A,T,C or G
tccccattttgaatnnancnagctacttgttctttttgcaggatcccatctattngggngnannctttnttgnnaatncnggtacgnnnctatgnatcangactgnacttnggtanctnncttggcccntacagnngnaangaangatgggctggtggattggcccacctgggagcaacatggggcanggggagccctcaccctnagccanccagacgagtgggatttnccccagnacannatacccccttcacaaanggaccactnaagtgcttcattaagcaagtcctggatcctgtgcccnccaactgggtgagacaccccaatgggtcaccntacaccttatacaanagcattttactggcatnangtgggtgcccctcaangacanagatcccanagganngagtggggtctnatctttgctgttnttccatcactctttggtgacatnttcaggtntgggagggacccagattagtattggctttgaangaaattcccannnatantgcanntatncctnncataagatggtgcctanacttgnttataagngnataacantnangtctacaccnaacnttcancccntaaaaaattnccctancnaaaanncctcaatntttnaaagggtcnactgcttncnctttacaaggaatctnantgntggnntaacnanacnttctttgtaaanattganntaaacngggntnttngtatntatanntcctnctntaacnantcctntgatnaaangggnttctatntaatcggtgnttctgcatcntaaccttctcnaanaaanngtattctctnctaatntcanccncntttntaancnnngtcaanacgcgg

SEQ ID NO: 5621 - DNA, 999 bp, Homo sapiens
  misc_feature 3, 5, 6, 8, 9, 10, 11, 12, 13, 14, 15, 16, 17, 18, 19, 20,22, 23, 24, 25, 26, 27, 28, 29, 31, 32, 33, 35, 36, 37,38, 39, 40, 41, 42, 43, 44, 45, 46, 47, 48, 49, 50, 51,52, 54, 55, 56, 57, 58, 59, 60, 61, 62, 63, 64, 65, 66,67: n = A,T,C or G
  misc_feature 68, 69, 70, 72, 73, 74, 75, 76, 77, 78, 79, 80, 81, 82, 83,84, 85, 86, 87, 89, 90, 91, 92, 93, 94, 95, 96, 98, 99,100, 101, 102, 103, 106, 107, 108, 109, 110, 113, 114, 115,116, 117, 118, 119, 120, 122, 123, 124, 125, 126, 127: n = A,T,C or G
  misc_feature 128, 130, 131, 134, 135, 136, 137, 138, 140, 142, 145, 146,147, 148, 149, 150, 151, 152, 154, 155, 157, 158, 160, 162,165, 167, 168, 169, 170, 173, 175, 177, 178, 179, 180, 181,182, 183, 185, 186, 187, 188, 189, 190, 191, 192, 193: n = A,T,C or G
  misc_feature 195, 196, 197, 201, 203, 204, 206, 213, 228, 231, 235, 236,237, 248, 249, 288, 297, 298, 301, 302, 312, 320, 328, 331,332, 337, 341, 345, 360, 362, 365, 370, 373, 387, 392, 397,419, 421, 433, 436, 453, 471, 480, 490, 494, 499, 501: n = A,T,C or G
  misc_feature 502, 503, 505, 511, 520, 521, 522, 528, 529, 530, 532, 534,536, 537, 552, 558, 566, 571, 580, 583, 593, 599, 614, 615,616, 629, 637, 643, 650, 655, 660, 661, 663, 668, 669, 695,711, 713, 714, 733, 738, 739, 744, 771, 776, 782, 786: n = A,T,C or G
  misc_feature 808, 810, 812, 820, 825, 829, 832, 839, 841, 848, 859, 863,871, 873, 875, 879, 883, 893, 902, 905, 907, 909, 917, 923,939, 943, 948, 950, 951, 957, 965, 969, 972, 982, 987, 995,996, 998, 999: n = A,T,C or G
ccncnncnnnnnnnnnnnnncnnnnnnnnannnannnnnnnnnnnnnnnnnncnnnnnnnnnnnnnnnnnannnnnnnnnnnnnnnnannnnnnnnannnnnnacnnnnncannnnnnnnannnnnnncnnagnnnnncncncgnnnnnnnnannanngngnacncnnnntanancnnnnnnncnnnnnnnnngnnnctgncnncncttttcnaaaagctggtcctcngcnactnnncaggcagcccnncgattcagaattcggcacgtaggccaagtatgcagtgtnaacggctgnnagnntcgagaaccngagtgtgngctctccntgnngaccnagancgangcgagagctccaagnanganatgantgngacctgcatggganaaggncaggnggatatcatggagagcgtgaananccggtctgaaanganacaggggtgccacccangtgccagagatgcgaagnaaccaatanagcaggggangggncaagngnnnancgaacngaagagcannnaacggnnnanangnnaaggagcacaatgangccctnatcgcccngagcnctcacgccnatnagggctcatncaaacngagcacccgctttcnnntgcccacaaaatngaattgantcaagncacgccngacangtgcnnanagccnngccattggaactcgtctcccccctangaatgctgcccttgcnannacccattgctatgctgctnaccanntcccncttgtattcctggggcccctcttatgnactgnaacgantcanccgtgactaggggtaaaaacgnangnggaaatgntatangaanttngcaccangnaatcatngcttatccatncccnaatgcatngntnaaanttcnacaactagtncgtcatagnacncntntggaatanttaggngaaactgtggcttatnaatngtccnanntggganaagggganccanatnaacttggctnaagcncgaatgtnncnn

SEQ ID NO: 5622 - DNA, 796 bp, Homo sapiens
  misc_feature 5, 9, 10, 20, 23, 26, 27, 28, 32, 38, 59, 60, 102, 213, 234,239, 245, 248, 254, 258, 360, 376, 384, 439, 466, 478, 546,558, 560, 567, 586, 597, 608, 639, 646, 654, 664, 671, 676,686, 687, 692, 705, 721, 727, 730, 741, 744, 749: n = A,T,C or G
  misc_feature 751, 752, 754, 757, 760, 770, 771, 778, 786, 787, 788, 796: n = A,T,C or G
ggtgnagtnnatgtctaatnctntgnnngcgnttgctntcgatgcaggatcccatccgnngaagaagctgcagaagaaatgaagaaagtgatgatgatttanattttgatattgatttagaagacacaggaggagaccatcaaatgaattaatatcactgtattaaaagtctgccgggcacagtggctcacgcctgtaatcccaacactttgngaggccaaggagggtggatcncctgnggtcanganttcttnaccngcctggccaacatggcggaaccccatcttcactaatagtacaaaaaattagctgggccgtggtggctcatgcctgtaatcccagctactcaagaggcttgangcaggaggattgcttnaaccctgnaggcggagattgaagtgagctgagttcgtgccattacactccacctgggtgacanagtgagactctgtctcaaaaaaaatanaataaaaagtcnatttacaatgtgaaattctgacaccttttggctttgagtattttcccaaagatattttgaatccttantgaaggaaattnanaaaaaanctatgggaaaaattggacnaaatttcattncttgaacaatnttaaaattggggtattatttacctttaacantccaacntaaaccangaatttcagnaattggntgggnttggattaannaaacntaacctcatgttnaaaaattaaaaattcncattanttnccttggcctcnaanaaaantnntnacncanataaactccnngcccagnccttttcnnngccttttn

SEQ ID NO: 5623 - DNA, 712 bp, Homo sapiens
  misc_feature 144, 207, 255, 264, 314, 325, 352, 378, 382, 399, 417, 451,472, 479, 481, 491, 504, 522, 538, 539, 545, 567, 574, 588,591, 605, 616, 618, 658, 689, 693, 699, 701, 702, 707: n = A,T,C or G
cacaagctacttgttctttttgcaggatcccatcgattcgaattcgcggccgcggcgccaatgcattgggcccggtacccagcttttgttccctttagtgagggttaattgcgcgcttggcgtaatcatggtcatagctgtttnctgtgtgaaattgttatccgctcacaattccacacaacatacgagccgggagcataaagtgtnaagcctggggtgcctaatgagtgagctaactcacattaattgcgttgngctcactgnccgctttccagtcgggaaacctgtcgtgccagctgcattaatgaatcggncaacgcgcggngagaggcggtttgcgtattgggcgctnttccgctttctcgctcactgactcantgcnctcggtcgttcggctgnggcgagcggtatcaactnactcaaaggcggtaatacgggtattcacagaatnagggggataacgcaggaaagnacatgtnancaaaaggccngcaaaaggccagnaaccctgaaaaaggcccncgttgctggcgccatnnacatangcttcgaccccctgacagcatnacaaaantcgaccttaagtcngangtggcgaaacccgncaggactattnanatccagcgtttcccctggaacttcctaggcgctttctgtnccacctgcgttaccgatcctgtccgcttttncttnggaaantnngtttntatat

SEQ ID NO: 5624 - DNA, 712 bp, Homo sapiens; identical to SEQ ID NO: 5623
  misc_feature 144, 207, 255, 264, 314, 325, 352, 378, 382, 399, 417, 451,472, 479, 481, 491, 504, 522, 538, 539, 545, 567, 574, 588,591, 605, 616, 618, 658, 689, 693, 699, 701, 702, 707: n = A,T,C or G

SEQ ID NO: 5625 - DNA, 710 bp, Homo sapiens
atccagctcttgtctttgcaggatccctcgattcgtgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggcctggaaaccatgaccat

SEQ ID NO: 5626 - DNA, 705 bp, Homo sapiens
  misc_feature 2, 563, 574, 618, 620, 638, 639, 642, 644, 698, 703, 705: n = A,T,C or G
tnctaggctcttgttcttttgcaggatccctcgattcgtttggtcagttgcaccttctgggtcactggtagccgcgggagccgggtggggcctaggcgatgatccggcattaaggagctgggatcatcctccgtctcaggtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttccgctgtcgtgaccgattgagtccatgggctgccagatcaacgcacaggggaactcgaagtcttcctacagtagaagttaccgagaaggtcaacactataacaagtactttacaggataccagtcggaacctgcgacaagtggaccagatgcttggacgatacccgagaatacagtaatggacaggcgggtgccatagaacatgtgagaaactacatttgnttgcatttctnctacccaccttttttgggaatgaatgttttggggaatggggctntnaccttaaggaaaaaaccnntgngnaatgctttaaaattttaaaactgatttaatattttatagtttaagtttaggtancttgncn

SEQ ID NO: 5627 - DNA, 733 bp, Homo sapiens
  misc_feature 20, 26, 28, 33, 44, 67, 68, 86, 103, 127, 133, 146, 153,193, 221, 225, 392, 513, 530, 560, 594, 596, 598, 600, 623,639, 648, 653, 654, 660, 668, 669, 671, 678, 680, 694, 703,707, 710, 723, 725, 726, 729, 732: n = A,T,C or G
tttgaatctgtctctctttnaaaccntnggctncttgatgtttntgcggatccctcgattgcgaatnntgcacgagatggtgtttnccctggaagctgagaanaatggggctttaatggaacaaatngctcangaagctgtttgtnatgcagnttattatggaaatggccaaaaactgtaatgtggatccaanagggtgttttcgtctatttttccagaangccnaagcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacanaatccagattatcttcagtattctatcagtacagctctctgcagcttaaactcggtggtacataaagaagatgatgaacccaaaatgatggacactgtataatttggttaagactgctgangccaagtgctattttgntacaacgaaaggaagaacttggctatttcntgacacttttatgggtgctgcactttattcttgngntngntttttgatggggagggaaagagnactgaaatgttttcgnaaatttttntttanngtgccngcttaggnntncttggtntngactctggtgtctngaataagangagntgntcccatatgtttngnnggnaanc

SEQ ID NO: 5628 - DNA, 709 bp, Homo sapiens
  misc_feature 2: n = A,T,C or G
tnaattcagctcttgttctttatgccgatccctcgattcgaattcggcacgaggccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgcccgaagtaactggctgtgcagaatgtat

SEQ ID NO: 5629 - DNA, 831 bp, Homo sapiens
  misc_feature 2, 3, 4, 6, 9, 14, 16, 169, 174, 179, 180, 217, 279, 329,333, 334, 338, 340, 341, 346, 364, 366, 369, 371, 372, 380,385, 396, 402, 404, 408, 419, 423, 429, 434, 439, 444, 460,463, 470, 471, 472, 473, 477, 480, 486, 494, 496, 497: n = A,T,C or G
  misc_feature 499, 504, 506, 510, 515, 520, 531, 532, 535, 539, 547, 548,551, 552, 554, 559, 563, 568, 574, 575, 581, 583, 584, 589,590, 592, 593, 597, 603, 604, 606, 607, 611, 617, 619, 623,625, 628, 632, 637, 640, 651, 652, 660, 663, 665, 666: n = A,T,C or G
  misc_feature 669, 671, 678, 686, 690, 692, 694, 696, 697, 698, 701, 705,706, 707, 708, 709, 710, 712, 714, 718, 719, 720, 722, 724,732, 734, 742, 748, 757, 758, 764, 766, 770, 771, 773, 776,777, 779, 780, 781, 790, 792, 793, 801, 804, 805, 810: n = A,T,C or G
  misc_feature 820, 821, 826, 828, 831: n = A,T,C or G
gnnngntgnccggncntttatacaatacaggctacttgttctttttgcagggatcccatcgattcgctgacctcctcctcagagaaagcactggccaaccagttcctggcccctggccgtgtgccaaccacagccagagagcgagtgcccgccacacagacggtgcatntgcantcacnngcgcggtacaccagcgagatgcggagtgagctactangcacggactctgcaatgtgagtcaccatgaacacaacatgacttgagggccaactgactaangacaagacatgtattcttgctgccccagggccttcatgccatggactccntgcnntgantnnaacangagcatcaccaaactacncntgnannaataccangactnatgataatggncccganangaancaaagctctgnacantggctnatacnttgtnatttncgtagctgaagcatgnggntcacctnnnntcangantttggngaccaacntnncnaactntnactntaacncatgncttttctaaannttnaaanttttaatnncgnntncaacnttcncaatntctggnnttcccnanntgctnngnnaggnaatctnncnntgantaaaantntttnanacncaanaaagntgnagggtttcaanntaagcttnaananntantncaaattnatactttntttngngntnnntantagnnnnnntnanaacnnntntntttcttantnatattatnatagcntaatataannttatantnatanncnatnnannnaacgtctananntttttatntcnntaaanatttcttttnnaaggntntcn

SEQ ID NO: 5630 - DNA, 793 bp, Homo sapiens; identical to SEQ ID NO: 514
  misc_feature 4, 5, 6, 7, 9, 14, 15, 16, 29, 241, 265, 378, 637, 761, 770: n = A,T,C or G

SEQ ID NO: 5631 - DNA, 750 bp, Homo sapiens
  misc_feature 1, 5, 8, 15, 22, 25, 32, 42, 74, 87, 100, 114, 115, 117,119, 121, 125, 133, 141, 145, 151, 152, 153, 154, 156, 176,180, 183, 190, 194, 198, 205, 208, 226, 227, 242, 243, 251,252, 254, 262, 285, 292, 293, 299, 301, 305, 309, 314: n = A,T,C or G
  misc_feature 318, 319, 324, 327, 329, 330, 331, 334, 337, 344, 356, 357,366, 376, 378, 379, 386, 387, 388, 393, 406, 408, 409, 412,423, 425, 426, 432, 436, 438, 442, 450, 452, 468, 475, 476,478, 479, 482, 485, 492, 499, 500, 504, 507, 518, 542: n = A,T,C or G
  misc_feature 549, 550, 551, 554, 556, 560, 563, 568, 571, 575, 581, 589,592, 593, 598, 622, 637, 644, 647, 648, 650, 662, 667, 674,687, 688, 693, 696, 698, 701, 703, 707, 711, 716, 719, 722,723, 726, 739, 741, 746: n = A,T,C or G
naatngcnaggctcntgctctntgngcaggancccatcgatncgaattcggcacggaggttatgagtggtcatngtgaaaatttggntgaatacagcaangtagcaagaaaatnncngncntatntactacanttaacctntatnaactgnnnngncatatgacatccaaatgttntatnatnacctggnaaanttantatagtntangatactaaaacagtatgnntacaaaagtgaactnnctgtgcanntntcacaggntttattcatgtgacactatatantgcctanngtcacntntcanccangttcntctnnagtgnaantnnntcnagngcatctngcacagatgctnnattgactanagaatgaatncnntgggcgnnnatacntgggctaactgcngnnatngatcattctananngcactnatgnanatanccccatanangccggacagacggtanacatacnnanngangcnccagatncttttannatgnatnattgagatttnaccagtctcatgtgccccgcgttntgtgttnnnctnanacangcngattnacnctgntctagncatcttgnctnnatcgngaaataatggctcctgcctccatnataatgtttaggagngaaatgnaannanttcgcgtgggcntgctngagtgcnaaaggcctttacnngttgngancnaantngggnagcnagttntcnccnnatngtacgctcccctnancaatntccg

SEQ ID NO: 5632 - DNA, 716 bp, Homo sapiens
  misc_feature 3, 4, 5, 11, 15, 21, 22, 70, 636, 642, 657, 671, 714: n = A,T,C or G
tgnnnttttgnttcnaatgcnngctcttgttctttttgcaggatcccatcgattcgcgcaaacttttcantctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctgaaaaaaaaaaaaaaaagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcangttcanggggaggtgtgggangttttttaattcgnggccgcgcgccaatgcattgggcccggacccacttttggtccntt

SEQ ID NO: 5633 - DNA, 792 bp, Homo sapiens
  misc_feature 2, 3, 4, 5, 6, 7, 8, 9, 10, 15, 22: n = A,T,C or G
gnnnnnnnnnttttnaacgctngctacttgttctttttgcaggatcccatcgattcgaattcggcacgaggagagcttgggatgtggtaatgccagccacactcctcagagccgtggccagatctcatcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcacaccttccaaccatgaaatcctttggtactcacaggagagtgacccacaaaccaaatctgttgggttctaaatggtttataaaaatattaaagaggcatttctcatctgtatcaacggaaacatttgttccaaaacaagacttcccacaggtgaagagaccactaaaagcatccaggaccagacagccatccaggaccaaccttccagttctgtctgtgaacgaggacctaatgcactgcacagcatttgcaacggcagatgagtatcatctgggaaatctgtctcaagatctggccttccacggatatgttgaagtaacaagcttgcctagagatgcagcaaatattttggtgatgggtgtggaaaattctgcaaaagaaggtgatcctggaacaatattcttcttcagggaaggagctgctg

SEQ ID NO: 5634 - DNA, 829 bp, Homo sapiens
  misc_feature 6, 10, 11, 15, 28, 34, 39, 40, 41, 42, 45, 48, 52, 54, 55,63, 68, 69, 71, 73, 81, 85, 90, 93, 106, 109, 123, 174,316, 382, 383, 387, 400, 403, 407, 416, 419, 421, 425, 431,439, 448, 455, 456, 457, 460, 461, 465, 469, 479, 487, 493: n = A,T,C or G
  misc_feature 497, 499, 501, 514, 522, 523, 527, 534, 537, 538, 540, 541,549, 552, 555, 559, 560, 564, 567, 576, 580, 584, 587, 595,596, 607, 616, 625, 627, 630, 639, 641, 643, 649, 652, 654,668, 669, 673, 674, 680, 683, 686, 690, 695, 696, 701: n = A,T,C or G
  misc_feature 707, 712, 714, 715, 721, 723, 731, 732, 737, 745, 748, 752,755, 756, 759, 760, 761, 762, 768, 769, 770, 773, 774, 775,779, 781, 782, 787, 798, 803, 808, 817, 823: n = A,T,C or G
ggtggngggnngtanttctaatgctggnctctcngtctnnnncangancacncnncgggaatnctcannancncaccttcnagcnccttntgngagttctgatcanggnattacactcttttnatgggggcctgcctgtaagtgtagacatgcacactcagctgaccttactgntcaaaagctggagaaaaagaaacagctttcatacagtgcaaactgtctacgtctatgtaaaagaatttgagaaacatggcagtagccattgctaattaatctgggtatgtgtaaatagtttaacttgatttttgactctggngttcggatctattttaagatcgatggagttaattgcttcatgacagttcttatgaaacatgcttcnntatntccttgtgccaangtntcgnttacagatnttncnaaangaattnactctgcnaaatactgnaatgacnnntcnngtgngacntgttaggcgnaacgatanatttgngagntntnttccttttgtatngatttggnnttangatgcanganncnnattttcanccnagngtgnncatnaancctgacganaccnctanttntttttaanncctgtattaancacctagantgccccggngnccnaaataactnangncccacntcntntaaagaacttctgnnaaanntagttnagnccntccnggccnntaaantggggngatgnannaaaagncngaaaaccnntgtanccaccccntantggngcnnctnnnnctattnnntcnnnccgntnnctccntacatatcttnccctnaaatnctttgggcntcaacnaatccg

SEQ ID NO: 5635 - DNA, 747 bp, Homo sapiens
  misc_feature 1, 4, 5, 9, 13, 14, 16, 19, 31, 90, 202, 214, 234, 303, 450,558, 590, 593, 629, 640, 641, 705, 734, 737, 738, 739: n = A,T,C or G
nggnngttnatcnncntgncagctcttgttntttttgcaggatcccatcgattcgaattcggcacgagctcagtaacccaattactagtnccttttgaagagaccaggctgggaattggtagtaataataatagctgacatttaccaggggctacccacatgccaagcatcatgctaatcttgccaggtccttctgagtcantgtgaatggcangagcaccacatgttcctttntcttcagttcacacacattgagtgtcttcatgtgtaagtaacaacagagactgagggcatatgtattgngtaaaaaaaaattttgttactgggaaaatagccattactgggaaatagctttgttacagaaagtccttcatgtggctgggcacagtggctcacgcctggaatcccagcactttgggaggccaaggtgggtgggtcacctgaagtcangagtacaagaccagcctggccaacgtggtgaaactccgtctctactaaaaatacaaaaaaattagctgggcttggtggcatacacctgtgatcccatctactcgggangctgagggaggagaattgcttgaacccgggangcngacgttgtagtgcgccaaaattgtgcccttgcattncagcctaggcnngagagtgagactccgtctcaaaaaaaaaaaaaaggtgatttaattaaaaccagatgaacccttncatgatcacgtgctatgaattaaaacaanatnnnaaaaaact

SEQ ID NO: 5636 - DNA, 860 bp, Homo sapiens
  misc_feature 3, 7, 9, 12, 14, 15, 16, 23, 25, 28, 33, 36, 38, 40, 42,47, 56, 58, 61, 64, 70, 78, 94, 96, 98, 104, 107, 108, 116,129, 130, 132, 135, 137, 141, 147, 157, 172, 183, 211, 233,244, 263, 267, 271, 275, 278, 283, 289, 341, 344, 350: n = A,T,C or G
  misc_feature 371, 375, 407, 428, 435, 436, 446, 475, 477, 482, 484, 486,493, 504, 507, 510, 516, 537, 538, 553, 561, 563, 567, 572,578, 585, 587, 591, 596, 640, 660, 662, 676, 681, 689, 699,703, 724, 737, 738, 745, 756, 757, 769, 789, 792, 798: n = A,T,C or G
  misc_feature 806, 822, 824, 825, 841, 844, 845, 853, 858, 859, 860: n = A,T,C or G
ctncttntnttntnnnatttttnanttntttanatnantntntttantttggtgtngntcnttnttctancctacacnctctttctctatctanancncggggnttnncaaaaatntggctcttctatnntntcngnctcntctatnatacacccantggcgaatccacatncagggggtctncaccaaagttccaacctccaaagtgaangactccgtggaacagcaagggnaggtgaagaantaataaaagagaaagaaangaanaacngcanaanaaaangaaaanagaaaagaaagaactaaagttagaaaaccaccaggaaaactcaaggaatcanaancctaanaagcgcaaaaagggacaggangctnaccttgaggctggtggggaggaagtccctgangccaatggctctgcagggaanaggagcnngaagaagaancatctcaaggacagcgccagtgattgaanangcacncntnggcgcanggaataggaanccngangcactnggaatttgaaacacattctannaagaaaaagatgaanctcccaanancatnctganggccgngaaccanangacnatgantgcttcctgcaaaaggttaattcaactggtaatggaactatttnaaagcaaattctgaaaccangncccccagacaatgnaaatnaccattcnataaagcctnaggnaaaaaatgttttatgctccanttcttaccacaanntgacatnattgagccatnnaccatattcccnaatgatggaaacttccctangtncattcnttttaacnaagaaaattcaatccnannaaccccttaacctttnaannttatttanaaggnnn

SEQ ID NO: 5637 - DNA, 1222 bp, Homo sapiens
  misc_feature 2, 3, 4, 10, 15, 55, 72, 73, 79, 80, 81, 90, 92, 96, 97,102, 104, 116, 118, 119, 121, 124, 125, 126, 130, 131, 135,136, 138, 140, 141, 144, 145, 146, 147, 148, 149, 150, 152,153, 154, 156, 158, 159, 160, 161, 162, 163, 165, 168: n = A,T,C or G
  misc_feature 169, 175, 176, 178, 179, 181, 182, 183, 184, 186, 187, 189,190, 195, 196, 197, 198, 199, 205, 206, 214, 215, 216, 217,218, 219, 220, 224, 225, 226, 227, 231, 232, 233, 234, 237,238, 240, 242, 243, 244, 245, 248, 249, 250, 252, 253: n = A,T,C or G
  misc_feature 254, 255, 256, 257, 259, 265, 268, 270, 271, 273, 275, 276,278, 283, 284, 286, 287, 288, 293, 295, 296, 302, 304, 305,306, 307, 311, 317, 323, 327, 328, 329, 330, 331, 332, 340,344, 348, 352, 358, 360, 363, 370, 375, 382, 387, 389: n = A,T,C or G
  misc_feature 390, 393, 397, 400, 409, 413, 414, 415, 421, 424, 430, 433,434, 441, 444, 446, 447, 449, 458, 459, 462, 463, 468, 474,479, 480, 481, 486, 488, 490, 491, 492, 493, 497, 503, 504,505, 508, 509, 510, 511, 517, 524, 525, 526, 530, 531: n = A,T,C or G
  misc_feature 537, 540, 541, 548, 553, 555, 559, 561, 566, 567, 571, 575,581, 582, 583, 585, 589, 596, 600, 601, 602, 605, 607, 609,615, 618, 619, 623, 625, 636, 637, 644, 653, 654, 655, 656,657, 658, 663, 664, 666, 670, 671, 673, 674, 677, 679: n = A,T,C or G
  misc_feature 681, 682, 688, 689, 691, 697, 701, 703, 708, 723, 732, 740,750, 751, 759, 763, 764, 770, 772, 779, 786, 791, 804, 808,809, 811, 813, 816, 819, 820, 822, 824, 825, 829, 834, 841,843, 846, 852, 855, 856, 857, 859, 860, 861, 863, 868: n = A,T,C or G
gnnntttttnccctnaaaaaatgggcccttgggggtttttcccttaaaaattggncctttgggggttttccnnaaaatnnncctttgggntntaannaccgngnccgttttttcgngnnanaannngatnntctnntncnnctnnnnnnnannnancnnnnnntncanntctatnncnncnnnnannanntatcnnnnnactctnntcaattcnnnnnnnactnnnntatnnnnatnnancnnnntgnnnannnnnntntcatcntcncnnantnncnctatnncnnnatctnannctctcntnnnnatanacctgncataanactnnnnnncatagtcncttnacancttnttatancnctnatacacnatctnttctaantctantnnatnatanacntccatcatnattnnntacttncanaccccnctnnccctacnctnanncntcactcccnnccnnatctntctctnctatnnnatcantntnnnnccanccactnnnacnnnntactantctaccnnncttnnatctcnatnnatcatanccatncntccncnccacnnttcncctnttaacnnntntatntcaatanaatnnnctnancnattacntcnnctcncntcttcattttnnttatctnctcattaannnnnnctccnncntcanntnnccntntnntactcnncnatcccntaantnctccncaatcatactcatcntctccatanatactcanatcctatacnnactatcanctanntcttcnantatattnttcattnttacnatccctctctccntcanntntnaanacnncnanntacncttanatctatntntanatacantcnnntnnncncaatntcanatnttctatcatnctcntaannatcctnnntntnnntataatcctancnanccacannnnctccnntatntnnnnacacatntatacncnactnannttctcnntcctnatnacatancccacnctntncatacantcntcncatntcntnnnttntattnttcanctantaacatantnanantcgtactnnnnanncancactnccctcnttatattcatcnatctntacataccatctannnannnacnnttcacnnatncntctncttnaattacanncacnctcnntcatanntcgnntatatatcactctntncnanatccactntntctntnntctccncccg

SEQ ID NO: 5638 - DNA, 1068 bp, Homo sapiens
  misc_feature 3, 10, 20, 22, 25, 26, 28, 33, 35, 43, 45, 62, 75, 99, 104,154, 159, 168, 172, 174, 186, 216, 223, 245, 252, 253, 271,275, 285, 291, 297, 298, 306, 307, 329, 333, 352, 353, 366,371, 383, 399, 400, 410, 412, 413, 416, 423, 424, 425: n = A,T,C or G
  misc_feature 429, 431, 438, 450, 451, 454, 458, 460, 462, 465, 466, 467,468, 478, 490, 493, 495, 496, 498, 503, 515, 519, 521, 525,526, 527, 529, 532, 541, 545, 546, 547, 548, 555, 556, 559,561, 562, 570, 583, 586, 591, 594, 596, 598, 605, 609: n = A,T,C or G
  misc_feature 612, 617, 619, 630, 633, 644, 646, 651, 654, 655, 656, 659,661, 670, 671, 674, 675, 676, 679, 690, 701, 702, 703, 704,706, 711, 723, 724, 727, 731, 732, 740, 745, 751, 758, 769,770, 777, 778, 779, 783, 787, 790, 797, 804, 806, 809: n = A,T,C or G
  misc_feature 810, 816, 817, 821, 823, 830, 833, 836, 837, 839, 840, 844,848, 851, 852, 853, 859, 861, 866, 873, 877, 883, 886, 887,890, 894, 902, 904, 906, 907, 915, 916, 926, 930, 935, 936,938, 944, 950, 952, 954, 958, 961, 962, 963, 965, 966: n = A,T,C or G
  misc_feature 970, 973, 984, 985, 986, 990, 991, 992, 994, 996, 1005, 1010,1016, 1018, 1020, 1023, 1030, 1033, 1042, 1047, 1049, 1051,1052, 1055, 1062, 1064, 1066: n = A,T,C or G
ggngcctttnaaaatacccngnttnnanacgcntngttacacncnctagcttaaaagggggnggaaccctatggntgcattgactgtggcaaggccttnagccnagaagttttgccttgtagcacatcagggtatatcatacagggaaagactnccttngtatgtccngaangngggcaaccctgntcacagaagtcaggactcattagacatcangaaaatncactcaggagagaaaccctatnaatgcanngactgtgggaaagccttncttncaaagacaangctcantgtcannacagaacnnacacgggagagagaccctatgnctgngatgagtgtgagaaagctnncttctatatgtcntgccnttgttaaacatnagcagaatacactcannggaagaaacncnnggngattcannngaangnggaaatntcctgaccacanncanggtncntntcnnnnagttcctaantagaacaatggngcnanngnggtanaaaggcccctgntagnanatannntnaanaccttggtnggcnnnnatggatnnggncnngtggggtnaatactgatgtgnatntctcnggntnancgaccantatnttngcatntnttcctattggnagnaatacctactntntaatntcnnnatntnctgcggganntannnttntttagcatctnctatccataannnncnaaatngatcatcatatnntcnatgnnctcatctngtctnacactnttgggtngccatctgctnnagacatnnnactntaanctntaaattnatcgctnantannacccanngtgntnaccagcngtnacnncnngctnctcngtnnngtatantntcacnatcatantcantgaatntannganacgngcatcttntnannctgcctcnnactctatcanaatnaagtnncncgaggnactcanantnactntcnnntnnttcncanaatgtatcatnnnctcnnnanantattttgantgcanatcatngnanacntatgaanccnaatcatgtntattncnanngcnttacttntnancg

SEQ ID NO: 5639 - DNA, 816 bp, Homo sapiens; identical to SEQ ID NO: 580
  misc_feature 10, 22, 51, 52, 60, 61, 63, 69, 80, 92, 108, 111, 128, 160,163, 529, 534, 538, 559, 595, 597, 614, 654, 669, 675, 682,684, 686, 687, 698, 706, 713, 715, 716, 730, 739, 742, 751,759, 764, 793, 805, 807: n = A,T,C or G

SEQ ID NO: 5640 - DNA, 1094 bp, Homo sapiens
  misc_feature 2, 3, 4, 9, 12, 13, 14, 15, 16, 17, 18, 21, 22, 23, 25, 39,41, 43, 45, 52, 57, 62, 63, 64, 68, 69, 75, 77, 88, 94,98, 99, 102, 114, 116, 119, 138, 145, 148, 154, 156, 167,173, 188, 190, 191, 192, 202, 204, 210, 212, 215, 216, 218: n = A,T,C or G
  misc_feature 228, 232, 236, 246, 247, 250, 252, 254, 259, 264, 274, 277,287, 298, 315, 316, 319, 323, 333, 337, 343, 351, 353, 357,363, 368, 373, 374, 377, 378, 381, 383, 384, 388, 391, 403,408, 412, 414, 426, 430, 436, 437, 443, 444, 464, 468: n = A,T,C or G
  misc_feature 475, 482, 483, 485, 486, 488, 490, 491, 493, 496, 497, 503,510, 513, 517, 518, 521, 531, 535, 536, 538, 540, 542, 543,545, 548, 553, 556, 557, 558, 560, 564, 570, 575, 578, 579,583, 584, 586, 593, 616, 622, 623, 624, 628, 630, 631: n = A,T,C or G
  misc_feature 633, 644, 656, 664, 669, 670, 673, 675, 681, 688, 691, 701,704, 708, 725, 736, 738, 740, 741, 751, 752, 755, 756, 761,766, 770, 775, 776, 777, 781, 782, 783, 790, 792, 794, 799,801, 802, 806, 815, 824, 834, 837, 839, 842, 849, 850: n = A,T,C or G
  misc_feature 858, 859, 861, 867, 876, 878, 881, 897, 915, 919, 927, 929,931, 936, 937, 939, 940, 942, 945, 947, 950, 954, 955, 959,960, 963, 965, 966, 968, 969, 971, 972, 978, 991, 993, 995,997, 1000, 1005, 1008, 1009, 1010, 1015, 1018, 1019: n = A,T,C or G
  misc_feature 1034, 1035, 1036, 1041, 1042, 1046, 1050, 1055, 1056, 1060,1061, 1068, 1072, 1073, 1077, 1078, 1079, 1085, 1087, 1091,1092: n = A,T,C or G
cnnncaaanacnnnnnnnaannnanaacaacgggggcgncncnanttcaaanctggnaaacnnntccnncacagncnacgaacgaaanggcacnagcnngcnaggaaaccgccncngcncagcaaccgaaggccaggnaattttnaanatcggngngggaggacagngggggncaatatgggcgggantnnncttcaaacangnaaaccntnccnngnggcggggganaccncggncaccatggannaantncnacaanaccgnggggaagacnggntatgcaggcnccgccataaanccccccctactaaggcnncanggancaccaacagntggnggccancaaaagcntntaanaacaanacctnacaanntcnncancnntttngcntatcccaccacnggganacangncaacggtggacnctcnaacaannaaaatnngaaaaacaaatctccccaanaatnggggggngaaccanngnnangnnanctnnaaccanaccgtcntgnaacnngcnccaatacaangggnngnangnngncanaacangcnnngnaccngcacgnaaggnggnnggcnngnatcacancaaacagacaatatccacggcgnaccccnnncacncnntnaacgggacccngagtacacacangcacgaangcccnnccngncccacncccctgnaancgagaaaacnaangccnggatacaaaaaaccccnaaccagccggncntnnccccccaacnngannaaagnaacanaccncacannngccnnngacaaancncnacaananngggnaaacaaacnctatggganatccccctanggnangcngacccgnnaaacggannancacaanctaaacaancngtncacgccaaaaaaaacngcccaaggccccatcacngaanggaaaacncnanacggnnannanagncnccntaannaaannccncnncnngnncaatcncccattcgaaaancncncnctnccgcnaannnggaanacnntcaaaaccccccgannncgacnntatncagnaacannaaanntggtgtnaccnncccnnncctaananatcnncc

SEQ ID NO: 5641 - DNA, 930 bp, Homo sapiens
  misc_feature 17, 25, 31, 32, 389, 437, 438, 472, 485, 486, 489, 500, 510,513, 525, 542, 544, 570, 576, 578, 579, 582, 583, 590, 596,597, 607, 609, 611, 613, 621, 623, 625, 630, 633, 634, 635,636, 637, 638, 641, 650, 652, 655, 668, 678, 679: n = A,T,C or G
  misc_feature 680, 681, 682, 685, 687, 694, 695, 706, 707, 711, 712, 714,722, 728, 734, 743, 748, 753, 759, 761, 766, 771, 782, 785,787, 788, 809, 829, 830, 831, 833, 837, 842, 845, 849, 856,858, 860, 864, 868, 870, 887, 889, 892, 895, 897, 900: n = A,T,C or G
  misc_feature 902, 903, 905, 914, 918, 925: n = A,T,C or G
ttttgctaaccgctggnctactcgntctctnngcaggatcccatcgattcgaattcggcacgaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccanaatctacgtctaaactgcagaagtttacaagctggttcatggggcggnngcccgagtacacagaccccaaggtggtggctcanggtgaaggcccgnnaanggtgtgtttgnggcccaaccnacnccaatagctggngggcaacacagaatagntnctgtataataatagtctcattttcanagaaanannttnntattccnctcttnnttcctaatcncnantncttattantntntaccntcnnnnnnccncctcatttncnctntttcattttatcnttatcttatnnnnntcnancctactnntattactcctnncctnnantctctatncctacnaccttntaatacctncttantctanacttcncnctctntaccntctctctcatnctntnnctactctctccctctcttctnctccatattattcttctctnnnantctntcttnttntctnctattancntncctntctntntctactatatcatcatntnctntcnanctnanntntctatctcntacntactcanacaac

SEQ ID NO: 5642 - DNA, 801 bp, Homo sapiens
  misc_feature 7, 13, 16, 19, 25, 30, 35, 36, 43, 45, 60, 70, 72, 84, 94,97, 98, 107, 116, 122, 128, 132, 134, 136, 137, 142, 147,151, 155, 166, 175, 178, 179, 188, 190, 191, 192, 195, 197,199, 202, 204, 210, 215, 218, 222, 223, 233, 236, 253: n = A,T,C or G
  misc_feature 254, 260, 261, 263, 265, 267, 270, 274, 277, 283, 291, 302,307, 311, 316, 323, 332, 336, 337, 342, 349, 350, 359, 364,365, 367, 370, 375, 381, 401, 403, 405, 406, 411, 417, 418,426, 432, 446, 459, 466, 469, 472, 474, 478, 480, 488: n = A,T,C or G
  misc_feature 490, 498, 507, 515, 527, 528, 544, 546, 550, 568, 569, 585,593, 598, 601, 611, 614, 619, 625, 638, 640, 645, 647, 648,653, 654, 659, 662, 666, 667, 671, 678, 679, 683, 688, 698,702, 704, 710, 715, 716, 717, 729, 735, 750, 751, 752: n = A,T,C or G
  misc_feature 760, 761, 766, 767, 771, 776, 779, 781, 785, 786, 791, 792,801: n = A,T,C or G
aaaaagncaggcnacntgnagacanaagancccanngaagaancncaggaaaagcccacnccgaaggggnanacggacgagccnaggcaaaggncannaagaacagngatttacanacgatntgcccngaancncnnggggngaaancagnggcngggccaccagnaaagaaacnagnncgcccaggncnnngangnanacnanaaacgnaagangangagnnaggggggaancangacaggagaggcaaaannaaaagnnanananagnggcnagncggacngaagaaanaaacaaggggngaagnacangaacnaagaaanagcaaaganaacnnaaagngaacaannccagcgccnagcannanccnaggangcacanaaaacagcaccaagaagacngnannagcangagagnngaagaganggcgcncacggggacacacnaggcaaacgcganaagcagnacnggncnaggngncgcgaagnanaagagacncaaggggangagagcanaagggaacgggnngcaggaagaagacaangnaacncaggaacgaaaaaggganncagaaagccggagaanaacacggngaganagnaccaaaggcnaanaaggngacaangggcaagagacananaccangnnggacnnaagangcnacannaggnaaaacannagangaaanaggggaacangaangnaaaagngaaannngggggaaaagancaaacnaaacagaaaacgggnnnggaaaaannacaanngaanaacanggngncaannggaannaaaggggan

SEQ ID NO: 5643 - DNA, 813 bp, Homo sapiens
  misc_feature 2, 3, 4, 9, 12, 13, 14, 25, 31, 39, 42, 89, 92, 117, 177,180, 193, 201, 254, 261, 308, 403, 473, 540, 543, 600, 616,636, 659, 678, 706, 737, 765, 768, 775, 789, 801, 804: n = A,T,C or G
gnnnttttnaannncgttggtttcnatgtancatttacnagntctttttgcaggatcccatcgatcgcaggtccacagccgaggtcgancancggcacagcgaggtcggcagcggcncagcgaggtcggcagttggcacagcgaggtcggcagcggcagcgaaggtcggcagcggcncancgaggtcggcaancggcagcnaaggtcggcagcgggcccccgctgtgctcttccgcggactctgaatcatggcnaaccacnggccacgatggcgacctcggctcggcgcgaaagcggctgctcaaaanaggaagacatgactaaaagtggaattcgagaccagctaagaagtggatgtgacccccacgttcgacaccatgggcctgcgggaggacctgctgcnggcatctacgcttacggttttgaaaaaccatcagcaatccagcaacgagcaatcaagcagatcatcaaanggagagatgtcatcgcacagtctcagtccggccaggaaaaacagccaccttcagtatctcagtcctncantgtttgggatattcaagttcgtgaaactcaagctttgatcttggctccacaagaaanttggctgtgccagatncataaggggcttcttgcttntcggtgactacatgaatgtccantgccatgcctgcattgganggacccaatttttggccaaggacatcanggaacctgggtttacggacaacatgttttcncgggcacttccaaggccgtgtttttganatnatccttncaaaaaaccctaanggacacctgctnttnaaaaatttg

SEQ ID NO: 5644 - DNA, 776 bp, Homo sapiens
  misc_feature 3, 7, 20, 24, 31, 36, 44, 47, 49, 68, 84, 87, 107, 116, 124,125, 129, 136, 138, 139, 142, 145, 151, 155, 159, 161, 163,168, 188, 189, 194, 197, 198, 199, 201, 207, 208, 209, 210,212, 213, 215, 218, 222, 226, 234, 237, 239, 245: n = A,T,C or G
  misc_feature 246, 247, 249, 251, 253, 255, 256, 264, 276, 283, 288, 289,293, 296, 299, 301, 305, 306, 313, 314, 323, 325, 326, 328,329, 333, 343, 356, 367, 368, 380, 386, 397, 398, 414, 430,436, 439, 448, 451, 461, 464, 465, 468, 473, 476, 478: n = A,T,C or G
  misc_feature 491, 502, 510, 511, 513, 516, 518, 520, 531, 543, 544, 548,550, 553, 556, 563, 564, 567, 569, 574, 575, 577, 584, 585,587, 589, 594, 599, 605, 606, 610, 611, 616, 625, 626, 642,647, 650, 656, 658, 662, 667, 672, 674, 677, 679, 681: n = A,T,C or G
  misc_feature 689, 693, 698, 702, 708, 715, 717, 718, 723, 731, 738, 740,741, 746, 748, 752, 759, 762, 764, 766, 773: n = A,T,C or G
ttnaatncttggcttttcanaatngctggangactngttctttntgnangaccgcacgagcacgaatncggcacgaggtcactntgnaacccagactgggagtgcancggtgtggncatagggnnctgngcctggnanngtntgntcgagntgtnatcncnantttgnttttgggtctgtagcttaannatgcngannnangatgcnnnnanngnttntgtnaganatggggtntancnagtttnnncnancngnnttcaattncatgggctcaantgaaccnctgcnntggnctnctnantatnngggactnncagacatgngnnannagtnctggtggcanatctcaatattanaggtaatatgnnatagtgatatcnatgacngtaccatttgnntcaaaatgtgaaaganataccgctgaagttantatgtnctnccttccaantcnagccgccatntcnntcnactcngcnantatgtcgactcanaatgaatgatngacatttnngntantncngcatcctatcnagtgctattatnnctananatntcnataattnnctngnccctnnancctacanncntngtcgnatgtntatccnncttnntgganctttgaaannttcgatagggggaacntgatnagngcagtntnacanaatgnttgcnanttntnantcggaaanatcnaattngggnagctgntaaacancnngggcntacctttntaatgtncnngggtntntaantcaaccnggntncngaaaaanaac

SEQ ID NO: 5645 - DNA, 720 bp, Homo sapiens
  misc_feature 2, 3, 4, 5, 6, 11, 14, 20, 37: n = A,T,C or G
tnnnnnttttnaantcaatnctggctctcgttctttntgcaggatccctcgattcgaattcggcacgagatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaaattgtccaatcacaagaaaataatggcaataattatcaaaacttt

SEQ ID NO: 5646 - DNA, 1117 bp, Homo sapiens
  misc_feature 3, 4, 6, 7, 8, 9, 10, 11, 13, 15, 19, 21, 25, 30, 33, 35,37, 38, 39, 43, 45, 47, 49, 50, 51, 52, 54, 55, 57, 60,62, 64, 69, 72, 76, 79, 84, 88, 96, 98, 100, 101, 104, 130,131, 201, 203, 204, 208, 363, 369, 377, 394, 401, 409, 410: n = A,T,C or G
  misc_feature 414, 420, 424, 435, 456, 459, 460, 468, 470, 471, 480, 481,484, 485, 486, 488, 498, 507, 509, 510, 511, 513, 516, 524,528, 533, 535, 536, 541, 544, 546, 547, 551, 552, 560, 562,576, 580, 581, 585, 586, 590, 597, 600, 601, 605, 612: n = A,T,C or G
  misc_feature 624, 627, 631, 632, 639, 643, 644, 647, 650, 652, 654, 655,658, 660, 664, 666, 669, 670, 673, 674, 676, 677, 687, 690,698, 699, 711, 712, 715, 719, 723, 724, 727, 729, 732, 733,734, 739, 751, 752, 754, 761, 769, 773, 776, 778, 782: n = A,T,C or G
  misc_feature 783, 784, 796, 798, 801, 806, 810, 814, 816, 818, 824, 825,835, 843, 846, 848, 850, 852, 853, 855, 861, 864, 867, 872,875, 877, 878, 882, 895, 899, 900, 901, 905, 910, 919, 920,923, 926, 930, 939, 940, 941, 945, 952, 955, 957, 958: n = A,T,C or G
  misc_feature 959, 960, 961, 965, 967, 969, 975, 980, 981, 982, 983, 988,989, 990, 997, 998, 1005, 1017, 1018, 1025, 1028, 1031,1034, 1035, 1046, 1051, 1061, 1065, 1070, 1074, 1075, 1079,1080, 1082, 1089, 1097, 1107, 1109, 1111, 1117: n = A,T,C or G
atnncnnnnnnancncatntnctantcctnacnantnnncttncncntnnnntnntnctnananttggnatntagnggnattcnaatncccagctntngnnctntttgcaggatcccatcgattcgaatnnggcacgaggaggaattcagctatcagctctcttcatgagtggagtagacatggccttgtttgcaaatgangnntgcngacaaaccaatcccctgggaacactgttgtccttggatgtattttgatgggaagctcttccaatccaaactcctcaaagccagccgggaaaagaccccactcattgacctctgtgatggtcaagctgatcaggctgccaaggtagagaagatgcnccatancgtcctcnaaagggctcagcttctncaggcanagccacanncttncctttnccgncgtcacctgcnctgctcttttacccctgtctntgnntacccccntnnactttttannccnnntnccaacccctnttaatggcncnnngncantaatgctntttncattncnnttctnttngnncttnntctcctangncccccctcattatngcgnnaaanncacngactatnttnntctnatgggcntccctttaaccnccnctgnncacactnctcnntcntantntnnatntntctncnatnntanncnnctcaatatcntcnccatcacnntatctatcctcnngtncctntctnnctnanttnnnatcanattttctatttnncnactcatntctctacnatcntantntatnnntatcaatctcanantanactantatntcantntnctacannatataatatnctcttttnatntntntnntnatcatntanatnatctntcntnnatanctacatctctctntctnnncatntcatntagatacanntanatntagntaattatannncttnttcttanttncnnnnnttcncntntcatcnctctnnnncgtannnctctccnntcattcnattcatacttcnnattgatnatncantannccatcataatntcacntccctcatancttnttctncaanntatnnanattctcnatatttcnttatctatanancnttgccn

SEQ ID NO: 5647 - DNA, 781 bp, Homo sapiens
  misc_feature 8, 10, 18, 48, 52, 59, 63, 64, 94, 113, 115, 123, 128, 131,145, 152, 163, 168, 190, 192, 211, 231, 233, 234, 235, 239,242, 264, 286, 297, 299, 303, 309, 313, 323, 327, 331, 337,342, 343, 346, 347, 348, 349, 350, 353, 355, 368, 370: n = A,T,C or G
  misc_feature 376, 382, 384, 388, 389, 398, 399, 405, 406, 408, 409, 410,412, 414, 415, 416, 417, 421, 424, 438, 457, 474, 482, 483,486, 488, 494, 502, 514, 518, 530, 531, 536, 542, 554, 555,562, 582, 591, 623, 630, 631, 632, 639, 656, 670, 679: n = A,T,C or G
  misc_feature 690, 703, 719, 731, 733, 749, 751, 752, 756, 757, 758, 761,767, 769, 771, 772, 774, 776, 777, 780: n = A,T,C or G
ttcaaatngnaggctctngttctttttgcaggatcccatcgattcggnagantcccatntctnnctgctgacgagggacctgctttggtgagtncgggaaggcccagggagtngnggcatgcnggctnctnattcactatggggnttcgccntggacacgtantcaantgcgcatgctgctgcccatgtntncctgccccacttcacccanttgggggctgctcaagggtngnnnggcntcngtggctggaggccagtatttanacaaggctctgtacatgacacncaactgtgctnanagtnccttcnctcngactacaccnatgntttnacagtnccctnntgnnnnntcntnttactacagtgcnanaacccnaatgancntttnnttcctgctnnatgccnncnnnantnnnngacnttntgttaatgttaacnaagtgtgtacactttaaanccacatattgtatggtntcctgtannatnangtgccngaacatgnacatttcgatanccanagattagattannggttntcatanggctgggggaannggcatancttagtgattggtaatgatntgggatttnttttgggaatgaatgaaaatattctaaaattngttgggnnnttatccnaattctacgaaatattnttaaaaaacccacntgaatttgnctactttaagnagagtgaaatttnatgtccttgttcctcnaattaagcttgngnaaaaagatcgtaaaancnngatnnnaantttctntnanntngnnctnt

SEQ ID NO: 5648 - DNA, 753 bp, Homo sapiens
  misc_feature 62, 65, 70, 72, 74, 78, 80, 81, 100, 101, 113, 120, 124,130, 132, 139, 141, 143, 144, 151, 155, 160, 164, 182, 186,206, 208, 210, 220, 237, 252, 255, 261, 265, 267, 302, 310,318, 321, 323, 325, 332, 336, 338, 339, 342, 348, 349: n = A,T,C or G
  misc_feature 354, 360, 363, 365, 379, 380, 384, 386, 388, 396, 411, 412,415, 417, 418, 426, 433, 437, 441, 444, 458, 460, 470, 473,495, 498, 500, 507, 509, 512, 513, 519, 520, 521, 530, 531,535, 538, 544, 546, 561, 576, 578, 590, 591, 608, 609: n = A,T,C or G
  misc_feature 614, 619, 631, 635, 642, 656, 657, 678, 679, 696, 707, 711,718, 720, 727, 734, 738, 743, 744, 748: n = A,T,C or G
aagctcttgttctttttgcaggatcccatcgattcgaattcggcacgagaaggctgagacanganaatgncntnaatngnngaggcagagcttgcagtcnnttcgagatcacnccactgnactncaaccngngagacanantnngactccntctnatacnatgngaaccctaaaatatgggntttntgcacattccagatctcaanancntgattctaantgaaagatggcaatatnccatcagaccaggtnttntctagntccntnttacgaaatgtccacaaatggcaggatcttcagantcctagtnactgctantgntncnaggaatntttntnnggngactannatgtnctaaanctnantggaggtgatggtnnaacnantnggtcactncactaagaatcattnnatngnnactctatntgggcanatantatngcnaatgtaccttaatnanatcatgcttnaangtcaattaatccactcatgaanttnancctctananctnnagtgannngtattacgnncatnccnacttgntnagatccttggatgantatcggactaacccntnatcttatgcagnntacaaaaatgccttttnnagggnaaatntgcgatgctatntgcnttatccntaaccatttgtacnntcccatttaacagggttaccnnccatccaattggcaatngattttatggnttcntggtttncnggggttngatttgngaangtttnnttantttcc

SEQ ID NO: 5649 - DNA, 740 bp, Homo sapiens
  misc_feature 5, 6, 7, 8, 9, 14, 80, 83, 90, 95, 107, 110, 113, 123, 124,145, 149, 150, 180, 193, 203, 223, 250, 252, 260, 264, 270,282, 287, 308, 314, 339, 344, 390, 405, 424, 453, 475, 512,521, 559, 605, 624, 628, 641, 658, 671, 692, 721, 725: n = A,T,C or G
  misc_feature 734: n = A,T,C or G
agggnnnnnttttnagatacagctacttgttctttttgcaggatcccatcgattcgaattcggcacgaggtttgatcatnggncaaggtnctggngagaactgcctntgnggntagctgattnnggggtccttcatatgaacganctgnntggagcactcacaggactcacccgggtacnaagattccaacangatgatgctnacatattctgtgccatggancagattgaagatgaaataaaaggttgntnggattttntacntacggntatagcgtattnggatnttcttttaaactaaacctttntactcncccggaaaaattccttggagatatngaagnatgggatcaagctgagaaacaacttgaaaacagtctgaatgaattnggtgaaaagtggganttaaactctggagatgganctttctatggcccaaagattgacatacanattaaagatgcaattgggcggnaccaccagtgtgcaaccatccagctggatttccagtngcccattanatttaatcttacttatgtaagccatgatggtgatgatnagaaaaggccagtgattgttcattgagccatcttgggatcagtggnaagaatgattgctatgctnacangaaaactattggnggcaaatgggccttttngctgtccctttgncaggtaatggtagttccagtnggacccaactgtgatgaatttcccaaaangacnacaccattncacgat

SEQ ID NO: 5650 - DNA, 824 bp, Homo sapiens
  misc_feature 2, 4, 25, 54, 58, 83, 85, 97, 98, 99, 100, 101, 108, 109,116, 129, 133, 135, 137, 139, 149, 152, 153, 170, 173, 177,178, 184, 189, 195, 207, 212, 242, 243, 244, 246, 248, 249,257, 267, 269, 274, 276, 280, 284, 292, 293, 296, 305: n = A,T,C or G
  misc_feature 308, 316, 320, 324, 336, 337, 342, 353, 357, 363, 364, 366,387, 392, 394, 397, 415, 419, 431, 432, 433, 447, 454, 456,465, 469, 471, 487, 489, 490, 496, 504, 512, 520, 527, 534,541, 543, 553, 560, 565, 567, 572, 580, 584, 585, 587: n = A,T,C or G
  misc_feature 591, 598, 609, 612, 618, 627, 639, 647, 648, 649, 652, 653,659, 666, 668, 674, 676, 679, 680, 686, 687, 695, 699, 707,713, 725, 728, 738, 739, 741, 744, 746, 747, 751, 753, 761,765, 771, 772, 773, 778, 780, 781, 784, 786, 789, 798: n = A,T,C or G
  misc_feature 801, 804, 805, 811, 812, 817, 822, 823: n = A,T,C or G
gncnctttcaacttcgccccttttnaaacccgttgttcaaatcctcgtttcaancccntctgcaggatcccatcgattcgaancngcacgagggggnnnnncgtggcnnattgcgngcagtacccttcnagcncngngnaaagtgcagncanncgtaacacatgcggcanacngcanngagcanaatgntaatgnccacttcttgantcatnccagaactcccttaagcccacaagtttgtnnngngnnaggtcaantctaggaacncngccgngnaacnggtntctcaatnnagncatccttanttnctgcatanacangagngttcttaaaacnnctccngtaaagcaagncatntctganntncctgaggatcattgctcccgnatacngntgntggggtgagccttcaggnagangggaacagaatnnngtactagggtcganagtcaananactaaggcncttnancaacatctcagagcanannatttgnggagcccntggaacgntactgggnaatttantcagtgngcatttntnaagactgggnccagggntggantnatctnttggcgangggnncntagngcctcancacaacactgngcnagcccnggacttagnaaacccctgcanaaactggnnnaannggcctnttaaaantnccccanangtnnaccccnnaagaagcncggnaagccccnaaactnccaaaccaaccnctntctttcctcnncnaantnnacancntgggggtntgcnttggtnnnaaatngnnccnanaantgcaccagntcnacnntagtcnnggggnacggnnc

SEQ ID NO: 5651 - DNA, 745 bp, Homo sapiens
  misc_feature 2, 362, 611, 614, 634, 678, 689, 708, 736, 744, 745: n = A,T,C or G
tntagatacagctcttgttctttttgcaggatccctcgattcgaattcggcacgagattcctttcatggtacagtatttaccccaagtcatgattaaatatctgtttatatatttctttattggattatttgtttatttttctctctctagactgcaagctccttgagcagaccatgtttattttgtctaccacaggtgctcaataaatatttttgactatttattacatgagaaggtttccatgcaaacacccattgaatacgattgaacttgaaccctaagagatgggctgtgacctttgttgccctcaaactaatcaaaggggagtgatattcaccatccagaatctagaataacttanaccttgtgggccaggagctagctacccatatgataatacaagagctctcagagaaatcatggaagttttgagcaatctctctctccctttgctaatttacttttcaaaactgaagtataatgggaataacttccccacctctcaaatgtcagcatgctctgaaatttcatgttctctcaggcgagccgattcatgttttccattccaccctcttctactgggctctctatgccctttctacagtctcgnttnttttaccctgggcccttttncctttggggctcttgattgaaaaaattgctgaactgtagctttnggaagtttaancttttgagaacccgtagantgatttcagttcttaggaaaaataaaancccgttgnn

SEQ ID NO: 5652 - DNA, 713 bp, Homo sapiens
  misc_feature 2, 3, 4, 5, 9, 14, 17, 641: n = A,T,C or G
tnnnncttnaaatnganagctacttgttctttttgcaggatcccatcgattcgctttttaacaatctggggctgtgttgcttctatgcccagcagtatgatatgactctgacctcatttgaacgtgccctttctttggctgaaaatgaagaagaggcagctgatgtctggtacaacttgggacatgtagctgtggagatacaaatttggcccatcagtgcttcaggctggctctggtcaacaacaacaaccacgccgaggcctacaacaacctggctgtgctggagatgcggaagggccacgttgaacaggcaagggcactattacaaactgcatcatcattagcaccccatatgtatgaaccgcattttaattttgcaacaatctctgataagattggagatctgcagagaagctatgttgctgcgcagaagtctgaagcagcatttccagaccatgtggacacacaacatttaattaaacaattaaggcagcattttgctatgctctgattgttccttagaccacatatgttcttatgaagcagcattatgcaaggggaaaaaagcactatgtctgtgtatgtatgtatatagtgtaatacgtatattttaacaaacctgtccttgatattaagttaangtgacacataagggtgacacagaatgtgtaatgcaaatttcatagtaatagtaactttataaaataatatta

SEQ ID NO: 5653 - DNA, 765 bp, Homo sapiens
  misc_feature 2, 3, 6, 7, 8, 9, 10, 11, 12, 13, 18, 506, 629, 682, 690,710, 720, 749: n = A,T,C or G
gnnggnnnnnnnnttgcnaatgctaggctacttgttctttttgcaggatcccatcgattcgaattcggcacgaggtggagctcacctatttggaatatggggcatttgttttttccactgcaatgatttcagtctggtttcatcatgttggaattcgatcacaccattttcaaacaatgttaacatagtccagcttttgtttttctcatctcttctgagaggagactcactgtttctgtctgaggaagctcataccctcggcaaaacatcaggacaaataaagagaaatgggggtacgcattcccaacagaagcagtgtgttatttgttttaaaactctgaacagagatcttggaaatctttcaaaaagaccattgaattcttcattggctgagaacgacgttttaaaatgtcttaaataaggctttgtttgcattgtttgagttcaaggggccttattattgaatggaattgcacaagcctttctttgtgcaatcaaaccattgntattggtagttctgtaaaggaaactgtggaatcgaattggcagtggagtcataaatctatttactgagtgtggcttccaagaaaatgttgcaattcaaaatgcctaaagtctgtgatttattnggagatttgggagattcttaaataatattttttaaaaaacttccatgccaacnttcttggnttaaatggtttggcaacctnccccttgatnaaaaaaattaaaaccaggcccaaatggtnctcaaatttaaaatct

SEQ ID NO: 5654 - DNA, 800 bp, Homo sapiens
  misc_feature 3, 5, 10, 14, 15, 17, 18, 21, 22, 23, 24, 28, 29, 32, 43,45, 47, 62, 70, 78, 82, 89, 92, 95, 103, 111, 113, 116,118, 128, 132, 140, 145, 153, 156, 158, 162, 169, 175, 185,186, 220, 228, 234, 235, 250, 267, 268, 271, 272, 273, 296: n = A,T,C or G
  misc_feature 308, 313, 329, 338, 339, 342, 363, 399, 406, 411, 423, 425,427, 428, 432, 445, 454, 457, 463, 469, 474, 475, 480, 483,491, 494, 499, 505, 507, 513, 522, 538, 539, 543, 547, 551,555, 561, 566, 567, 576, 579, 582, 589, 591, 592, 597: n = A,T,C or G
  misc_feature 605, 607, 611, 617, 619, 626, 641, 654, 667, 671, 683, 689,699, 700, 705, 720, 721, 722, 724, 738, 739, 743, 751, 752,754, 759, 760, 768, 770, 771, 783, 785, 786, 791, 792, 793,794, 799: n = A,T,C or G
aananggccnggcnncnnggnnnngccnncgnaagccctttgnangnaacccctctgggaangcccccancggcggancccngcgccgnggnacncggcacgnggcagacnanacnanaggttgacgngccnttttcgancaggngacgcacnacncnggcnggggganccccangccgggcagnncggccgggggcccggccacgaagaacgcgggccngggcgccncgaccnnggccgcagataccancaacgggcagggggcgnnctnnnggcccagcaagaagggcgaaaangaggccgacggntgccnggcgcggcaccacgantggcacccnngancggggacacgcgagagagcangtgggggccgcgacacaggggagacggcggagccgngggacanggggngagaaccacagncncnnagcncgccagcgccggnaacagggcnggnctccangcccgnaggcnncgacncgngcaaaacngcnggccnaccggncnccacantgaaagacnggaggagaacgggganngaangacngggngcangagggntgagnnggccaacanggngcnaacaaangnnccacnacgcccgngngganggcagngncagcggnggagaaggaggaccncaaaggcgacggngcagggacgcacngggnaaaacccccaanaggcanggaggggacnnggcgnaagggccggggaggnnngnaaggggggcccggnngccngggccccnngnacccnnaaggcccncnngggggggcaaananngcccnnnngaacna

SEQ ID NO: 5655 - DNA, 741 bp, Homo sapiens
  misc_feature 1: n = A,T,C or G
ngttgatcaagctcttgttctttttgcaggatcccatcgattcgaattcggcacgagcacagacccagaacctgctatgcggaacaaggctgatcagcaacttgtggaaatagacaaaaaatatgctggattcattcatatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcaaaaacagacgtgactatgctcttgtatatagcagacaatctagcctgttttccataccagacacaggaagagccgttgtttataatgcatcatatagacattacactctcagtttctggtagtaacctactgcagtcattcaaggagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgttgccagaaaattcagctcctttaatcgaatttgcaaatgtgtccaaggtattttattacttctcatgttaaaacaacatttgaagaatc

SEQ ID NO: 5656 - DNA, 817 bp, Homo sapiens
  misc_feature 5, 15, 16, 21, 49, 57, 63, 72, 82, 83, 84, 92, 112, 115,119, 211, 217, 245, 253, 260, 272, 273, 275, 290, 303, 305,309, 312, 329, 334, 335, 337, 345, 346, 350, 353, 364, 369,372, 381, 384, 390, 391, 393, 398, 403, 410, 418, 423: n = A,T,C or G
  misc_feature 426, 440, 443, 445, 450, 456, 457, 459, 462, 467, 470, 473,475, 476, 483, 487, 490, 492, 495, 498, 517, 522, 523, 527,548, 556, 563, 565, 571, 577, 580, 583, 588, 597, 600, 603,615, 618, 622, 623, 625, 634, 635, 643, 648, 651, 652: n = A,T,C or G
  misc_feature 660, 665, 670, 674, 677, 682, 688, 689, 690, 699, 716, 719,734, 739, 740, 741, 750, 753, 759, 763, 768, 769, 770, 772,773, 778, 780, 782, 785, 796, 802, 810, 811: n = A,T,C or G
aaatntacagtttcnngaccnttgggcaggcatcccatcgattcgaatncggcacgnaggatntactggccnattggaatcnnnaacctganttagaaaggctcaacgagancangctntcagggctgctaaggaagcaaaaaaggctaagcaagcatctaaaaagactgcaatggctgctgctaaggcacctacaaaggcagcacctacncaaaanattgtgaagcctgtgaaagtttcaggtntcaatgtntactcangatggaatgatnnangcatctggctcacgntgaagggctcgcntnaccnatnacactgtcgtcctgcancacanncncagcatgnntgtnctntgcttcaaagnctganaanctcttcatntcnatttgnntnacacnctgcntgacctngccctctnatacnacntgtttctaacccgnacntnttccntctatnntnttntcctngcnaangnncatatgngccnagncngcncgngcctcacatctcgtgctcntggcnncttntgctgcctgaaactcccttgncttacgtntgtctcntngggtangccctntcnctntttcnagacttggntcnaangtgtacaacatntantgtnnangcctttctnnaggatcanctaantgnntggacacnattantaagncttnctnttaantacttnnnattcaattngctccttcatacattcntgntaaattgttccctanctggnnnagcaattanatngcattnttantagtnnngnntcccntntntgnttaatgcctcncttatngggcggtnngggtcg

SEQ ID NO: 5657 - DNA, 1359 bp, Homo sapiens
  misc_feature 3, 5, 6, 11, 14, 15, 19, 24, 30, 34, 35, 47, 52, 58, 61,68, 77, 80, 82, 90, 93, 95, 96, 99, 109, 116, 117, 118,122, 128, 133, 143, 144, 145, 146, 151, 161, 162, 170, 172,175, 176, 181, 182, 186, 187, 189, 192, 193, 198, 202, 206: n = A,T,C or G
  misc_feature 207, 208, 209, 212, 213, 215, 218, 221, 223, 224, 225, 226,228, 229, 233, 241, 243, 254, 258, 262, 266, 268, 269, 272,276, 279, 285, 287, 288, 292, 293, 299, 300, 301, 303, 308,309, 310, 311, 316, 318, 319, 325, 326, 328, 330, 333: n = A,T,C or G
  misc_feature 336, 337, 338, 339, 342, 345, 346, 348, 354, 363, 364, 365,366, 367, 368, 371, 383, 385, 386, 390, 392, 393, 396, 399,400, 402, 403, 406, 407, 408, 412, 414, 415, 417, 418, 419,425, 428, 429, 430, 431, 438, 439, 445, 446, 448, 449: n = A,T,C or G
  misc_feature 456, 463, 468, 469, 472, 478, 479, 480, 497, 503, 505, 510,511, 512, 513, 514, 515, 517, 518, 519, 523, 531, 532, 536,537, 538, 539, 541, 545, 546, 551, 556, 557, 559, 560, 565,567, 569, 577, 584, 589, 597, 599, 600, 602, 603, 604: n = A,T,C or G
  misc_feature 606, 608, 609, 610, 614, 621, 624, 626, 629, 640, 644, 646,649, 651, 656, 661, 663, 664, 667, 675, 679, 682, 683, 684,686, 687, 691, 697, 699, 706, 708, 712, 717, 721, 723, 724,725, 726, 731, 732, 735, 739, 746, 759, 765, 766, 768: n = A,T,C or G
  misc_feature 772, 773, 779, 781, 784, 785, 786, 787, 793, 802, 808, 816,817, 820, 821, 830, 838, 843, 845, 850, 854, 859, 865, 870,871, 880, 886, 895, 897, 902, 904, 908, 911, 919, 926, 939,942, 943, 948, 961, 966, 967, 978, 979, 983, 989, 993: n = A,T,C or G
ttngnnaaaantcnnctanaatcnactttntggnnatacttcggtcntatanctaganganaaggggnatcccccantcngnatctcggnacntnntangctaatcatnagctatnnnattntttacncatgnattctactannnntcatntataataacnncctaaatnantcnnaatannaagnntnctnnggganatantctnnnnatnntngantcnannnnanntatntcaattancnccataactaanatantatntatntnnatnttanttntactantnnatannacttannnantactnnnnatacnannatatannananacnacnnnnttnttnntntttctntaaatcaannnnnntcntatattactttncnnattntnnatnatnntnnatnnnatananncnnnttattntcnnnnatattcnntatttnnannataatcnctaatcnaatannatnataacnnncctatcatacaataagnaatacnantcctnnnnnncnnnctanctatcttnnttcnnnntnatannttttntgatnncnnatcantntnaatacctntatactnatatnttatcatntnnannntnannncaantatattnatnanacncaaactactcnactntntcnanttaancaaananntantccatatntctncannncnntgantattananagatctntnactntatanccanannnnattgnncanatanatatcantactacatataantctacnntnactnntaactnanaannnnactatnactcgattntctatncacttatnncannactactacncataacancagtntntcgcntacntatancgagtnatctnnttttaaatntatatnacatactcnanaatancnatcnatnattactanacatatnatcaactatatangtnnagtanaaatcatcttttnaattnntaactaacagnntatnaactanatgnatatnaatacatanantatncaaactcntnnctcacancgttataaaataaccntataanattgntntatacagnanatacttatnaacttngnattntatatntcncntctaannataccattataatgcnatnacactatntaatactatanangctanatcgtnnnatgnntctcncncttatntacnactgcgantcannnncntnttatcgntctcatncgattntaccnancatanatatacccatattatantantntgtnannctntatatatntatatnatactnannttngnnatntcatatntnantctcncagatnntacanntntnatantatnaatgcctatantacatncg

SEQ ID NO: 5658 - DNA, 858 bp, Homo sapiens
  misc_feature 17, 29, 36, 39, 40, 43, 48, 49, 50, 51, 53, 54, 59, 61, 67,70, 79, 80, 92, 94, 102, 105, 109, 114, 128, 130, 133, 137,138, 143, 148, 149, 156, 168, 172, 180, 181, 186, 192, 193,200, 201, 207, 220, 228, 234, 235, 237, 239, 244, 246: n = A,T,C or G
  misc_feature 247, 263, 266, 268, 270, 272, 274, 289, 297, 300, 301, 305,307, 308, 315, 319, 321, 325, 328, 332, 333, 336, 339, 340,341, 343, 345, 349, 351, 371, 373, 375, 379, 391, 404, 418,422, 425, 430, 441, 446, 447, 448, 452, 457, 475, 486: n = A,T,C or G
  misc_feature 492, 493, 505, 507, 512, 513, 517, 519, 520, 529, 549, 568,569, 571, 572, 583, 591, 596, 608, 613, 616, 627, 637, 638,646, 654, 665, 675, 679, 682, 695, 703, 711, 717, 729, 732,733, 740, 745, 753, 756, 760, 765, 777, 787, 791, 802: n = A,T,C or G
  misc_feature 810, 821, 830, 834, 843, 845, 850, 851, 853, 857: n = A,T,C or G
cttgaattcccctaatnaaaccgtttggnaagcccnatnnctntaggnnnncnntgcgntnacgatncgncacgagggnnccactgaccacnantatgtcgnacntttnacaanggcctgaactaacntnaanaatnncaaancatcnnaacggancggccctgcctnaacngacgacgnntcccnttgagnnatagccnngccccnacttaactgagtnattaaccntgtatnntntncttcngnnggctcagaagctgatngantnancncnatcacgaccatcgancttgctcnccnnagancnncccagtnaggntnattnagnattnnctnccnnnancntatnanaatggccgctcccttgatcnancnatcngtgactctcatntactggactcatnccacctgcacccangcgnatntaaanatccccatagntcacnnnaatnataanacataaattaggatacanacctgattganatgttnnagctgaacaggntntaccnnctgnannctcttgggngttaactatggatatgaacntcactttgaaaactggganncnnaacggggattncttaaatnccttnttgctataggcnaatanttnccgggagaggntggagtatcnnggatgaancaattcanctttactgaanaaagtgggcncggnctngaatccatagggnaaaaccanttgttaanattatngggttccaacgnaanncctgagntaacnttccaaanggnttgnaagantttgggaaggcntgaatgggancaangggggctcccnatccaaanaaattgtcaantttcaagtncctnggccctttntnaaacnntngaant

SEQ ID NO: 5659 - DNA, 716 bp, Homo sapiens; identical to SEQ ID NO: 5632
  misc_feature 3, 4, 5, 11, 15, 21, 22, 70, 636, 642, 657, 671, 714: n = A,T,C or G

SEQ ID NO: 5660 - DNA, 767 bp, Homo sapiens
  misc_feature 1, 4, 6, 14, 18, 44, 49, 52, 56, 58, 60, 63, 68, 72, 73,93, 103, 110, 115, 118, 120, 126, 127, 136, 137, 144, 154,157, 160, 163, 172, 174, 177, 187, 188, 194, 200, 201, 207,211, 216, 218, 220, 221, 222, 228, 247, 256, 266, 274: n = A,T,C or G
  misc_feature 280, 281, 286, 287, 289, 301, 307, 311, 323, 328, 331, 338,339, 342, 347, 348, 349, 354, 355, 358, 364, 366, 369, 373,374, 375, 381, 399, 401, 404, 406, 413, 415, 417, 418, 434,436, 450, 452, 454, 466, 470, 485, 486, 492, 494, 496: n = A,T,C or G
  misc_feature 499, 503, 516, 518, 519, 532, 533, 539, 552, 553, 560, 565,566, 575, 580, 581, 603, 612, 618, 620, 623, 632, 633, 634,637, 640, 645, 649, 656, 666, 674, 678, 689, 692, 707, 712,716, 723, 728, 734, 737, 739, 751, 752, 757, 765: n = A,T,C or G
naancnatagttcntgtnctttttgcaggatccctcgattcgantgcgnctnaagnancngcncaggnctannctcaccccattactggctgntgttctatgnaggtctnatganggnanctgacnnagaccgtgnnagtaacnttggactctnctncantgnactaagaananacnaatgtgggcnngccatntgcccnnctcgtntgancacancnannnaagagnctccagcatggcaattgcnattcacccngaatgctgtncatgaagngaactnngttcnngngacggcattccnacctgngccnatgcccatgacnaggantcnactgganntcnagaannntgctnntgngcctcntnaanggcnnntgtatngctcaccatggagccctngnggncnttggacntnanntactatgacaggccanancactgactgaccancntngatgacggctcntgtntacctatgaattganntgcatnananctngagngatcaaagttacnanntggtacacctctnnctcagngatttctcaggtnnctcgatntcaanncttaatatntacanngctaattgcacttagaccctgncacgttctngatgtnanacntccttgacnnnatngtnacatntttnttcatgncttaaaagtnaattggtngcanagtttctttcnatnccggatgctctgctnttacncaangatacgngattnaatgtnaangntcgtcaggaagnntttantgaacttnct

SEQ ID NO: 5661 - DNA, 1154 bp, Homo sapiens
  misc_feature 1, 11, 23, 24, 25, 26, 30, 33, 34, 53, 92, 99, 113, 133,135, 140, 170, 175, 198, 214, 223, 283, 286, 290, 307, 317,321, 386, 389, 405, 415, 417, 421, 432, 445, 446, 469, 503,516, 518, 523, 525, 540, 544, 553, 598, 607, 618, 639: n = A,T,C or G
  misc_feature 645, 647, 651, 661, 674, 679, 690, 700, 707, 720, 727, 746,748, 750, 753, 755, 756, 774, 786, 790, 802, 808, 809, 814,816, 818, 820, 824, 827, 830, 837, 847, 855, 856, 872, 873,876, 878, 888, 891, 894, 897, 899, 907, 924, 925, 926: n = A,T,C or G
  misc_feature 930, 931, 935, 936, 940, 943, 948, 949, 951, 971, 976, 978,989, 992, 1001, 1005, 1006, 1010, 1011, 1013, 1014, 1015,1017, 1018, 1019, 1033, 1043, 1045, 1056, 1060, 1068, 1071,1078, 1084, 1087, 1092, 1094, 1105, 1108, 1113, 1125: n = A,T,C or G
  misc_feature 1127, 1139: n = A,T,C or G
ngggggagggntgaggtgtaaannnnctcntanntatttaccaagccttactntgggtttctttttttgggccaggggaattccccattcgnatttggnggaaatttcgggcnaccgaaaggcagcaagggtntntggtnccacttgggggttgccaaaggggcttaaanaatgncttccaagtttaaaaaggccagngcaaaaattaaccgtnggggttcgngcttggaaaaaaaataccgtggtcaattttcttaaaggttgtggatttatttggcaaagnttnaaanaaatggaaattggatgnttttccaacnaaantaaggggttatttggtaaatttcaagggggtattagccacaccaatttttaaatggtaaagcccnaanaaaggatggttttgtnaccacgtttncnaaanaaaaattagtnacctggtatccanntcccaagttggtcccacttttcncttcctaaacctttccttggccctaccgccaacnagcaccactttananattancnttgccaccgaatttncctngaagccacngggaaaagggaataccttttacttggaccctggtttcaccgaaanccgaccttntttagaccctnaatgaacccttattttcactngggttnantaanacctttgtcntttggggccaggnccttntttcaaccctnggaatgcttnaagggtnggaaaactagganttacccnaacccttggcccctttcantngnaantnnacataccccatttggttngtgctacctttngggnattaccccattnctttannccccngnantnccanggngtnccatcantggttcctangtaaaatnncggaaactttcttaannggnanggacttgaanggncanagnangaaatttngcggtagaataaccctnnnaaanngtcnnaatntgnttaanntncttttaaccttgaaaaatcntagcncncacttggttanctntttgccccntttnncccnncnnnannnttggcactttccgntattcccctnanaaaatttaccngctngacatatnttnactcccngtgccnttnggttnanaccaccacccntgntagtntcccaaacttcntncctcatgctacntctacggggaggtct

SEQ ID NO: 5662 - DNA, 766 bp, Homo sapiens
  misc_feature 3, 4, 5, 6, 7, 8, 9, 10, 13, 14, 21, 28, 34, 35, 39, 47,64, 73, 75, 86, 88, 95, 97, 98, 114, 122, 129, 134, 143,144, 159, 165, 166, 190, 191, 193, 203, 214, 239, 241, 243,261, 262, 263, 268, 269, 271, 272, 273, 274, 283, 286, 288: n = A,T,C or G
  misc_feature 289, 290, 293, 299, 300, 305, 310, 315, 318, 319, 329, 330,340, 342, 346, 353, 354, 358, 359, 361, 362, 366, 370, 376,378, 379, 384, 392, 405, 410, 413, 478, 484, 488, 492, 494,495, 503, 504, 506, 508, 509, 511, 518, 519, 521, 528: n = A,T,C or G
  misc_feature 536, 540, 545, 549, 550, 553, 556, 559, 560, 562, 563, 586,601, 603, 609, 614, 618, 625, 637, 648, 659, 660, 665, 679,702, 704, 712, 717, 718, 747, 763, 765: n = A,T,C or G
ttnnnnnnnngtnntttaagntacaggntacaanncctnggctactngttctttctgcaggaanccatgcgcntngcaatgctgancnagggctntnntcatgtatccactggnttctgccncccaaantgctngactgcagnngtgtgatcatggctnactgcnnccttgacctcctgggctagagcanntngccttcctangactctcaaantgctgggattacaggtgtgagccanangngcgtggcctctttttacnnnattgnnannnnaattattanggnannntcnaaggcnnaatgnattgncaccntcnntgctcacctnngacttgaccngntganctcatgnnatcnnannaccncatnctttcnannagctntgactacnagcagcacaccancctanccngctagtctgtatggcggagcacacacatggaatcaactcgtgtgcccaactcaggtagaactacngtactnaagngatncnnccgtctgnncncnnanggtgtcnngnttacacntttgagcnattncacangggnnatntcntcnntnntcaaatcttacaccttgggctangcttggaagtgtaangnatatanctgangacnccttagntttatgaagctncattgagggtncctgtaccaannatggncgcatccaactggnttccatcttcttaatcagaaatntnacattggngcagnngaaaaaaaaaaaagaactcgaggccttanactatagtgagtcgtntng

SEQ ID NO: 5663 - DNA, 579 bp, Homo sapiens
  misc_feature 12, 56, 59, 131, 146, 157, 166, 180, 185, 193, 194, 196,212, 213, 223, 260, 262, 273, 276, 285, 292, 293, 300, 320,331, 332, 340, 348, 349, 350, 351, 352, 361, 362, 368, 369,380, 395, 401, 415, 416, 428, 430, 437, 446, 447, 448: n = A,T,C or G
  misc_feature 449, 454, 456, 474, 487, 497, 506, 510, 521, 523, 528, 546,547, 549, 556, 560: n = A,T,C or G
ttaagcctttgntatctgttctttttgcaggatcccatcgattcgcgcaaactttncantctctctaaagaagatgatgtccgccagtatgttgtaagaaagcccttaaataaagaaggtaacaaacctangaccaaagcacccangattcagcgtnttgttactncacgtgtcctgcancacanacggcggnntnttgctctgacaagcanngtccaagaanagtaaccataaggctgcagaatatgctagactcttgncntcagaatgaangcngcttggcgnagcccannaacacantgcgaagagcctatgctgcntctctgtagcnntctctaantatgatcnnnnngaaatcatnntatgannccaatgataanacagcttaagaacgnggaaanccttaacttccagnnatcgctatctcngnagatctntattggcannnnctgangnaagatgttatctaaatgntgtcgttatgtcncttactgatncagtacacncttnatcatttgtangntgtgngttggagtctaattggcnncncttcttncctnacctcttagtcttatgtga

SEQ ID NO: 5664 - DNA, 1028 bp, Homo sapiens
  misc_feature 10, 12, 18, 19, 20, 22, 23, 26, 27, 29, 31, 32, 33, 35, 36,39, 40, 45, 46, 47, 50, 52, 53, 54, 56, 58, 59, 60, 62,66, 67, 68, 70, 71, 73, 75, 76, 77, 82, 83, 84, 86, 89,93, 98, 99, 102, 104, 106, 113, 114, 117, 134, 139, 146,149: n = A,T,C or G
  misc_feature 173, 174, 181, 182, 183, 188, 193, 195, 196, 203, 206, 208,217, 218, 225, 228, 232, 233, 234, 237, 241, 249, 257, 259,260, 263, 264, 266, 271, 272, 282, 283, 284, 292, 298, 302,312, 316, 322, 328, 331, 332, 337, 347, 355, 361, 364: n = A,T,C or G
  misc_feature 373, 376, 380, 382, 384, 385, 386, 391, 392, 401, 411, 412,415, 417, 420, 434, 436, 438, 448, 451, 461, 464, 467, 470,471, 472, 473, 474, 475, 479, 480, 481, 483, 493, 495, 496,497, 502, 513, 519, 531, 532, 537, 542, 548, 549, 563: n = A,T,C or G
  misc_feature 564, 565, 573, 577, 583, 588, 591, 594, 595, 602, 607, 610,619, 620, 624, 632, 634, 635, 640, 642, 645, 650, 651, 654,657, 660, 667, 668, 669, 670, 673, 676, 682, 691, 696, 697,702, 708, 716, 717, 721, 725, 726, 728, 730, 731, 733: n = A,T,C or G
  misc_feature 735, 737, 738, 743, 746, 753, 758, 761, 768, 769, 780, 785,786, 787, 799, 804, 813, 817, 825, 828, 831, 837, 839, 843,849, 850, 871, 874, 880, 888, 899, 902, 905, 915, 919, 920,924, 928, 931, 936, 937, 941, 948, 951, 955, 958, 960: n = A,T,C or G
  misc_feature 961, 962, 964, 966, 967, 969, 982, 983, 987, 998, 1007, 1012,1015, 1018: n = A,T,C or G
cccccgccgnanaaactnnncnnatnnangnnncnnaanncaccnnncancnnnanannngnacgnnnanncncnnngcacnnnanacngcanagganntgncncncggattnnccntgaacctggaaaccgcntctancaggagnccngcgattcgaattcggcacgagagnncacaggnnntgcgncgacnanngctaaangcnanaacgggaanngagaagncgnggannnggngagncgatgacnggacacancnnatnngncaagnnggacgcttgnnnacgcagcnggaccnacanggtgcaagangccntcgacnacatanaannaccanaaaaaacccnaggcacgnggcacntcnccccggagnaangcancncnnnggganngccgacagngctgagaaanngcngnaanccaggaggtggaanangnacgagcaccnganaggcgccatngcnctncannnnnngcannnancagtgcactntnnncacangaaacaacacnacaganagtcaagcaccnnaaaanctcantacacnnccacaaggagcgcnnntggacccngctnctaagncggangtnggnntaagacnatcgngancccaccaanntccntggccaangnnaaaanangcnaaaannggnccntgntcggcannnngcnaantagcantgaaaaaanccggnnccatnaaaaancaacgggnncaancctnntnanngngngnngcaanagngggggcncaaanagnaaacccnnattgcacgcgnaggtnnntaattagagggnggcanacgggacancacncggaccgnaantanggcccncnacanaaactnnacccaaatcgcccagggaaancgnaaacgngacttttnacagaacttgnaancgnacgaaccccncgannagtnacanaangcagnnaganaaaaaantgngtcngcncnnnangnngnctcataggggacnnaaanaacataggganacacaccgngagcnaanaanattaagggcg

SEQ ID NO: 5665 - DNA, 832 bp, Homo sapiens
  misc_feature 2, 6, 9, 10, 11, 18, 21, 22, 33, 34, 41, 53, 58, 59, 64,69, 70, 77, 84, 85, 89, 107, 114, 117, 120, 121, 124, 128,131, 135, 138, 143, 145, 146, 148, 156, 158, 160, 161, 174,179, 190, 201, 209, 221, 227, 228, 232, 237, 239, 243: n = A,T,C or G
  misc_feature 244, 259, 260, 266, 272, 275, 280, 281, 283, 289, 302, 304,309, 315, 317, 320, 324, 331, 334, 339, 341, 345, 349, 350,360, 363, 367, 369, 380, 381, 382, 394, 397, 399, 406, 410,413, 415, 416, 419, 422, 435, 437, 438, 446, 448, 460: n = A,T,C or G
  misc_feature 467, 475, 476, 479, 482, 490, 496, 497, 500, 501, 502, 505,512, 530, 539, 547, 550, 555, 556, 558, 566, 567, 572, 582,583, 587, 588, 596, 598, 601, 604, 605, 608, 609, 616, 632,635, 636, 639, 642, 645, 646, 652, 654, 657, 661, 675: n = A,T,C or G
  misc_feature 679, 683, 687, 693, 695, 697, 705, 710, 714, 715, 717, 722,723, 730, 733, 736, 737, 738, 743, 744, 745, 750, 752, 757,758, 759, 760, 769, 771, 773, 774, 777, 778, 779, 780, 782,791, 798, 799, 805, 817, 818: n = A,T,C or G
antggnaannngggcaanaanncccttaagaannactgaanggaaaagcccgnagcgnntgggnggaanngggacgngaggggnnggangagggggtacagaccggnttttggncgncgnnttncgangancganggnggggnanntngggggggnangnnaaggggcggcagnggganaaagatgcggnggcgaggccangaaagganggaagggaagangggaannaagncaggngncccnngggcaacaaggaggnnaggggnacaggnagnaaagnngnggaagnggaccggagcagncnaaacngggagngnaanaggngggaagnaanggagngngcanaagnngagagagagnacncagngnagaaacaggcnnnagagaagcagcnggngnaaaaacnggcnggnannagnganagggagaggaggnannaaaggcangngaaaagaagganggcaganggaaggannggnaanaagcccangagagnnggnnnacnagagaanggggcaaaggcgacaggngggaaaggnaaaggganggnagaanngnagggggcnngaagnaacgagacgnnggannggggaggnanaanggnnaannagagggngaaggaaaggacaagnggnnganagnggnnagacgnangcngaanaggaggggaggagnaacngagnaganggaggnangnggaagggnggacngggnncnggagnnggaaggnggngannnaaggnnngggananggggnnnnaaaggggangnannaannnngnaagagggangggaggnnaagggnggggagagaggnnggagggcgaaaacc

SEQ ID NO: 5666 - DNA, 1036 bp, Homo sapiens
  misc_feature 2, 3, 7, 9, 10, 11, 16, 17, 18, 19, 20, 21, 23, 25, 26, 27,28, 29, 30, 31, 35, 36, 37, 38, 39, 44, 45, 51, 56, 57,60, 61, 62, 64, 65, 66, 67, 68, 76, 77, 78, 82, 88, 89,90, 93, 94, 95, 96, 97, 99, 100, 109, 111, 113, 117, 119,121: n = A,T,C or G
  misc_feature 134, 136, 138, 140, 141, 142, 143, 145, 146, 147, 150, 151,153, 156, 157, 164, 168, 169, 171, 176, 182, 183, 197, 198,199, 201, 203, 204, 206, 208, 209, 211, 215, 223, 226, 227,228, 230, 231, 232, 234, 235, 237, 245, 247, 249, 250: n = A,T,C or G
  misc_feature 254, 283, 301, 302, 306, 308, 310, 311, 318, 319, 322, 324,327, 329, 331, 335, 337, 339, 340, 345, 346, 347, 348, 349,351, 355, 356, 357, 363, 365, 366, 368, 374, 375, 377, 378,384, 385, 386, 396, 400, 403, 410, 442, 448, 459, 465: n = A,T,C or G
  misc_feature 470, 483, 505, 509, 520, 525, 539, 543, 547, 554, 556, 559,561, 564, 574, 575, 609, 612, 627, 650, 651, 662, 665, 667,673, 681, 696, 714, 715, 724, 725, 726, 735, 740, 748, 749,755, 771, 772, 775, 781, 784, 793, 799, 806, 810, 825: n = A,T,C or G
  misc_feature 828, 829, 830, 832, 836, 842, 850, 851, 852, 853, 862, 863,872, 876, 887, 890, 891, 892, 895, 899, 900, 902, 910, 920,932, 941, 942, 944, 945, 946, 949, 953, 955, 962, 968, 970,1001, 1002, 1006, 1011, 1012, 1024, 1025, 1035: n = A,T,C or G
anngacngnnnaaacnnnnnnancnnnnnnnaaannnnngaaanngaaggnaacannaannngnnnnncgaaaaannngaanacaacnnncannnnnannacaccaggngnanaagnangnaaaggaacgcgcncncnannnncnnncgnngngannacgaaancggnnangacgntgaaanntagaatgcacagannnanannancnnantagnaaacatcnggnnncnnnannangcgacatntntnnccgnttggaaacgcttggcaatctccgacgcanagagagagagaagagctnncaanancnnagatagnnagnancgnananatanangnngtcannnnnanaggnnngaaacncnncnctctanntnncagctnnnggctcacagngganagncaacganggcagaaggaacatgagcctgatgaagagacnggaaanggagcacctgntcctgnacctncaaagagaacagnccaaagaaatacacccaagcanggangctcagagatnaatancagagagaggactnccancctnaaggcangnatnanganaaggcaaaanncaaaggtaaaggacatgagagctgaagacttgangangctaatcagacacanggagcactgggcacataggctannccctaaactgnagntngagganattatcgncagagcagaataccngggaagtaaaaaggaagnncagacctgnnnaaaacgaantcgantagaaccnnccctanatatacatgaagaatnntgntagcanatnatgatgaangctgcnggagaanaaangaaacactgaaagtnacnnnantacngaattnagaacccnnnntggacaaanntatactganaagngagaatggctngcnnncangagnnanagttgaanccctaacagnacgagcaaccancagagaaanngnnnaanaaantnaacaacntgggcntnggaaaagaaagcaaggcaaagcccgcaggannaaanaagtnnatgaaccctagnngaaaatggang

SEQ ID NO: 5667 - DNA, 711 bp, Homo sapiens
  misc_feature 2, 6, 22, 185, 342, 463, 472, 524, 525, 538, 549, 555, 559,567, 599, 631, 639, 641, 655, 663, 673, 676: n = A,T,C or G
tnaatncttgctctcgcctctngcaggatccctcgattcgaattcggcacgaggctacactgtggggggaagatgctgataaatttgatggttctagacagcccgtgttggctatcaaaggagcccgagtctctgatttcggtggacggagcctctccgtgctgtcttcaagcactatcattgcnaatcctgacatcccagaggcctataagcttcgtggatggtttgacgcagaaggacaagccttagatggtgtttccatctctgatctaaagagcggcggagtcggagggagtaacaccaactggaaaaccttgtatgaggtcaaatccgagaacctgngccaaggcgacaagccggactactttagttctgtggccacagtggtgtatcttcgcaaagagaactgcatgtaccaagcctgcccgactcatgactgcaataagaaagtgattgatcaacngaatggatngtaccgcttgtgagaagtgcgacaccgaatttcccaattttcaagtacccgnntgatcctgtcagnaaatattgcanattttnaagnagaatcantgggtgacttgttttccaggagtctgctgaanctatccttggaccaaaatgctgcttatcttgnggaattanangacaagaatgaacngcctttgnagaagttttnccntaatgccaacttgcgaatctttcattattagaagc

SEQ ID NO: 5668 - DNA, 820 bp, Homo sapiens
  misc_feature 1, 4, 8, 10, 17, 25, 34, 51, 52, 53, 58, 59, 63, 71, 75,76, 84, 89, 96, 98, 127, 139, 152, 153, 154, 156, 179, 184,187, 189, 190, 211, 219, 221, 233, 235, 244, 255, 256, 266,290, 299, 303, 309, 315, 317, 321, 324, 330, 334, 337: n = A,T,C or G
  misc_feature 365, 391, 392, 399, 400, 414, 429, 433, 443, 449, 457, 466,486, 494, 504, 509, 510, 513, 533, 541, 543, 547, 563, 568,569, 573, 577, 593, 602, 606, 607, 609, 615, 621, 622, 623,641, 650, 654, 657, 658, 660, 669, 673, 680, 690, 694: n = A,T,C or G
  misc_feature 718, 719, 723, 742, 776, 780, 792, 793, 799, 807, 810, 811,812, 817: n = A,T,C or G
ncgncccntntttaaanccggcaanctttggaancctttggaaagccccgnnncgaanncggnacgaggcngggnntttcctgntacangcaaaancngcttcgagggaccacattttttcccccgnaacccgccgccngggaggggaagannntnaacctgggcccggcacagggtancctgnganannctgtgaccggaaaggcgcccnacccggantnagtggctccaantntcaatgcanccccacacccnnagttgttttnatcctgagaaaaaaaagggaggcngaattattnaaanttaaangagganancccntcntggaanggcngcngacccttcctgcagaaatggggagcacntgaggacacaggtgggtggaggcccnntgtgcgnngctggtcggattcnggcagccctccgtcncttnttataaaacnttgggngagaagantatattganaatgtcagtgaaacaagccnacattggnaatggaggcncagannacnccacaaggagcccttctgcntataaaancnagangcaaaaaacctttttnaattnntgtnaatnaaaaggaaagacttgntaggctcanatcnnanctgggngtgggnnnacgggggagaacactgcnaacaggganaaanggnngngcacacaanaaangagtggncgaaatttgnccangtggacccagccggggaaaaaacnnatanaaaaaaactcttcatagancctttttaaaaaaaaaaaaaaaaaaaaacttcgngccncagaaaaccaannggaggngacctatnccnnnagaanccg

SEQ ID NO: 5669 - DNA, 895 bp, Homo sapiens
  misc_feature 3, 4, 5, 6, 9, 12, 13, 17, 19, 20, 32, 33, 45, 48, 55, 60,71, 73, 75, 78, 81, 87, 91, 92, 94, 97, 98, 104, 107, 118,121, 122, 123, 125, 128, 133, 147, 148, 150, 176, 196, 199,204, 210, 222, 229, 230, 231, 233, 239, 241, 253, 255: n = A,T,C or G
  misc_feature 256, 258, 260, 261, 262, 263, 267, 269, 274, 275, 281, 283,290, 296, 297, 298, 305, 306, 308, 314, 318, 323, 325, 335,337, 353, 365, 367, 408, 420, 422, 425, 426, 430, 431, 432,437, 455, 456, 459, 468, 480, 483, 487, 499, 502, 504: n = A,T,C or G
  misc_feature 515, 516, 522, 523, 528, 536, 540, 548, 562, 564, 566, 575,581, 582, 591, 601, 611, 617, 620, 624, 629, 631, 634, 641,648, 675, 681, 682, 685, 696, 698, 711, 713, 718, 721, 732,734, 741, 742, 759, 762, 772, 773, 775, 781, 790, 795: n = A,T,C or G
  misc_feature 798, 800, 811, 812, 821, 834, 840, 841, 871, 877, 881: n = A,T,C or G
ggnnnngantgnntttnannccttgcaaacgnntcgctgagggancgnccgaatncggcncgcggaggaantnanatngtncatggnatanncngtnntttgtntgntatacagtgcntgnnngnagnggggntccgtactgctagnnangaacgtgcattcacagggttataaanataacgatgttagcaccaanccncttcnaccctncaatagggtgtnagatgcnnnanatggangntgcctatttaangnntntnnnntgcncnatatnngaattncngaggacnacttannnccgaaanntntacttnccgnaccgnanggcggaaagngnttatttttgatgactncgtgggtccgcncngagagctcctgctttgcctgcgcctcccgttctaaactgtnaccctttagttntngannaccnnncccgncttgggaacggtctgacnntcnctcgaaaanaggaagtggctnaanggcnggcttcttgacncgngnatcggatcctnnggcccnnccccnttccgttncaancttgcttntgcaacaagcgatngntnacgcttttnactganntcttttatntcgccatttnggattcccgngttccntgnaacnaaaangnccnggcggangtcaccnataaaacctgttccccttgcttacaanaagcannganggtgcccgtcngngccctggtcttgnanaacanggntgttggggaancntaaactnncccacatttgatggaanacncattttcatnnanccattnttaaaaacnggggntgngngcaacgccaanncctactccncactatccaaagntcccanntattggcggggcattcttcattggaaattntggatngaangaaacccttctcct

SEQ ID NO: 5670 - DNA, 759 bp, Homo sapiens
  misc_feature 69, 76, 80, 82, 84, 86, 90, 94, 95, 98, 100, 105, 113, 133,134, 140, 155, 160, 161, 170, 174, 176, 179, 201, 211, 243,251, 264, 266, 271, 273, 275, 276, 279, 283, 290, 292, 296,297, 301, 306, 307, 315, 319, 320, 323, 331, 336, 340: n = A,T,C or G
  misc_feature 343, 344, 350, 357, 361, 371, 374, 377, 381, 385, 394, 395,396, 400, 401, 403, 405, 407, 411, 416, 425, 427, 432, 439,442, 446, 447, 450, 471, 481, 485, 489, 495, 500, 501, 503,504, 514, 517, 520, 530, 533, 537, 542, 544, 546, 553: n = A,T,C or G
  misc_feature 559, 563, 569, 581, 584, 585, 587, 588, 592, 597, 601, 602,610, 627, 636, 637, 638, 640, 642, 645, 665, 675, 677, 684,705, 708, 712, 713, 714, 717, 725, 736, 743, 750, 751: n = A,T,C or G
tttcaaatcgcttggctactcgttctttctgcaggatcccatcgattcgaattcggcacgaggcctgtnattccancatncncngncacnaatnnaananggagnccttaggntcttaatgtgaacaggcagnngattangctgggcactcaggnagaanntcgcgtgtntcantnttnaggcatgtttcatgattcaaantactctccancccttgctctcaatgccttgcatgagccttgnatgattgnattaggactaccnanattancncnngtnatcncctttgntnaaanngaantcacnntgtatgtnacannatnctaatacntcaanaggnacnngtattntctgacnaaanagctaggcanctnaanatanccanattatatcnnnatcnntngncncttnattantacatacgnanacctngtaaggnatntttnncantggacattgctacagatcagntgacgattangtancctncataantaatnnanngcattgtacnttnacngatcgttctnccnctgncatgntncngttcctnagtganacanagctcntcgtattctggncgnntnnccgntatcngttnntaatgcanatatccctatgcaggtntcccatatnnntntnatnatgcatatagccttttgaangctccccatntnatatgcncatattccaccatatgaaatnttncctnnncgnactttggncacatgtaagncttggtnacccaanntaatcatc

SEQ ID NO: 5671 - DNA, 767 bp, Homo sapiens
  misc_feature 5, 19, 20, 23, 247, 248, 547, 562, 621, 703, 723, 733, 743,759, 767: n = A,T,C or G
gaaancccctttgttactnngtnctttttgcaggatccctcgattcgaattcggcacgagggggattcataattccagacaggtagagaacggttttatttatgtagagacagagtctcgctctgtcgcccagctgaggcggggagaatcactttgacctgggaggtggaggttgcgctgagctgagatcattacactgcactccacctgggcaacagagtgagactatgtctcaaaaaaaaaaaannaaaaaaaaaactcgagcctctagaactatagtgagtcgtattacgtagatccagacatgataagatcattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaattcgcggccgcggcgccaatgcattgggcccggacccagcttttggtccctttantgagggttaattgcncgcttggcgtaatcatggcatagctggttcctgtgtgaaattgttatccgtcacaattncacacacatacgagccgggacataaagtgtaaagcctggggtgcctaatgagtgagctactcacattaattgcgttgcgctnctggccgctttccaatcggnaacctgtcgngccacttgcnttatgaatcggccacncccggggn

SEQ ID NO: 5672 - DNA, 719 bp, Homo sapiens; identical to SEQ ID NO: 522
  misc_feature 10, 18, 23, 32, 669: n = A,T,C or G

SEQ ID NO: 5673 - DNA, 887 bp, Homo sapiens
  misc_feature 1, 2, 14, 15, 61, 104, 107, 111, 115, 117, 136, 171, 228,239, 271, 276, 302, 312, 322, 325, 329, 334, 345, 378, 389,404, 410, 413, 415, 421, 446, 451, 455, 461, 494, 515, 517,524, 526, 538, 540, 541, 552, 553, 554, 557, 567, 571: n = A,T,C or G
  misc_feature 576, 577, 582, 585, 586, 588, 594, 599, 601, 604, 611, 628,639, 643, 650, 652, 657, 661, 673, 674, 678, 680, 682, 685,699, 706, 707, 714, 720, 721, 733, 735, 750, 763, 772, 781,789, 792, 813, 818, 820, 825, 854, 859, 865, 877: n = A,T,C or G
nntttaaaaccttnnttttaacccttttaaaacctttcaactaccgggctttttgcaagancccatcgatttcgaattccgcacgaaggaaaacatggcacttnttnttgncatncntaacgggccctggccgctnacccgtggaaagtacaggtcctgacaactggggtncctgatgggcctgggtgacattatctcacaacaacttggtggagaggcggggtctgnaggaacaccangagaggcccggactctgaccatggtgtccctnggctntggctttgatggccctgtggtaggangctggacaanggtttgatcngancatncctgncaccaccaaantgggatgccctgaagaaaatgtttatggatcangggggctttgnccccgtgttttctangctgcnttntnccactnggtatggggcacttaatggaatggntaacncagnacaaanttgggcccaaactacatgcgggattatactagntgcccttatcacccactactntnttatggncntgctgtgccagntnnccaacttttannntgntgcccctttnattncaaanntggancgnngnccaaantgaancnttnttttttnttgaaccttcctacctntccctgggaanggcncaatatngnttatnaaanccttgccctcannttcnantngtnttcccaaccttttntaggggnntacaganttttgnnccccatgggaancnaggacaataacaaanctccttctaaaantggggggantaacccccntttctacnagnagtttgggtttttcccggtgncaaanantttantaaaggaatttggcaccccttggaagggnccccnttttanttcttaaaaaangtccacctgc

SEQ ID NO: 5674 - DNA, 858 bp, Homo sapiens
  misc_feature 3, 9, 12, 20, 24, 25, 27, 32, 33, 36, 52, 54, 59, 64, 65,66, 68, 72, 74, 82, 84, 86, 91, 92, 99, 104, 107, 115, 116,119, 120, 122, 153, 157, 169, 173, 177, 178, 196, 206, 240,260, 277, 304, 319, 328, 341, 350, 386, 391, 396, 410: n = A,T,C or G
  misc_feature 423, 425, 426, 443, 466, 468, 471, 476, 484, 488, 493, 510,511, 521, 528, 536, 539, 541, 542, 543, 551, 562, 563, 568,572, 576, 590, 596, 597, 604, 608, 612, 613, 616, 617, 619,626, 634, 647, 652, 663, 664, 665, 667, 668, 670, 671: n = A,T,C or G
  misc_feature 682, 683, 691, 696, 697, 701, 706, 709, 710, 712, 713, 717,718, 726, 730, 732, 738, 750, 753, 757, 768, 769, 772, 773,776, 778, 779, 782, 788, 794, 797, 799, 807, 808, 813, 816,823, 825, 834, 837, 838, 847, 848, 851, 852, 855: n = A,T,C or G
ttnctaatnctngctatcgnagtnntntaagnncanttctaatacttggcancncgatntcgcnnnancatncnatacagtntncntctgnncgaggcncccangtncatggctnnatnnanggccatccatatgccagctgggggccaggcnacantggccatattgnctgnagcnngaatggtgcccacctacncgaattgaanggctaagagtcccagatagctaggccagagctgnaagcatacagtaaggggaanagctgctcccacagganagggatagattccatctcactgcgcancctgggaggaggcanggatcctgncacgctaagcctnaggcaccancctccctgtgctcgacatgcaaagtcatgactcctncttgntgagnactgagctaccttntactgctccaaancnnactaacagctctccaancccttggggtgactcgagatccnanganctgtngacttaantgangatantcagtcctgttctgccnnggcaggccanattcctncctccaanaancnnnatctttcnaaaccctgaanntgtancctntctnatttacccagctantttaannccaaatnttanaaanntanncnaataccnttactccnaaaccacttttgncttcnttacctgatannngnngnnctatactcacnntttagccntaaanngaanccttnctnnannagcnnatttgtcntttnancttggnaaactttctatntanaatnaccatccaaannttnnggnanntcnttaatnttttanccnanctacaatnnaacanctntaacctnantcctgtaantcnnacaaaattnntcnntancct

SEQ ID NO: 5675 - DNA, 1786 bp, Homo sapiens
  misc_feature 3, 6, 9, 12, 13, 18, 19, 23, 24, 25, 27, 30, 31, 32, 33,36, 37, 38, 41, 43, 44, 47, 50, 54, 56, 57, 59, 61, 65,66, 67, 68, 69, 71, 76, 78, 79, 81, 84, 85, 87, 88, 89,91, 96, 99, 101, 105, 109, 111, 116, 118, 119, 120, 124,126: n = A,T,C or G
  misc_feature 128, 129, 130, 132, 133, 135, 137, 138, 139, 142, 144, 147,149, 150, 153, 155, 157, 159, 160, 161, 162, 164, 165, 166,167, 169, 172, 173, 175, 181, 182, 187, 189, 191, 192, 193,195, 196, 199, 202, 205, 206, 208, 210, 211, 212, 213: n = A,T,C or G
  misc_feature 219, 221, 223, 227, 229, 231, 234, 237, 239, 247, 248, 252,253, 256, 257, 262, 264, 265, 267, 269, 272, 275, 276, 281,283, 285, 287, 288, 289, 292, 294, 306, 308, 318, 320, 325,326, 327, 328, 334, 338, 343, 345, 347, 349, 353, 354: n = A,T,C or G
  misc_feature 357, 358, 361, 362, 364, 365, 369, 375, 376, 378, 382, 384,386, 388, 391, 393, 396, 397, 400, 401, 402, 403, 404, 407,409, 412, 418, 420, 422, 426, 428, 430, 437, 443, 444, 445,446, 449, 453, 456, 457, 458, 467, 470, 473, 475, 477: n = A,T,C or G
  misc_feature 480, 481, 482, 485, 487, 496, 498, 500, 502, 505, 511, 513,514, 515, 516, 517, 519, 523, 526, 530, 535, 537, 538, 539,541, 542, 543, 547, 549, 550, 553, 554, 555, 557, 561, 563,568, 569, 571, 573, 578, 582, 583, 584, 585, 586, 587: n = A,T,C or G
  misc_feature 589, 590, 592, 594, 597, 599, 600, 605, 606, 607, 609, 615,621, 622, 624, 625, 627, 628, 633, 635, 638, 639, 641, 649,650, 651, 653, 654, 655, 656, 661, 662, 663, 668, 672, 673,674, 676, 679, 684, 685, 694, 695, 708, 710, 712, 719: n = A,T,C or G
cgnccnccnccnnccccnncggnnncngcnnnnacnnnccncnncgngcnacgncnncncnaccnnnnnangagcncnngncgnnannncncgccnacnangggntcgngncagcngnnnccangncnnncnncngnnngcncnggnanngcngnancnnnnannnncnacnnangctacnncagcnancnnncnngcnganagnncncnnnnagcgcnancncgcncncnccngcnancccacacnnacgnncanncgggncnngngnacnggnnccccnancntnnntcncnttttggccaacncngcctgggcancnacccnnnntcgccncagnaacgngngnangggnncgnnacnncnnccgnccccanngncccntntncnccngnagnntcnnnnncananccncagcanancnccanancncgccccngggggnnnncgnaccnccnnncacccgcgnagngcncncncannncgngncgcctcccncncncncgnaccccncnnnnngncccnccngccngcccncnnnannngccnannccnnncncccnanacacnncngncgagncccnnnnnncnncncnccncnnccccnnngncagacnactccnncnncnnccagncnccnncnacccgccnnngnnnnctccnnncgcangcannncnccngcccnnccccccggnnctggcacacgacncncncaccgcnncnnccccnnnnacnacgnngcncncnagcnnncacnnancanncanngacncngacacaccngcngaggcaacacgcncncaccnnnacacnccantnacgcatccggnncatcacgcncgcnnganccngacngagacaacncagcnnnnncncnagnnnacacgcnggcnacagactctcncacgnnacgccannnncgcacctccncnnnacaccnangcacccgngananccncgcacnngngnngctcanacgcancangcgcgncnangtcncnngacgcnncgnctcnacnccgcgngncnccaacgncgcgccanccnngacgncgncacnacngacgncacnnnncacaganaggacncactngngcgcannnccncncgncgncancncccgacgcnagtatanacnatgcnngnncagcacacannnnncnanaccngccgngccncacgctctcgngcagncacacgcggncgcctagagccnngcatcntagagcacgcgcannnntccngccacatngcacancnncanacnngcccncnncnnncagacccncnnnccanctccnganaccncgactcacaccncnctnncgcgcaanagnnncaggnanacgctcngctctncactgnganaccgcangacgncccttncnactcanacncncngncacagncacnctncnccgnacacncnctnncacatccgngnnatcncnncnannnacgnacannncgcgcaccngcacgcacaccanngnncngacgacccncncgntcanacctgcgancngctcatgcgccgtntctacacnccgncngtncnacncncgaccgncacagnncnncgctncgntnncnncgccnccgcgcgntcccancnncaggcnnctacnnnccagntatccngngtnnngnncaacgcncagcgntctcnncacanncccgangcgnngncnntncnnnngagagcacccagntanncaaccnnacnccaganaactcnaccnactcgntcacagnctcgctgtcnaccnggatacaccgaccccacc

SEQ ID NO: 5676 - DNA, 759 bp, Homo sapiens
  misc_feature 7, 9, 31, 32, 88, 90, 94, 637, 652, 672, 720, 731: n = A,T,C or G
tttatgncntagtgaactctttgggaagcanntcccatcgattcgctcagattaaggggtttgaaaaacaaaccgaaaaagatgggcntnattnagccttacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagagtttcgctcttgttgcccaggctggagtgcaatggcgcaatctcggctcactgcaacccgatacctcctgagttcaagcgattctcctgcctcagcctctcaagtagctgggattacctgcgtatgccaccacacccagctaatttttttttttgaatttagtagagatggggatttcacccatgttaatcangctgatctagaactnctggacctcaggtgatccanccggcttgggcttccaaaaggactgggattaccagcgtgagccactgnacccaaaccgnctaaaccttttaaaaaaggattatttgg

SEQ ID NO: 5677 - DNA, 772 bp, Homo sapiens
  misc_feature 8, 590, 596, 656, 681, 688, 709, 730, 735: n = A,T,C or G
ccaacgcnggctacttgttctttttgcaggatcccatcgattcgaattcggcacgaggattagtactagttctatctggaaaaagcccgggttggaagaagctgtggagagtgcgtgtgcaatgcgagactcatttcttggaagcatccctggcaaaaatgcagctgagtacaaggttatcactgtgatagaacctggactgctttttgagataatagagatgctgcagtctgaagagacttccagcacctctcagttgaatgaattaatgatggcttctgagtcaactttactggctcaggaaccacgagagatgactgcagatgtaatcgagcttaaagggaaattcctcatcaacttagaaggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaaganagccangatttaggtaatgagtggatgagtaaatggtggaggatgggagtcaaaatcagaattatnggaagaagtatttcctgtaactatngaaaganttatgtatatatacatgccanaaatatatatgtgtgtgtgtntctgnggatggatatatgtatatctcttcctatatatatccc

SEQ ID NO: 5678 - DNA, 833 bp, Homo sapiens
  misc_feature 3, 4, 6, 7, 8, 9, 10, 21, 33, 34, 47, 49, 50, 51, 55, 64,68, 69, 78, 80, 86, 87, 98, 102, 109, 125, 132, 135, 140,141, 144, 145, 153, 154, 160, 164, 182, 191, 194, 202, 205,230, 244, 248, 254, 262, 269, 271, 272, 283, 285, 290: n = A,T,C or G
  misc_feature 308, 310, 316, 323, 324, 355, 379, 382, 390, 394, 396, 403,406, 407, 409, 410, 414, 417, 421, 424, 425, 428, 431, 432,435, 439, 445, 467, 487, 489, 492, 506, 508, 510, 512, 517,525, 528, 538, 543, 547, 549, 553, 563, 573, 576, 582: n = A,T,C or G
  misc_feature 584, 586, 594, 595, 596, 599, 602, 606, 618, 619, 620, 621,649, 651, 660, 663, 678, 685, 696, 707, 708, 712, 713, 721,722, 725, 733, 740, 743, 754, 760, 777, 783, 786, 788, 794,795, 797, 806, 808, 812, 816, 820, 824: n = A,T,C or G
ggnncnnnnntttttaactcntgccctttgaannccttggtacctcncnnngganggggccctngttnnaattcgctncnacccanngatgggccagngggngaacttncttgagtatgtcgccnttccggnggncgttnnctnngttctacnnagaacncttngagggctgaaaataaatntggaagatnganacaccctntgngggtcctctctgagacaaatccatntggtgggtaattgnacantaaatnttttttgntcaaatntnnaaaaaaaaaanangcctntacaactcttgtgagtcntnttaccnccatccnnacatgataatgatacatatgatgatgttggncacaaccaacatctagaagtgcgnttnaaaaaaangctntntttgcgnaanntnngatnctnttgnttnnttngannccnttgngcctgnataaacaagttaacaacgacanttctttcattaggggagtcngnatnatggtgggggccangnangngttcntgaatctngcntcgtctcctncaggncatntncacnacacccgaantttgggcatnttnttttgncntntgaacggnnnctnggngttnatcaaggatatnnnntttcctgtgtgcaaaatttgtcccctcncnaattccacnctngcatgccatcccggnatcattnaagggtaaaantcctggggggnngccnnatgcagtnngcncaacctcncatttgnatngctggttggancataantggccctgctattttanttgcgnggnanaacatnncntggggcctntngtgncatntaanatanattggggcg

SEQ ID NO: 5679 - DNA, 773 bp, Homo sapiens
  misc_feature 28, 420, 491, 580, 756: n = A,T,C or G
tttattccatcagctcttgtcttttgcngatccctcgattcgaattcggcacgagattctccctaaatagtaaatcccactgtatacaaaactgttctcttgttctgccttttaaaatgttcatgtagaaaattaatgaactatagggaatagctctagggagaacaaatgtgctttctgtaaaaaggcagaccaggggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggnatcttttcaattaatgtatctgtaaaaagtttctttgtaaatactatgtgttctggtgtgtcttaaaattncaaacaaaatgatccctgcatttcctgaagatgtttaaacgtgagaagtctggtaggcaaagcagtctgagaaagaaataggaaatgcngaaatagggtttgtctgggtgcatataatctttgctctttttaagctctgtgactctgaaatatatttttgggttcttcagtgtgtttggacaagacacttgatatttctatcaaacaaatgactttcatattgcaccaatctttgtaagaccactcaaataaaagcttttaaaangcaaaaaaaaaaaaaaa

SEQ ID NO: 5680 - DNA, 855 bp, Homo sapiens
  misc_feature 4, 5, 10, 11, 18, 69, 74, 75, 78, 81, 92, 94, 104, 112, 115,123, 125, 152, 154, 165, 172, 173, 178, 187, 191, 195, 225,236, 239, 245, 274, 285, 294, 309, 316, 339, 347, 370, 371,379, 382, 389, 390, 391, 392, 393, 399, 402, 404: n = A,T,C or G
  misc_feature 408, 409, 412, 417, 421, 428, 429, 430, 433, 434, 441, 443,453, 454, 490, 495, 503, 504, 521, 522, 524, 534, 563, 576,587, 592, 605, 635, 638, 683, 688, 689, 697, 710, 717, 735,759, 763, 766, 778, 782, 783, 789, 793, 797, 806, 808: n = A,T,C or G
  misc_feature 812, 818, 821, 823, 853: n = A,T,C or G
gccnnttgannccatcanctcttgttctttttgcaggatcccatcgattcgaattcggcacgaggggcncaaannatntcntgatgacaaananctctgtatancaggtcantcncagtgttnanagtctcagttgcttgcttggggaactngngtccctaatgngaatagnntgctngattgctcnggcnctgntactgtgacagtgtttttagacctgtgttnctaaaaaaaanatnaatgcnctgaaaagggtgttgggagggtggttcancatagaaacanagatgttanggtgtttagatttanggttggnaacaaggtcatctttagtcaccncactgggnaggcagcatttgctacattggcnnactaactnccnttgctannnnntttcangantncaannacntgtgnatcntagtatnnnagnntgaaatnantttccaccannagcgggcattgtttctatcacagcataggctatgtnaagcnaactctannatgataaatgacacccnntnttatctattngcatcgacccccgtctctacaagaaagtnaccaaaaattttncccgggcatgntggtnggggcaccctgtnggtccccagctatttcaaaaaaggcttganggnggggaggaatcacttggacccccgggggggggtggagggttgcanttgannccaaatcnacgcccactgcanttcccgncttggggtggacacaagngagacccccattttataaaaaaanaatnaanacctcctttggnaacnngggggnaaantctnttctttttnangaanttttcntgntnggactttggggttcctctatgactttcatntc

SEQ ID NO: 5681 - DNA, 932 bp, Homo sapiens
  misc_feature 1, 2, 3, 4, 5, 6, 9, 10, 11, 12, 14, 18, 19, 20, 21, 22,23, 24, 25, 26, 27, 30, 31, 33, 34, 39, 42, 43, 44, 45,51, 55, 60, 74, 85, 89, 93, 94, 96, 100, 103, 110, 118,119, 131, 137, 143, 146, 161, 163, 166, 171, 184, 185, 190,199: n = A,T,C or G
  misc_feature 205, 218, 263, 271, 278, 284, 333, 337, 374, 385, 427, 434,437, 439, 443, 445, 452, 466, 468, 477, 480, 483, 493, 494,505, 509, 510, 523, 524, 525, 557, 572, 577, 613, 616, 617,618, 619, 628, 632, 634, 640, 642, 649, 657, 660, 670: n = A,T,C or G
  misc_feature 671, 679, 687, 694, 695, 697, 706, 707, 721, 723, 724, 725,735, 740, 743, 744, 745, 747, 751, 759, 761, 765, 774, 777,778, 780, 791, 806, 807, 813, 817, 821, 823, 831, 832, 842,843, 848, 854, 879, 881, 883, 884, 896, 898, 912, 914: n = A,T,C or G
  misc_feature 919, 924, 925, 930: n = A,T,C or G
nnnnnngannnnanagannnnnnnnnngannanntcctnttnnnntagganttgnaaatncctcgttctaaatncttggtaaacncctngctnnanggtncgngccactntgtccggnncgagggtgggcncacacnctaatntcnctgggtccatggtantnccnattangcatgctgtgttnntgcanatgatgtantacganatccacggtgttnggttaatgatttattcactcattagtcattccacaaactagtctngagcaccngttatgnacccancactgtgctggaatgctgaggagacaggagtgaagtaaaaagacatggntccngcaggaaacaggcaaggagagccttgacttgacggantctggcaatancgccaggctggaatgcaatggcgcgatctctcctcactggancctacgnctncngggntnaagcaantctactgcctcagnanctggagtanctnggnactacaggcnngcgctaccacncgcnnatgagaaaacttnnngccacagagaggtgaaataagtgagatgcttnctaacctaatgcganaaccncgtgaaaagatttttggcaacctgaaaaatcccatnctnnnntgaggattntatngncaaccngnaatcaantcttaggnaanatgaatgccnnttcgggantaaattcnatttttnntnatctcccannaaggaaggaaaacntnnnaagcctctangaatnatnnngncttnctaacccngngtantcaaaactnttnncnaatctattggnaaacccgatctaganntttttnaatnaccntnaaaatctnnaaaagaaagnncaatnagtatnttattcactcgaaaagtctccaaancncnntaaaagaactcnantggaccaaactacncnttggnggaannttaancc

SEQ ID NO: 5682 - DNA, 1358 bp, Homo sapiens
  misc_feature 4, 5, 14, 15, 16, 24, 35, 43, 50, 53, 69, 74, 80, 82, 84,96, 97, 102, 108, 112, 114, 120, 122, 124, 126, 133, 137,143, 145, 148, 150, 153, 157, 161, 176, 177, 181, 192, 193,194, 196, 201, 207, 215, 216, 217, 234, 239, 240, 242: n = A,T,C or G
  misc_feature 249, 250, 253, 254, 255, 256, 258, 264, 265, 267, 271, 273,274, 276, 285, 289, 297, 300, 309, 316, 319, 323, 325, 328,331, 332, 357, 358, 383, 390, 394, 396, 400, 401, 404, 405,408, 410, 414, 423, 426, 433, 434, 439, 442, 449, 450: n = A,T,C or G
  misc_feature 451, 456, 457, 462, 467, 472, 474, 475, 479, 481, 483, 485,487, 491, 494, 495, 497, 498, 502, 503, 504, 512, 514, 526,527, 528, 529, 530, 533, 535, 536, 538, 539, 540, 544, 546,550, 552, 561, 563, 565, 568, 571, 584, 587, 592, 594: n = A,T,C or G
  misc_feature 605, 606, 607, 614, 615, 618, 625, 626, 629, 635, 639, 642,644, 645, 646, 647, 652, 653, 663, 679, 683, 686, 687, 690,692, 696, 702, 711, 716, 717, 722, 723, 724, 726, 727, 728,732, 737, 738, 739, 741, 748, 749, 750, 757, 765, 773: n = A,T,C or G
  misc_feature 775, 778, 787, 788, 789, 802, 823, 824, 826, 829, 830, 837,849, 850, 851, 852, 853, 855, 858, 865, 873, 874, 878, 881,889, 890, 893, 895, 896, 910, 912, 921, 924, 927, 940, 941,943, 958, 965, 966, 967, 973, 975, 977, 980, 986, 988: n = A,T,C or G
  misc_feature 990, 992, 996, 1001, 1007, 1018, 1020, 1027, 1033, 1040,1041, 1043, 1046, 1048, 1069, 1082, 1092, 1094, 1097, 1099,1108, 1117, 1119, 1126, 1131, 1141, 1144, 1148, 1149, 1152,1157, 1160, 1164, 1169, 1173, 1176, 1179, 1184, 1186: n = A,T,C or G
ttgnnggaaccccnnntttttttnttaaaaaaaanccccccantttcccnaangggcccttaacctccnggttnttgtantntntttttactgatnngaaangagcanaacncncagatngntnantgtaaantttnctatcncnccncnaangtancttnctttgtatccaaccnnggtntagtcgtctcnnncntagancttaantatataannnataaacacctaccgtgntatanntntgtacanntannnncngcgcgnngngcancnnangtcatatanaccntgcgccanatncttctacanactacanccntatnanggnttnnataaagttcttaataacgcatcatnntgttcaacaactggggtagctatantgaacantctnancacnnaannatngnttcncaaaagganaancatctcnntatangantaccctnnntttgnncaatnatatnaaatncnntgancnancncncgtntgnntnnaagnnntgaatctngncaatatgttggnnnnngcntnntnnntttnanattnanaaaccttgncntnatnatncatgtggtatgtnaanacgtncnttaaaataggnnnaagacgnnccnattgccnnacnttatanaatntcntnnnnccatnntgctcgattntgattacaaatattgntgcngannggnanaatnacctcnatcttgatnccttnnaatannnannnaaanaattnnntnctttctnnntcacacnacattccnacgtaccntnatnatctttgtnnnacgtcattgtacnaacaacttaatgtagctttgnnanacnnaacaatntcctctctttgnnnnnanggnatgcacncatttccnnttgntantaacctanntcngnnaatattgtaatagncncttaacgcntcnaantctcgggtaatcnnancaaaggtttgtcacnaattctnnnccgttncnangcntaactntntncntaanacatngattgnttaactcgaangnatatgancgcgancgcatgnncncanancgtcacttcttgggatacccncgctctactttanactctttaangncananggttacganactgcactngnactgtangcttngtttactctnccnccgnnaanactcntcnatangatgnttangcnccnacgcnannntnncgnantctatncgagcanantnaacnnnctccanatnaanaaaatngtnnntgtngnacanataanngacntatccttctgtatattctcgacgcgaananatggtacgtgagngntttacntaangtancanatntgnggttnacactnnnntatncgagcctccg

SEQ ID NO: 5683 - DNA, 716 bp, Homo sapiens
  misc_feature 2, 3, 4, 8, 10, 89, 106, 107, 176, 236, 252, 272, 275, 276,298, 301, 311, 328, 331, 347, 358, 372, 374, 395, 423, 516,543, 549, 564, 586, 604, 617, 621, 632, 646, 669, 685: n = A,T,C or G
gnnntttnanatcagctacttgttctttttgcaggatcccatcgattcgctgaaatgtcaaacacggccacctaggcagcatttacaancaagagtccactgcttnnttgatgtatatcttaagcgcccccagtgaatgaacagcatataactccacataaaaatcattaaatgtnattgacttccagagcaggcagttctgtgtgtatgcctctggagaaggctggctgaattgnaattggtctgtacctnctgcctatcatgtacatgangtnnttgggcaaagagaactttccanaanataagtccanaaattatagatcatcanacnaccaatgacatattgntgagatatctncaagatctagaatngncctgggtgtcaaggaagtctntggggtttttacaaatattgataatgcnctttttataaaatgcactttttataaaaatgcatgctcacttgagacaacttgaaaaacacactagaaaaggccgggcgtagtggctcacgcntgtaatcccagcactctgggaggccgngacggntggatcacgatgcangagattgagaccatcctggctnacatggtgaaaccccgtntctactaaaaatncacnaaaattagcanggtgttggtgacgnggcgcctatagtcccatctactnaagaagcttgatgcangaaaaatggtgtgaacccaggaaacgagctt

SEQ ID NO: 5684 - DNA, 758 bp, Homo sapiens
  misc_feature 2, 17, 73, 135, 172, 185, 192, 198, 247, 255, 302, 389, 435,436, 475, 514, 524, 525, 526, 602, 626, 647, 681, 685, 692,695, 696, 701, 702, 703, 712, 720, 726, 728, 739, 741, 743,749, 757, 758: n = A,T,C or G
angcagctcttgttctnctttcaggaccctatcgattcgaattcggcacgagccaagctgtaccagagtgcangaggcatgccaggaggaatgcctgggggatttcctggtggtggagctcctccctctggtggngcttcctcagggcccaccattgaagaggttgattaanccaaccaagtgtngatgtancattgntccacacatttaaaacatttgaaggacctaaattcgtagcaaattctgnggcagttntaaaaagttaagctgctatagtaagttactgggcattctcaatactngaatatggaacatatgcacaggggaaggaaataacattgcactttataaacactgtattgtaagtggaaaatgcaatgtcttaaatnaaactatttaaaattggcaccataaaaaaaaataaaagaaaactcnngcctctagaactatagtgagtcgtattacgtagatccanacatgataagatacattgatgagtttggacaaaccacanctagaatgcnnngaaaaaaatgctttatttgtgaaatttgagatgctattgctttatttgtgccattatgagctgcaataaacaagtnaacaacacaggttgcattcatttnatgtttcaaggttcaaggggnaggtgtggggaggctacttaatttcattgacgcngggnccttgcnttnngggcnnngaccccagntttttgtncctttngnggagggttaantncnaacttngggttaann

SEQ ID NO: 5685 - DNA, 739 bp, Homo sapiens
  misc_feature 3, 4, 5, 7, 9, 23, 24, 25, 64, 100, 102, 104, 117, 128, 133,135, 144, 145, 147, 186, 187, 198, 199, 212, 225, 228, 232,239, 240, 243, 249, 251, 252, 255, 256, 257, 262, 266, 267,269, 275, 276, 279, 284, 286, 287, 293, 299, 300: n = A,T,C or G
  misc_feature 302, 304, 311, 314, 315, 318, 321, 327, 335, 336, 337, 347,350, 354, 357, 360, 364, 384, 386, 388, 396, 397, 398, 399,401, 416, 417, 430, 508, 538, 545, 581, 587, 596, 603, 611,612, 614, 620, 623, 633, 638, 645, 647, 649, 652, 677: n = A,T,C or G
  misc_feature 688, 691, 696, 700, 703, 705, 716, 719, 728, 731: n = A,T,C or G
agnnnantnctatgatcccttgnnncaggatccatcgattcgaattcggcacgagtgcctttgntccccaactctagggagctagtttcatacatttaanancnctgcttacctcanagctccctttnagcancngcagacttnnanatctgtttaaccagttccctatattaaattctctctggnnaaatacatggnngggctttgattanctgctgaaccctnagngatncataccnnatnatgctncnnaannnatgcnatanncntacaannatntgtantnnaggatncctatnncnanactgctngtnntancancatcancatgacannnacctttaaangtnttcnatntanctanaattatctaaaatgttaaangncntaaaacannnnantaagcaaaagatganntcaagtgtatgtncatttagtagtgacttgtgagatttgacgtgttcatgacagctggctatttgtattgtctgaatgatagtgtatttgngtactttgcccattgcctattggggcattntaaaatngatccttaggtaatgttaattaagaacattgacctngggcanggcgcggtngctcacncctgtagnncnaacacnttncgagggcgangcagnaaattcnananaangagtttgatacatctgggcaacatngcgaaacctgnctntctanaatntananttagccggcanggnggagctgcngantccagtag

SEQ ID NO: 5686 - DNA, 750 bp, Homo sapiens
  misc_feature 5, 6, 7, 19, 23, 25, 92, 103, 108, 114, 127, 159, 196, 197,204, 223, 312, 322, 350, 357, 383, 420, 422, 450, 451, 474,499, 516, 525, 532, 572, 582, 602, 604, 608, 625, 647, 661,665, 728, 749: n = A,T,C or G
ttatnnntaccgctttgcnactncncgcaggatccctcgattcgaattcggcacgagggtgattcagatgatggcgaagatggtcgaggttntgagaacgganaaatnaaggcncttcggacagctnctctggcaatgtatctgaaggggaaagccctnctgacagccatggaggactctttccagggaagacagnnatcaaangacaaagctgccactccangaaaagatggtcccaaacgttctgtactgtccaagtcagttcctgggtacaagccaaaggtcattccaaatgctatatgtggaatttgnctgaatggtnaggagtccaacatgaaaggaaaggctgnatcactnatacactgctcccaatgtgagaatantggccatccttcttgcctggatatgacaatggagctngnttctatgattaagacctacccatggcanngcatggaatgtaaaacatgcatnatatgtggacaaccccaccatgaanaagaaatgatgttctgngatatgtgngacagangttatcatactttttgagtgggccttggtgctattccatnacgtcgctgnatttgtgactggtgtcaacngncccncccaacacccagtaaantgtggcaaaaaggggaaaaatnagcaaagagggatnaaancgtttttgactctaatctgtatatgcatttaagtggaatatttggtgccattttcaacattantttcatgcccataaaagaatnt

SEQ ID NO: 5687 - DNA, 730 bp, Homo sapiens
  misc_feature 2, 3, 23, 528, 621, 631, 670, 683: n = A,T,C or G
tnnctttgattcaattcatagcnactggttctttttgcaggatcccatcgattcgcccagggccgcctgcctgagcctctctgcagctgctcacctcctgctgaggcctctgccttcagagctagtggggcctgctcacacattccagtagtttcctctttatttgtcctgaaccaagttgtagaatttaaaggaggtgaagtaaggcgatttctatggaaaatatatttttcttctttactcctcatgctgagtgcataagaatttattatttcccctgaatgttcaaagtggtgtgtgtgtgtgtgtaaaagaaccaggagcaaacaatcttaataggaatgtgcgatcttgtgtttatctttagcacacttaattagctacaacccgggactgttgccatttgaacaagttgttaagaaaatctgccatgttttgctctttttcaaaaggaatgactttaataaccatagcaacacttactcagttttgtgatccactccaagattatgggagcaagaacagatnctcctgaaagcaaccctcaccttcttccccgcccctgccctcagcaagtcctggcctgtgtgaactgaagggtttggaagctctggtttctangagtgcccanaactagaaagactagggtgtctaattatttgaggggcanttgtcaatggcantgtggggggcaccccattgttatttcgaggcactgcattgctttttt

SEQ ID NO: 5688 - DNA, 818 bp, Homo sapiens
  misc_feature 2, 7, 12, 14, 17, 23, 36, 92, 107, 108, 109, 110, 111, 114,116, 117, 128, 142, 144, 176, 185, 198, 199, 200, 208, 214,225, 228, 229, 250, 292, 294, 320, 321, 333, 334, 337, 365,378, 380, 390, 392, 395, 396, 397, 422, 425, 433, 461: n = A,T,C or G
  misc_feature 469, 483, 487, 493, 497, 498, 501, 505, 506, 519, 538, 549,552, 553, 557, 566, 567, 577, 578, 582, 584, 586, 609, 621,635, 648, 650, 658, 660, 667, 670, 683, 686, 700, 702, 707,712, 715, 718, 722, 734, 735, 751, 759, 762, 767, 780: n = A,T,C or G
  misc_feature 782, 789, 792, 795, 800, 803, 818: n = A,T,C or G
tntcctncgcgngncgnattccnctaaggagaggcncggatccctcgattcgaattcggcacgagtctcgatctcccgacctcgtttccgcntgcctcggcctcccnnnnngcngnnattacaggcgngagccaccgagctngncctggatcaaatcttaatccatgcgcatgggnacacaagantactgggttgaannnattctagntttgtnatttaaatacntgnngatgaatctattttagcacanggtataaataactcgggaggtcatctctatcttctctccttnantgcatttgggtataccacgtttaagnnctaaaacagctnngcntatgttggccaggggaaaacatggcatnctgtgcgcaaagntnaatgatcgcngnccnnncttggcccctccctgggtttatggncancgtaagangcccgcatgttaaagcttaaaccgtcanttgggctnggtgtaaatccccnattnaattcntggnnggncaannctcttgaccccgnaaacaatggaaagggccanctggggcctcnaanntgtnggagccccnnttaacaaacnnttantngnaaacctttggaattccaaccttnaaagggaggggnaccatggaagatanttgagtggcccgntnggaattgnanccccttnaangcaattagtttcnccnaattttcctggttnanaaaanatgcnccnaanaccnggggggcccaannctgggctaaagccggnggggctcncanaaccngggtttttaactntngatacantanggngaaanaangggcccctttttaan

SEQ ID NO: 5689 - DNA, 748 bp, Homo sapiens
  misc_feature 10, 11, 20, 30, 33, 38, 45, 55, 58, 66, 69, 74, 78, 79, 84,87, 90, 92, 95, 96, 103, 104, 121, 125, 130, 133, 134, 146,151, 163, 174, 178, 179, 191, 194, 197, 198, 199, 206, 210,214, 227, 232, 260, 261, 267, 269, 274, 278, 281, 286: n = A,T,C or G
  misc_feature 288, 290, 305, 307, 320, 323, 328, 341, 349, 354, 357, 374,377, 395, 396, 417, 429, 430, 431, 437, 443, 448, 449, 456,463, 475, 480, 510, 512, 520, 540, 544, 571, 576, 577, 579,586, 597, 601, 637, 639, 645, 665, 668, 674, 676, 683: n = A,T,C or G
  misc_feature 687, 695, 704, 705, 706, 707, 713, 722, 728, 730, 743: n = A,T,C or G
agcttcattnnactatcagntgcgctgctntangtgcnggatccnttcgaatccngcncgaggcgnganggcangganngcagngcncangnccnnttaagcnnttttctgtcttatcacncagngaatnaanntgaactggatcngaacnatcccatattanccgatcctttnctcnnatgaaagaaaanacntannnagaacanatangctnaaactgatacagnaagtngccgtcagcctctagaactatagtgagnngaatgncntacanccanacntgatnananacattgatgagtttngncaaaccacatctngantgcantgaaaaaaatgcnctattcgngaaancantgatgctattgctttanttnggaaccattataagctgnnataaacaagctaacaacaacnattgcattcatnnnatgctncaggancacgnngaggtgnaggaggnagtgtaattcgnggccncggagccaatgcattgggcccagacccacntntgaccctntagtgagggttaatggcgcncttngcgtaatcatggtcatagctgcttccngcgtnnanttgatanccggtgcaatntcancacatacgaccgggacataaagtgaaagcctggagnancctaangaagtgaccaactcacattnatngcctgngntaactgncccnttccagtngggaaaccnnnncgccanatgcttaangaatcngncacccgccggganaggcg

SEQ ID NO: 5690 - DNA, 704 bp, Homo sapiens
  misc_feature 2, 3, 6, 10, 11, 20, 21, 22, 23, 24, 25, 27, 43, 45, 46,69, 76, 81, 86, 89, 94, 95, 98, 99, 107, 109, 112, 124,130, 131, 138, 141, 147, 158, 184, 188, 210, 214, 219, 224,226, 228, 230, 246, 249, 253, 261, 269, 280, 282, 287, 292: n = A,T,C or G
  misc_feature 295, 296, 301, 302, 314, 322, 324, 338, 341, 359, 361, 365,369, 383, 386, 408, 412, 430, 431, 438, 441, 442, 443, 446,452, 453, 457, 460, 462, 467, 469, 472, 476, 481, 491, 493,497, 502, 504, 507, 509, 529, 531, 541, 549, 550, 561: n = A,T,C or G
  misc_feature 572, 590, 595, 604, 607, 614, 626, 630, 648, 651, 652, 654,662, 665, 666, 668, 675, 677, 690, 691, 692, 696, 703, 704: n = A,T,C or G
gnnttnaaannttgcttggnnnnnncnctttccgcaggatccnanncgattcgaattcggcacgaggtncagctcncctanctggnatntgggnngtnngaaacatncnctntcctgataccantgtgcnngaatcanganacatangccattacacngcgtctatgcaagcttgcacataacntcangtactgcagctcacacaccctntgcnaggcngaatnantngntctgcctccggatacnaanaatntcggctcngcctcagngctaatgatcntnatgtngtgtnctnnagtanntgctgtatctgngtgttatntntgccaaactctagntantgatcttatgatcccttntngaantaanatggggttcttgantgnctgagaacgacttgcacaatgngttnattgtggcacgtcatctnncaatgantannnagnctattnnccanggnanactcngntcntacntggcnctaagcactntnttgncgatngncancnctctgtgaaatggaattacngntattcatggntaattacnnattttggcccnctttctgtttntacaatgaaggcttaaanctaantgtccaaantgnataatgntcccttaattanaagnctacttcattcaagtganaanngnccgtaatnaanncntactctncnactgcataatatnnncctnaggactnn

SEQ ID NO: 5691 - DNA, 758 bp, Homo sapiens
  misc_feature 3, 5, 10, 17, 20, 645, 700, 716, 727, 735, 738, 751, 754: n = A,T,C or G
agntntttcnatttctnatnttgttctttctgcaggatcccatcgattcgaattcggcacgagagcagcttaagcagcagacgcaaaatcgaatgaagctaatggccgacaactacgaggatgaccacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattncagcacccgtttctacatctgccatcttactctgcctttctgctttggatgtggnctctacactaaccttnttgatgtccanggtagatnaanggtcgaatctttntgnaaaa

SEQ ID NO: 5692 - DNA, 1030 bp, Homo sapiens
  misc_feature 6, 16, 18, 21, 24, 25, 27, 36, 43, 45, 47, 49, 50, 51, 59,60, 73, 89, 138, 140, 141, 147, 151, 158, 163, 182, 203,212, 217, 228, 243, 246, 253, 277, 294, 297, 306, 310, 315,325, 348, 352, 359, 366, 370, 375, 379, 387, 390, 392: n = A,T,C or G
  misc_feature 396, 407, 409, 425, 427, 429, 430, 436, 446, 448, 449, 458,462, 475, 476, 489, 493, 495, 496, 497, 498, 506, 508, 511,513, 515, 524, 535, 536, 546, 550, 551, 554, 555, 559, 567,568, 572, 573, 574, 583, 586, 591, 599, 601, 606, 611: n = A,T,C or G
  misc_feature 612, 614, 619, 624, 627, 628, 631, 637, 638, 639, 640, 645,646, 651, 658, 666, 667, 669, 671, 676, 680, 683, 685, 698,701, 702, 707, 712, 716, 718, 726, 732, 741, 746, 747, 751,760, 766, 772, 777, 783, 784, 794, 801, 804, 807, 811: n = A,T,C or G
  misc_feature 815, 819, 820, 824, 825, 826, 827, 832, 833, 839, 856, 857,861, 864, 870, 871, 873, 876, 877, 881, 882, 883, 884, 904,919, 920, 922, 929, 935, 937, 942, 948, 953, 957, 964, 966,967, 986, 994, 1003, 1012, 1019, 1028, 1029: n = A,T,C or G
gcgtcncactttgaancntcnaanngngggcaatcnaatcgcncnangnnnctaggtanncgaattcggcacnagagcaggcgcttggnccctaaggtggatgttagagtagtgattatggtcagcgtgggtgctatncnngtgttncagnttttcanctggnggaatagctacaataaggnaatcagctacctagccacagngcccaagtnccgtntccaagctacngagattgccaagcancanggactgntcaaaaaagccaaataaaaaggcnaaaacaaaaagtccaangangatatccgngacnaggangagaacatcntaaagaacattataaaaagcaanatantatttanagggtgnctantcagnaacnccaaatantgngnatcntcctctgtatnanatcaatcctagctccntntnncctatnctcatatccnannctggcatangtcnggagagatctacnntttcaacatcaancggntnnnnattatggnanagnantnacagatcantccattctacnntaaatctatnaccnngtnnactnctctattnnaatnnnactatgaanatnctctnaactaaancntttcntttanncnaaaancctcntgnnctncatggnnnnaattnnttacngtccttnccaaaccnncnanacacncacngancntaatcttcacaantannaacantctgngctnanctcgaacncccctnaattggctnaccannatcntccactggnatcatncggtantgganttaaanngcaactcggntctctgnggnctnctgnattncaannatcnnnntgcgnntatttntcttgcacacaatatannctcncgnaatttnncntanncttnnnnctctcaaatactctctctanacatagagcaattanntntctgatnatactntngaccncgtcantcacnacgngcacaanannatatcattgtacattcatntatctgtngactttacnacagtcccngccaatntaacaaacnnt

SEQ ID NO: 5693 - DNA, 761 bp, Homo sapiens
  misc_feature 2, 5, 9, 11, 26, 29, 33, 104, 514, 521, 565, 588, 589, 598,601, 603, 607, 619, 630, 634, 644, 648, 653, 656, 657, 659,661, 664, 668, 676, 677, 678, 679, 680, 682, 683, 688, 689,691, 694, 696, 707, 708, 709, 711, 713, 714, 717, 718: n = A,T,C or G
  misc_feature 725, 726, 727, 728, 729, 731, 732, 733, 734, 736, 737, 740,745, 747, 748, 749, 750, 751, 752, 753, 754, 757, 761: n = A,T,C or G
cnttncctnancaggtatggccattnccntttntgcaggatcccatcgattcgcctgtccgagagagccccgctcacggggcacagctgctactttttaggccntgctgcacttccggacccactgcttcaactggcactcccccacgtacgagtatgcgttgagacatttgtacgtgctggtcaacctttgtgagaagccgtatccacttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggangtttgtnggtttgcctgcagttttgaggagcaggaagctcatgggggcttntgtaccccctttaaaaggagtcnntattctganaantngaanctgaaacctttntaaatcttcanaaangattttattngaanaaggnccnnancnccnaaanggaaaacnnnnntnnaaaanntnatnantttttgaaagnnntngnnttnnaaactannnnngnnnncnnaanccaancnnnnnnnnaanaccn

SEQ ID NO: 5694 - DNA, 863 bp, Homo sapiens
  misc_feature 3, 18, 20, 24, 104, 225, 275, 290, 347, 502, 544, 549, 567,622, 644, 645, 652, 658, 679, 740, 754, 775, 802, 811, 832,840, 845: n = A,T,C or G
ttnacatcaagctcttgntnctanccccttcctcgattcgaattcggcacgaggagagagagagagagagagagagagagagagagagagagagagagagattnagagagagagagagagagagagagagagagagagagagagagagagagagagagagagagagagagagagagagagagagagagagagagagagagagagagagagagagagagagagctnaagggaaggctgccgggaaggcaaatggaacaggaatggacctgtctcangaaggccagctgcangtcctccacaaaatcaaagaagggaagaaactctgagtttgaggtacaggggcttcngggtgcacacgtccctccagggcccatggtcagtattgcacctgtgttatgaacccccatatctgtgcagggcaggggcgggggctgctgttttattggggaggggagcctcctaaaaatggggtccaggcagacccctccagacctcacactgncgaggaggcctttcccaaaggggcgttctccccgggatgcanaccgnatgttttgtgggaaaccnccctttaaataccccacaccgacgtattccttgttcccgactttttcccgggttntttgttttgaaaaatacctgtnngtttcangcctcnttggatcttaaaatgggcaanaatagggaacctttttttttgtcaccaaaaaaaatacctggggggggaaaaattgtttgtnaaaaaaataagacntttttgggaccaccaccaacnttttttggggggctttccaccttgaanctttccaanttttttttaaaccatgggganttttattnaaccnttaaatggtttttcttgg

SEQ ID NO: 5695 - DNA, 761 bp, Homo sapiens
  misc_feature 9, 15, 19, 29, 30, 41, 46, 74, 95, 102, 104, 107, 123, 132,133, 144, 145, 150, 152, 161, 162, 171, 222, 223, 259, 308,437, 444, 461, 468, 486, 492, 530, 552, 572, 579, 600, 615,616, 617, 621, 630, 638, 645, 646, 651, 653, 656, 659: n = A,T,C or G
  misc_feature 667, 673, 684, 691, 704, 721, 724, 750, 758: n = A,T,C or G
cgcgggcgnaagcgnagcncttcccaacnnccttggatccnatcgncccgaattcggcacgagtatgggcttgnagaaatgctaccgtttttttncccgttnanacntggatcccgaaactgnactaacgtnnagtatcaggcnnaatgncnggaaagggnnggcttatgnaggcaactacagatagttgtaagggatcatacagaagatattgatgatagnngaaatattcttagaaggggtgtgtatgtctagctgngtctaccatgtgtatgtattcttgacaagcagtataaaatacctgtganttttctttacattagggataatgcataaggaattaatcttcatatatattatcatccctaatgtagcagggggaagtatttaattgcccatgatatgtattttacttatactatgccagagaggaaacnataaagnaattacacatgtaatcntgggttnttcacatatgtaggtatncatttngagtaggttgaagaaagaaaaaaaatatttaaatgaantgaattcctgatgggatagtancaataagtatttaaaagccngtattcnaaaaataataaagggtacggncatttttgagcttgnnnttcntttgctacnggaaatantccaaannaaagngntancantggcaccngctggnctcaacgcacntattggnaaccgcactgganaggatgaacaaggggtnagncaatagcaaacccctataacattccnggccaaanacc

SEQ ID NO: 5696 - DNA, 779 bp, Homo sapiens
  misc_feature 11, 16, 638: n = A,T,C or G
ttgaacctttntacanctcttgttttttttgcaggatcccatcgattcgaattcggcacgagaccaagtagaccagaaactgaccattctcagtcctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttncagagctcaataaggtcaaaaaggaagttacctctgtgacatcttgggatgtaaacactttgggatttggtatagaataacccattgaaatttctgctgtgccgaaggtggtagaaatttacttttttgggtatatcttat

SEQ ID NO: 5697 - DNA, 825 bp, Homo sapiens; identical to SEQ ID NO: 516
  misc_feature 13, 22, 28, 33, 34, 47, 85, 101, 112, 123, 128, 130, 135,141, 142, 151, 154, 155, 177, 178, 189, 191, 193, 197, 202,208, 210, 213, 214, 218, 219, 234, 238, 263, 270, 276, 278,304, 319, 334, 344, 345, 352, 364, 375, 382, 383, 384: n = A,T,C or G
  misc_feature 394, 396, 404, 407, 444, 459, 460, 468, 472, 480, 483, 500,503, 512, 528, 534, 536, 538, 557, 561, 575, 577, 584, 589,592, 597, 599, 601, 623, 627, 630, 636, 642, 647, 656, 659,666, 668, 671, 685, 686, 702, 706, 707, 717, 720, 721: n = A,T,C or G
  misc_feature 725, 727, 728, 734, 746, 747, 748, 751, 752, 767, 770, 779,795, 796, 810, 813, 821, 822, 823, 824: n = A,T,C or G

SEQ ID NO: 5698 - DNA, 1090 bp, Homo sapiens
  misc_feature 41, 45, 59, 62, 63, 64, 69, 72, 77, 79, 82, 90, 93, 108,110, 111, 123, 124, 125, 126, 131, 134, 137, 149, 152, 161,162, 179, 180, 186, 193, 196, 212, 227, 230, 235, 236, 243,247, 250, 264, 278, 284, 288, 313, 338, 339, 350, 351: n = A,T,C or G
  misc_feature 358, 360, 361, 381, 383, 385, 387, 398, 403, 405, 414, 416,418, 422, 424, 428, 439, 445, 453, 458, 470, 472, 475, 478,480, 486, 498, 516, 531, 534, 542, 554, 556, 564, 565, 568,570, 574, 591, 593, 612, 617, 620, 629, 636, 640, 661: n = A,T,C or G
  misc_feature 680, 683, 684, 692, 694, 696, 701, 705, 708, 725, 732, 735,741, 751, 756, 774, 775, 782, 791, 793, 797, 799, 801, 805,811, 822, 830, 831, 832, 835, 840, 845, 846, 867, 868, 874,876, 883, 891, 899, 905, 907, 911, 913, 919, 938, 949: n = A,T,C or G
  misc_feature 961, 966, 967, 969, 972, 979, 983, 990, 991, 992, 996, 1000,1004, 1005, 1007, 1008, 1012, 1014, 1022, 1024, 1026, 1027,1032, 1042, 1043, 1047, 1049, 1070, 1081, 1084, 1085: n = A,T,C or G
gaaaggaagcacgcaaagcaactcccagcagcatcccagcnaaangcccagaggaaggnacnnngcagnacnacccncncgngcaccgcnttnttttccccagtaggngnngacacgccaacnnnnggggnccncgnggacaagaggcngancccaaaacnngacagggcaaggacccnncagacncgggganggngaccagagcgcggccnagcgagaaacagccngcnaccgnnaggccanaaancangccgctgaaggganccgggctccggccntaaacnccancactgacacgacccagcaaaccccncaagaggaaaaagacccccaagggnnaaacacaagcnnagggcangnncacgggggacccccgaccgncnancncggggaagccngccgnangaacggganangncacnangggngcataagaccnaccacncagggccnaccanggagaaaaaaanancgnacnanaaaggncaaaccgcaacnccggaaggggcacccacnaagggggaacccccnaangggctcgnaccgggcgccantngccaaagnnggncncccncaaacgacccggggggncnaaacccccccgggggccanccacncanggggggganccccaangganggcaaagcccccaaagccccnccgggggcaacccaaaaanccnnggagcccngngncccanaganacnggaaacccgggggacgnccccaanacncagacnaaaaaagcgngggancccccaaaaaaagcaaanngcacacncccccgagngnaccnangncaangggggnaaagacaaaanagaccccnnnganaaganccccnnaaaggccccacgggggaaacnngggacncncaggggncccccccnggggaccncggggngngccnanaacccncaaaaaacgggggaaaacncccccccccanaaaaggcccacnggacnnanaanccccccncccngggaggnnncccnaccncccnngnncccnangaaaaacnanannggggnaaaaaccccnngggngnccaaaaaaagggggaaacccnccgaggggggnganncccgc

SEQ ID NO: 5699 - DNA, 779 bp, Homo sapiens
  misc_feature 6, 7, 10, 18, 62, 68, 69, 73, 77, 79, 85, 87, 88, 89, 97,102, 104, 105, 114, 115, 117, 118, 124, 125, 159, 163, 165,166, 167, 169, 173, 183, 217, 219, 220, 233, 244, 247, 260,262, 266, 275, 286, 292, 297, 301, 302, 308, 309, 310: n = A,T,C or G
  misc_feature 319, 320, 322, 330, 331, 335, 336, 340, 343, 347, 348, 353,354, 360, 362, 368, 374, 397, 401, 411, 418, 420, 425, 427,430, 437, 441, 454, 457, 464, 465, 477, 481, 491, 494, 495,502, 508, 509, 511, 522, 543, 565, 588, 591, 601, 606: n = A,T,C or G
  misc_feature 608, 612, 616, 617, 625, 626, 628, 631, 632, 640, 650, 656,662, 665, 674, 679, 682, 694, 699, 704, 718, 722, 753, 754,762, 771, 779: n = A,T,C or G
gctaanngcnggctactngttctttttgcaggatcccatcgattcgaattcggcacgagggntggggnntcgncggncncgctangnnngccatacncaatntnnagagtctanngnntgtaannttgctgcttatatgtacctgtgcttatattcgancctngnnncncatncttctggacngaagtaagactggattgttgggtatattaggggnanngtgccagagatcngtgaacggcanagnccttatgtggccnantgcngtgtaatantggccttaagnatcctnttcanacannagctgnnnaaaatgccnnantgtagcanncatnntatnagnttgnnaacanngactgncngcccanaataanggctgggatgttgaactctggantctncgaacattgngtgagananattgncngangctgtantctnttttaatgtgatnggnccaatgnnctgtataaaccnttangatgtacccnttnnatattcngtaccnntnatcctcagtantgtcactacagtatcacatantgcatatgttatcctgttgtancagatactgaacttagtgaggtntcnctaaggcacntagananaaancaannttggttanntnctnncgtatctntcactgtganttgcanatgatntantctttatanaatgnganccttttaccggnctaanttttnaattaaaatggctnattntgtgttgataaaaaaaactcgagcatacttnnaccctctngaactatanttgagtcn

SEQ ID NO: 5700 - DNA, 1776 bp, Homo sapiens
  misc_feature 3, 10, 11, 12, 15, 20, 21, 25, 27, 29, 34, 35, 36, 59, 67,68, 69, 70, 80, 85, 87, 88, 93, 95, 99, 107, 108, 109, 111,114, 116, 119, 126, 128, 133, 136, 137, 140, 143, 144, 145,146, 147, 148, 150, 153, 162, 165, 168, 174, 176, 182: n = A,T,C or G
  misc_feature 184, 185, 192, 197, 210, 213, 218, 220, 221, 222, 226, 227,230, 234, 236, 239, 242, 244, 248, 249, 264, 271, 272, 282,283, 285, 292, 294, 295, 297, 300, 306, 307, 308, 309, 310,312, 315, 319, 320, 322, 324, 326, 333, 334, 338, 339: n = A,T,C or G
  misc_feature 342, 343, 344, 350, 351, 360, 362, 364, 369, 371, 372, 373,376, 377, 378, 380, 386, 387, 388, 391, 395, 398, 399, 400,406, 411, 414, 416, 418, 419, 422, 423, 424, 427, 429, 435,440, 441, 443, 448, 449, 450, 453, 457, 459, 461, 468: n = A,T,C or G
  misc_feature 469, 470, 471, 473, 481, 482, 483, 485, 486, 487, 489, 490,492, 496, 497, 499, 500, 504, 506, 517, 525, 526, 529, 533,534, 537, 539, 541, 542, 544, 548, 549, 551, 553, 558, 561,565, 567, 568, 569, 570, 573, 577, 579, 580, 583, 585: n = A,T,C or G
  misc_feature 587, 590, 592, 593, 599, 600, 601, 602, 604, 605, 613, 617,623, 635, 638, 639, 641, 646, 654, 660, 662, 663, 664, 667,669, 671, 672, 677, 694, 695, 697, 707, 714, 715, 719, 722,723, 728, 736, 745, 747, 752, 756, 758, 759, 762, 764: n = A,T,C or G
  misc_feature 765, 768, 778, 780, 784, 786, 788, 790, 792, 802, 808, 809,814, 815, 817, 820, 825, 836, 840, 841, 847, 853, 854, 856,858, 862, 864, 868, 870, 881, 882, 885, 886, 887, 889, 891,895, 896, 900, 903, 907, 913, 916, 918, 925, 927, 929: n = A,T,C or G
ggnggagggnnnggnttttnnaggngngntttannngtggggaaaaaaccccttttttnttaaaaannnnactttggggngaaangnngctgnanatantcggcctnnngngananagngagtcgngnggganagnnggntgnnnnnngnagngatataggntangantagtananggatananngagcagngaacngtagttttttttnagngaganannngagnnaanaggnanacnatnanaganngggggggggcgcaanggggtgnnaaggcgaganncnaactcgnannanaantgaaannnnnanacngtgnnananantgagcgnngatnnatnnntgcaanncataagaantngnaatgnannntgnnngnacaaannnctncganagnnngcaagngaatncgnancnnacnnnagngnagaagnagtannangaccnnnaanggantncngagaggnnnnanaaggatgnnnannnanngnaganngnngaananaagaggagacnaactatannagntagnntgncnanngnagannananaagcnganaganannnntgngagnanncanangnggnanntaaagnnnnannacgtatangagntgtgtnagaactgaaganaannancacgnaaatgaanaacatncnnngancnanncgaangaaaatatcacgctganngnagatagatanacgctcnntatnganncagtnactgtganatctgcganangacancacngnnagntnnacnacacagatgnangctnananangnagcagagtanaagacnnggagnngngtncgcanatatcgatatnaagnntacganagtgannanangaanantgantnaggataacgannagnnngntntatnngggntanaggngagagntanantgctgcncncnanannanngaatncagcgcnngncgancangnnanaatngggnannganananantgtannnanagcaangntannagtgactntnnngtaatngatngagnnagnnganatgagtgctctgncnntagcgaganantacngngaatntntanagagntgtagagnagcagcananannantntcngngtnnaangtagagagcgangganactnnntagtatanncaganacgangangnggtgtgnanncggagtgtagagncgattagagagnaaacnnngncacggtgtatnanagatngagacangangagaactgcnnacaagnanntannnaatangtacnnaatgngancataagtatnacacaggtnactntatanngnncatcaacgcncgantntanaaacnntagnttnacnannaaagctacgttctnnncnagaagaagnactnnanganntngagcngcacganaagtatcgtnggaacgagcantcgtnnatgaganagtanacangcaaanaggaagnnnagnaacagtcacangncagangaaacatnctcacnngnnanttancgnnganacgtaaatgtagacacgnaggagatnaannngatatgangganannnaaagagtanatgcgtantngnatnaganangananaagtnaagagantgacnanatanatgatntanganagacgganganataatctggaagcgnggaanagantagagatagnngaganggatcnngtanacagntcnnngncnnctanatgaganngnncaactgtntatacgatntannnaggnagatcaagaatatacnntctcct

SEQ ID NO: 5701 - DNA, 747 bp, Homo sapiens
  misc_feature 14, 24, 26, 59, 69, 75, 633, 638, 681, 699, 708, 712, 717,719, 723: n = A,T,C or G
gttaatctctagcnaggctcttgntntttctgcaggatcccatcgattcgaattcggcncgaggttaanagaatnaaaaagaatgattgaagccttcgagacatatgggatactataaagccaccacatatttgaatcatttgggtcccagaagacagagaacaaaaggattggaaaactcatctatttttttgttattaaataatagatgaaaacttcccaaatctatcaaatgatttagatatccagaaacaggaggctccaagatccgcaaacatatacaatgcaagaaagtcttctccttggcacattatagtcaaactatctaaagtcaaagacagaattctgaaaaaggcaagagaaaagtgcctagtcagttgtaaagaaaaccttatcaggctaatagtgaatttctcagcagaaaccttacaagccaggaaagaatgatacattcaaagtactgaatgaaaaaaatgctatccaagggatactatatctagcaaaaatattctttgtaactgaaggagaaataaagtcttccccagaaattgcttaagggagtcctaatcctgggagcaaaatgactacatttaccatcatgaaaacttatgaatgtgtaaaacctgctaatanagcantcacacaaaggaataagggaaagtaattaaatggtcctgtacnggaaaaccaccaacccanaattggaanaaanaattnancttnaaaaacctcgagcctcttgaactt

SEQ ID NO: 5702 - DNA, 1197 bp, Homo sapiens; identical to SEQ ID NO: 5535
  misc_feature 14, 23, 31, 32, 35, 42, 52, 61, 64, 74, 78, 84, 94, 95, 99,113, 131, 132, 133, 139, 143, 145, 152, 168, 171, 179, 181,184, 185, 186, 187, 196, 203, 205, 206, 208, 211, 226, 229,236, 239, 240, 245, 249, 251, 265, 267, 282, 284, 290: n = A,T,C or G
  misc_feature 292, 293, 303, 306, 311, 324, 329, 330, 331, 334, 335, 338,341, 345, 347, 353, 364, 365, 371, 372, 382, 387, 388, 394,397, 400, 402, 403, 405, 409, 414, 417, 419, 420, 425, 431,433, 434, 441, 458, 469, 472, 477, 478, 479, 481, 482: n = A,T,C or G
  misc_feature 483, 485, 486, 487, 488, 493, 494, 495, 496, 503, 505, 510,514, 517, 518, 519, 522, 523, 525, 526, 528, 529, 530, 534,537, 538, 540, 542, 543, 549, 550, 552, 553, 554, 555, 556,557, 559, 560, 563, 564, 565, 567, 571, 577, 578, 581: n = A,T,C or G
  misc_feature 584, 585, 587, 590, 591, 593, 598, 599, 601, 605, 606, 611,612, 615, 621, 624, 627, 628, 629, 630, 631, 635, 640, 645,648, 651, 652, 657, 659, 662, 665, 668, 670, 671, 675, 677,678, 681, 682, 691, 695, 698, 704, 707, 708, 709, 711: n = A,T,C or G
  misc_feature 714, 716, 721, 727, 731, 735, 736, 746, 749, 753, 759, 762,765, 766, 767, 770, 773, 776, 777, 782, 786, 788, 789, 792,796, 797, 799, 801, 808, 809, 812, 822, 823, 824, 827, 834,835, 837, 851, 852, 854, 858, 862, 873, 876, 879, 884: n = A,T,C or G
  misc_feature 885, 890, 894, 898, 921, 924, 926, 936, 950, 952, 956, 964,965, 969, 980, 988, 1007, 1008, 1010, 1021, 1026, 1027,1028, 1029, 1035, 1045, 1053, 1056, 1058, 1064, 1069, 1081,1083, 1086, 1090, 1096, 1100, 1101, 1108, 1117, 1126, 1128: n = A,T,C or G

SEQ ID NO: 5703 - DNA, 767 bp, Homo sapiens; identical to SEQ ID NO: 5671
  misc_feature 5, 19, 20, 23, 247, 248, 547, 562, 621, 703, 723, 733, 743,759, 767: n = A,T,C or G

SEQ ID NO: 5704 - DNA, 761 bp, Homo sapiens
  misc_feature 1, 3, 4, 15, 16, 606, 632, 708, 712, 752, 759: n = A,T,C or G
ngnntttaagatcannccaagcgcttggtgcaggatccctcgattcgaattcggcacgaggaccacctacggaaaactgaggcccacataagctcgattggttgtacctccaacagatatttattaagcacctactaaatactgagcccattgcaagcaccagggaagcctctgtgaacagcacaaggtccctgctctggagattctgcttcagtggtggagacagaaaataaacagtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgtctttgccattattctcggggctttcatagcagctgggtctgaccttgcttttaacttagaaggctatatttttgnattcctgaatgatatcttcacagcancaaatggagtttataccaaacagaaaatggacccaaaggagctaggggaaatccggagtctttctacaatgcctgntttntgaattatccaacttcttattattagtggcttcactgganaacctgnct

SEQ ID NO: 5705 - DNA, 984 bp, Homo sapiens
  misc_feature 3, 5, 27, 32, 42, 51, 52, 62, 65, 69, 76, 96, 102, 103, 104,126, 143, 148, 150, 155, 160, 236, 252, 256, 274, 297, 305,314, 323, 331, 342, 351, 378, 386, 417, 426, 436, 442, 446,470, 480, 488, 494, 516, 521, 528, 529, 532, 536: n = A,T,C or G
  misc_feature 544, 550, 566, 592, 596, 622, 634, 642, 652, 655, 656, 661,662, 665, 701, 705, 707, 709, 715, 726, 732, 734, 737, 741,747, 754, 772, 792, 793, 799, 811, 814, 817, 828, 829, 852,861, 888, 892, 903, 906, 934, 935, 938, 945, 948, 962: n = A,T,C or G
  misc_feature 966, 970, 978, 983: n = A,T,C or G
tgngnttttttaaaaaccagctacttnttatnaaggcaggcnaccgattcnnattgcgggangancatngattcgngcccctgcatgatggtggcngaactnnntgcccaaagtggggcctgggancccaacaaccccaacangccgncncggtnaaccnacaatatcaacccgcaaaccccagggacgccggccatgtacaacacagaccagatctctccctatgctgccccctncccacaaggttttctnccancccatgcccagcccccanagctaccaccaagtggtgccaancccagcangctaccatnaatacccantccccatncaggtccaccntacaccgtntaccatggtctatcaggctatccccancccgagcnccgtttggctacaggtctatgacaacctggnagctccctntcccatgggngggtanaaancccaacaaaactgctcaaggcttnaagggtattntgaagcgngaaaantttcgggcagaacttggggttnacccnacctggnncantttntaagggtngaaaanggttgccggggggaanaaccctttactccttgggaattaacnaacnaagggttggggtggggggaacaaacnaacaaagggggngggttaantccccccccngtnnggttnnacnggggtttccccttggggggggcccccaaaagggttngggnangngggttnggagccaaggnaaattncnctntttncctttnggggtanccccccctttaaaacttngggaagaaaaagaaactttnnttcccnaaaattgggtgnaanagncccccaaaagnngggcaaaaagcttggggatttgngggaaaccntaaagggggaaagggggagactttttnaaancccaaaggganggncttttaacttgatttaaacgggggaaannaanggagggnttncttggggaaagganaaantttntgccaaanaaccnc

SEQ ID NO: 5706 - DNA, 772 bp, Homo sapiens
  misc_feature 3, 4, 5, 12, 14, 22, 29, 38, 49, 56, 57, 71, 77, 90, 93,108, 119, 124, 127, 149, 150, 156, 163, 225, 234, 236, 242,251, 282, 284, 290, 299, 317, 319, 329, 334, 338, 339, 362,368, 397, 409, 460, 478, 511, 523, 527, 561, 562, 568: n = A,T,C or G
  misc_feature 581, 599, 611, 614, 622, 626, 643, 659, 667, 668, 669, 682,685, 705, 723, 738, 755, 759, 765: n = A,T,C or G
ggnnnggtttanancagctctngatctcngtgcacganccctcgtttgnatgatcnnatcgattcgctcangtcggntgccatttatggnatnactttattttatttnattgcattatnatatnatnttgagacagagtctcactctgnnacccangctggantgcagtggccggatctcggctcactacaagctctgcctcctgggttcacgccattctactgnctcaacctncngagtanctgggactncaggcgcctgccactgggcccggctaatgtntngtattnttagtaganacagggtttcaccatatnanccaggatggnctcgntctnntgaccttgttatctgcccgactngacctnccaaagtgctgggattacaggcgtgagtnaccatgcccagnctcaagtaggttttgaatgaatttctcatacttttaaagtacaacattatngcaataacaggactattncacttcttttctaatttggataatggatagatnatcctaagtgtnatangatggctcaacctccgtacaatggtgaatcccgnntcagtngaaatctcggccnggtgtcaaccttgaacanaagcccctagtnatnaccatttngtgnattagcctttggtgttnagtttttcaccttggnttaactgnnngccttaaacctcnttnagctcaagtggacccttccnacctttaaccggccccgnattaagttggggganccatttgggcctttgcngccnaccccnggccccc

SEQ ID NO: 5707 - DNA, 848 bp, Homo sapiens
  misc_feature 1, 2, 3, 4, 5, 7, 8, 11, 18, 22, 25, 26, 27, 29, 30, 34,35, 38, 40, 43, 45, 48, 55, 72, 76, 77, 92, 100, 337, 358,368, 445, 490, 493, 503, 514, 550, 552, 554, 556, 561, 585,595, 606, 613, 614, 646, 658, 660, 688, 690, 691, 699: n = A,T,C or G
  misc_feature 702, 703, 714, 720, 721, 734, 752, 757, 768, 775, 776, 783,788, 794, 795, 797, 799, 808, 820, 827, 833: n = A,T,C or G
nnnnnannggnttttatnctcngtnnncnntttnnaananggnangcnactggtncgaatgcaggacccacnattnnaattcggcacgaganggccttangctttttttttgtagggtgagagtgggggagagatctcttgctctgttgcccaggctggtctccagctcctggcctccggcagtcctcccacctcagcctcccagagtactaggattatgggcatgagccaccacacctagccaggctttttatattgagttggttatatatgcttcatagccacactttataatattggagtatagtattaaattacagcttgttgtcaagtcagngtttctgtaagacagtatatncaatattggntagagtaacacctatttggtgatacaagatcaacagggtgtctctgattaatttagctcctacatagcccagaagcnagttcattatgatttagaatattgtacatggttatgcaaggaatnatnccaacctatntgtgtttatanggtcagatgatgttcagatttatatctgctgatagngntntnttgcngggaaaacctataaaaccccttcngacttgttanaaacagtgagnaaagccnngattggaaatatttaattacaaccctcgtggnattaaaattttnantttaccattgggaatggttaaaatgctngnncattttgnaanntttgttaaaanccttgnntcctttaaaaacnttttgaaataacccttgntctanggggaaaaaangtatttnnaggcccnaaaanaaatannananggggaaggnggggggattttnccaagtncccccntatgtttggggggcc

SEQ ID NO: 5708 - DNA, 769 bp, Homo sapiens
  misc_feature 2, 9, 13, 14, 40, 45, 55, 102, 109, 511, 607, 608, 617, 673,701, 727, 733, 736, 752, 762, 763, 765, 769: n = A,T,C or G
tngccttanggtnncccttcccatgcactcccacggaaangcccncccatcgtangcgcagcatccacatgaacaggcggcgccgaagggatcctgcccctnactctcnttttctgttgaaccatctggaattcacaggcctgtcatgagagacacgatgagaagtccttaaaggtagatcactgattcacaggggagcaggcggaggcaagggtgagtcagtgcttggaactcagtcatccagatttggctctggaaacttctgaagctgtagcctttggggatccctgactgcgagtacaggaagccaacgctatgtggtcttctggaaactcattatctttttcactggtgctatctgggaaaaacagatgaaaacctgaaggtgttctgtatgtgtgctttcaaaagcaaggatctggccggacgcagtggctcaggcctgtaatcccagcactttgggaggccgaggcaggaggatcacctgaggtcaggagtttgagaccagctnggccaacatggcgaaaccatctctactaaaagtcaaaaattatctgggtgtggtggtgggcacctgtaatcacagctactcaagtagctgaggcannaagaatcanttgaacccaagaggccaaagttgcacttgagcacaagatcacaccactgcacttcnacctgggtgacaagaatgaaacttccgnctcaaaaaaaaaaaaaaaaaaaactngacctntanaactatagggagtcgnattccgtaanncngacn

SEQ ID NO: 5709 - DNA, 717 bp, Homo sapiens
  misc_feature 3, 4, 7, 54, 67, 69, 70, 78, 81, 91, 97, 99, 101, 120, 132,136, 146, 153, 156, 157, 167, 172, 176, 178, 179, 180, 183,185, 190, 198, 199, 201, 202, 205, 206, 210, 211, 214, 217,220, 222, 228, 229, 231, 262, 265, 274, 278, 286, 287: n = A,T,C or G
  misc_feature 295, 300, 301, 309, 324, 327, 344, 348, 355, 363, 369, 373,379, 394, 395, 401, 431, 441, 444, 483, 489, 493, 498, 501,514, 520, 521, 529, 533, 546, 567, 572, 584, 585, 588, 603,612, 616, 629, 638, 642, 643, 644, 662, 673, 680, 699: n = A,T,C or G
  misc_feature 703, 712, 714, 715, 716: n = A,T,C or G
ggnnttnaaatatcagctcttgttctttttgcaggatccctcgattcgaattcngcacgaggtctangnngatgtctntcnaatcatgggntgtccntntnttttgacacagggccttgncttattgctcangctngagtgcagtnagctgtnatnncactgctgcncttcngcgnannngtnanaatantactctgnntnnganngaannaantanatngntacccnnanaccaactctgtctaaatggaaaagatggatnatnaatcttagncttnatagaacnntgagattntcaannggtgcgangcacagtgctcattnttncatcctatcacaagacncgtntaacctntaaccgtnaacaanatgnaatcgntgtataaaaacaatnnctgtgnttaataggtgactgactacagtagcctttnaggagtccanagncacttattcagcctgatctttccacatacactacattgnattgtntaanattcntanaaattactgcgcnatctanngctttaancctnatgtagtgactgntgctatatctggaagtatctntaaanagtttgctgggnnttnctcactgcttaatcntactagacntatncatctgcctatcntatcacttngccnnnatgattactgcaccggtntacgaaaaatnccattantgattaaacttttaaaggncaangaccatatntnnng

SEQ ID NO: 5710 - DNA, 1403 bp, Homo sapiens
  misc_feature 2, 59, 67, 70, 76, 79, 87, 88, 91, 92, 94, 95, 97, 106, 112,117, 121, 124, 129, 130, 138, 143, 146, 147, 148, 151, 160,163, 164, 165, 173, 175, 177, 179, 192, 193, 194, 200, 203,205, 209, 215, 217, 218, 219, 227, 230, 231, 235: n = A,T,C or G
  misc_feature 238, 245, 246, 247, 250, 251, 254, 256, 263, 268, 269, 274,278, 283, 285, 286, 290, 291, 292, 295, 296, 298, 299, 303,304, 313, 315, 322, 328, 329, 330, 332, 339, 340, 345, 348,351, 354, 355, 356, 360, 366, 369, 370, 375, 381, 383: n = A,T,C or G
  misc_feature 384, 386, 387, 389, 390, 404, 407, 408, 413, 415, 417, 419,420, 423, 427, 430, 433, 434, 439, 442, 443, 444, 447, 450,451, 453, 454, 461, 463, 465, 467, 468, 484, 491, 492, 511,513, 517, 518, 521, 522, 525, 528, 529, 532, 533, 534: n = A,T,C or G
  misc_feature 537, 541, 546, 551, 553, 554, 559, 575, 577, 580, 590, 595,597, 604, 605, 606, 611, 614, 623, 625, 639, 642, 652, 655,659, 661, 668, 672, 675, 676, 686, 691, 692, 694, 702, 705,706, 708, 709, 714, 720, 751, 752, 753, 754, 763, 782: n = A,T,C or G
  misc_feature 787, 789, 792, 799, 803, 809, 815, 823, 831, 844, 853, 854,855, 861, 866, 871, 878, 880, 882, 886, 902, 903, 919, 925,926, 927, 929, 944, 946, 949, 955, 957, 959, 967, 969, 971,977, 978, 983, 985, 986, 989, 994, 995, 1000, 1006: n = A,T,C or G
  misc_feature 1013, 1022, 1026, 1031, 1032, 1040, 1042, 1045, 1046, 1048,1049, 1055, 1067, 1074, 1080, 1083, 1098, 1104, 1126, 1139,1146, 1149, 1162, 1174, 1189, 1192, 1199, 1201, 1218, 1220,1221, 1231, 1236, 1250, 1254, 1257, 1259, 1264, 1267: n = A,T,C or G
gngacgttgcaaaaagcctggggtttccaaaagccttggttgacgcccatcgcttgganggccgttngcnaacgcnccnacacgcgnnacnngnncnactgagacnagcaanggtgncaanggncagannacaagganggagnctnnntgnacgcgcggnttnnnccgggggnancnangggggggagaacnnnccgggnggnanaatngggcgngnnngcaggacncanngcanatncgaaagnnnccnnggnanccgcagnccggnngacangcgnctgancnnggannnagnnanngagnnaggagaggngngccccanggagannngnacggacnnggagnganagncannncacncacggngcnnaaganagggananncnngnngcaaaggggcgagnaannggggnantnannganagangangannggagnagnnnagngannannggagggncncngnnagtgcatacagagaanggcgacnngaagcgaaaacgccacaananggcnnccnnggngcnnacnnnganagancaacncgggnanncagcnggacgacgagcagcanancgncaactagcanaggananacggaannnggccncantcggcgagnanaaaagaaagccacngcnaaacgcacgnagncacnanacgaccncagnggnncacggggcanacagnncncgacggcngcnnannctaancagacncacagcgcaaaaatgggggagacatgacaannnngacagcganacaccacgacaaacgcgcnggcanancanagcgccncganaggacngacggngaaaccgncgacagcnccacacacaagcncagagaggnnntacacnctagngacangagaggngncngggnaagcgcacgagaacannaacaccgacagagcangagcgnnnanagcaaagaccggacncnagnacgccnanangacacggncngnagacannagagnannagngatgnngacanaacggngccgaanagaagacgnacancgcanngaccaaangnacnnanncaccangagaagaagagnagaacgnacacgnacnagcacgaagaccacngagacntgaccgcgcacagagaagcacngggggacgcccanagaaaanaangagagctgcgcanagagcacagaancacgatgagaacggnccnaaacgantncacgcccaaaacagganannctgggggcanacaanagagagcaggtagncaanacngncgaanagnccgagcanagagacntgggnngnggagnagcagngnnggnncanccagaacaagaaagnnggacagnacngcnangcantagnnanaangnaagnnattnnnggntngncagcgaanngtnaagcggagngnncgg

SEQ ID NO: 5711 - DNA, 1019 bp, Homo sapiens
  misc_feature 2, 3, 6, 7, 11, 12, 30, 64, 118, 125, 133, 134, 137, 150,159, 162, 166, 169, 193, 199, 205, 213, 223, 224, 227, 235,237, 247, 251, 254, 269, 270, 279, 301, 312, 314, 326, 336,338, 343, 346, 362, 371, 374, 377, 380, 385, 395, 399: n = A,T,C or G
  misc_feature 401, 408, 409, 412, 413, 422, 430, 439, 444, 446, 447, 450,454, 456, 462, 464, 470, 473, 475, 487, 490, 494, 498, 501,510, 511, 520, 521, 527, 528, 530, 532, 533, 534, 540, 541,567, 570, 580, 583, 592, 593, 595, 597, 598, 603, 608: n = A,T,C or G
  misc_feature 609, 610, 611, 613, 615, 616, 617, 619, 622, 627, 631, 633,634, 639, 645, 650, 651, 652, 653, 655, 661, 662, 667, 673,674, 677, 683, 692, 693, 699, 701, 702, 705, 711, 715, 716,719, 720, 722, 723, 725, 727, 729, 730, 731, 732, 736: n = A,T,C or G
  misc_feature 740, 742, 744, 745, 748, 750, 751, 752, 753, 754, 755, 761,772, 773, 779, 780, 781, 783, 790, 792, 794, 795, 800, 801,802, 805, 807, 811, 812, 818, 824, 832, 834, 835, 844, 848,849, 855, 857, 858, 861, 863, 865, 869, 889, 892, 898: n = A,T,C or G
  misc_feature 900, 911, 912, 914, 925, 930, 949, 956, 965, 966, 971, 975,977, 983, 987, 994, 995, 996, 1001, 1003, 1009, 1010, 1012,1015, 1016: n = A,T,C or G
gnnggnnaaannggcttttaaacatacagnctacttgttctttttgcagggatcccatcgattngaattcggcacgagggccaccgaagagggcaccagtgtcttgtcacctggactncacatangactaatnntgntactggcaataangatctatanaangtcngcnactgatgtgtatgaaaagcatacntgactntatatnctaatgtngggatgtgannttnctaaagtntnacaataattngtgntancatcacatgaccaanngttaactantatcttggagacactgactttntggggccatantnttttgattttanaccaagaacntntaatnatntgtatcccaaatatgntgctccttntgnganagnccaanggctgatttncctntncatcttnnatnnttgttggancacctaangaggtagtnttctngnnggncctngnaaaaantnttccanaanantacccgtgtgcntcnttanaatngantaattgtcnnaaaattaanntaggcnntngnnncaaaannaaaaggcctcccctttgaaaaacaangtnattttgaaanaangataaatcnntntnnagttnatcannnnanannnanatntgtcnaatncnntctanattttntaccnnnntntagtannattcntaaaanntanagaccnttttccctnntgaagnannctntgggcntaannaanntnngntnannnntcancttngncnngtntnnnnnnattcgngtaatatgganncatttnnnanataaaananannttctnnntgnangacnntactanacaaanttttaaantnngttctacancccnnttttananntananantcgnatatgaatttcaatctcccnatnttgttnanataatcaaatnnanattaaattttnataanccttattaaaacctctttnatgaagnatccaattnntgatnaatncntaaacnatgntatactnnnatatntnattatnnantgnnccg

SEQ ID NO: 5712 - DNA, 786 bp, Homo sapiens
  misc_feature 3, 4, 5, 6, 7, 11, 24, 423, 457, 467, 482, 555, 560, 599,604, 620, 650, 681, 702, 721, 723, 735, 759, 763, 766, 779: n = A,T,C or G
tgnnnnncgtnagaccagcttttnaacatacaggctacttgttctttttgcaggcatcccatcgattcgcatccctggagcagcttccaacactacttcagggtggcagtgtttggggcactgggcgagcctgccggcctctagatggcctcatctcttccttccacaaactgtctagaaccaataaaaggaaacctgccaaaaaaaaaaaaaaaaaactcgagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcangttcagggggaggtgtgggaggttttttaattcncggacgcggngccaatgcattgggncccggtacccagcttttggtccctttagtgagggttaattgcgcccttggcgtaatcatgggcatagctggtncctgngtgaaaattgttattccggtcacaaattcccgccacatnccaanccgggggccttaaagngttaaaacctggggtgcctaaagaagtgancttaactcaccatttaattggcgtttgcccnttaaatggcccgcttttcaanttcgggaaaaccttgtccntnccaagcttgcanttaaatgaaattggccaaacgccnccgnggnaaaaggccggttntgccttt

SEQ ID NO: 5713 - DNA, 755 bp, Homo sapiens
  misc_feature 2, 4, 10, 12, 25, 89, 90, 91, 97, 629, 638, 648, 685, 696,719, 738, 740, 744: n = A,T,C or G
gntnatgacntnaaactctttggcnagcaggctccctcgattcgaattcggcacgaggaatcttccttaaagtccagagtctcccggannntggagnttgtccttcccaagccttctcgcggggagggaattccttctttctgccgcctgttacatccctgtgtgagaaggtctggtgagctgagcccacatcactcgttctgctgcccaggtgtgcttccatcttcactgtggaaaagtcattttgaactccccggtgactgcaaattaagtaatcaaggacagatgggactgggttgaccattccaaggagtacagttacttgaagaatctggaagcaataccgagcacatttgttggcattaattcattggagcaataatgctgtacgtagaaagtatgttgcttttttaaaaaaacatcatcagttctgagcatttgtagcaagtgaactctaacttggaacggatgataaattcttctaaaaaacaaataaaaaccctccagacaatattatgcattgagagctttaaaaaatatatatcctacagcatttggaaaacactttgtctggctatgccactgcactccagcctgggcgacagagcgagactccgtcttcaaaaaanaaaaaaaangaagacttgnattaatggagaaacagactggtccctggctagaaatnccaaatattgnaaagaagtcatttctttaaaatnaatttatggatttaatgcngncctnagttaaaaatc

SEQ ID NO: 5714 - DNA, 742 bp, Homo sapiens
  misc_feature 5, 6, 10, 13, 15, 631, 699: n = A,T,C or G
agtgnntttnaananacaagctacttgttctttttgcaggatcccatcgattcgaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacacccctcncccttgccatcatggaaaatgccaatgttctggccccgttatgccagtatctgccagcagaatggcantgtgcccatcgtggacctgagatcttcctgatggggaccatga

SEQ ID NO: 5715 - DNA, 846 bp, Homo sapiens
  misc_feature 4, 18, 23, 25, 35, 37, 46, 54, 66, 71, 72, 73, 74, 75, 77,81, 87, 93, 101, 112, 119, 121, 122, 123, 124, 125, 129,137, 139, 145, 147, 148, 149, 157, 158, 168, 172, 190, 192,199, 202, 203, 212, 225, 231, 235, 243, 250, 278, 279: n = A,T,C or G
  misc_feature 280, 310, 333, 344, 349, 355, 368, 385, 390, 401, 404, 408,426, 431, 441, 455, 461, 463, 468, 475, 481, 485, 496, 516,524, 533, 541, 542, 553, 558, 562, 569, 572, 575, 578, 600,601, 631, 634, 643, 650, 652, 668, 669, 675, 692, 693: n = A,T,C or G
  misc_feature 694, 695, 705, 718, 719, 721, 722, 726, 734, 743, 744, 746,747, 763, 767, 772, 777, 780, 797, 799, 811, 818, 824, 830,836, 844, 845: n = A,T,C or G
tttnaaatcccagctctngcagnanttcaagtccncntttctaatncttggcanctcgatctcgcncgaannnnntnggcncgagantctgcnctacaacngacaggattgntagaacntnnnnngtcngggggatntngaatantnnntcaacacnngtgatacgcntganctaacaggtggtgttttnantataccnacnnaaatagcangatgcgacaacantcctgnaacngtgtcttntcaaagncaactggcctggaaggctacaagtgtcnnnaaagattctgttcagaatctagccacaganataaaggatggacaaatacctgngacatagtctnctcanagacanccaagccttgaangctcaggtgatgaaaangattntgtttcgaatntanccangagaaataaaggatgganaaaantctgggacantgtcttctcagaancaatcngnccatnaaggttntatttnacangaaagttctcnttttgaatatttgccacacngaataacnggcggttgngaaatctnnaacagagtatnctganaatntgcccanccntgnaangctacaattgaaaaataataanntctgatctgaaatacaagccaccaaaatgnaangattgtacnaatcatncncacccagcagcaacanngacttnatgaaatggccatccannnnggaaaaccanaaggaagctttgnnannaatntgcaatanattacccanncnnacaaggttgaaaaaanccanaattncattnctnagggatggaccctttgntngaccttaaattncagtccntcctcnaaaccnttcttnaagaaggnnc

SEQ ID NO: 5716 - DNA, 717 bp, Homo sapiens; identical to SEQ ID NO: 5709
  misc_feature 3, 4, 7, 54, 67, 69, 70, 78, 81, 91, 97, 99, 101, 120, 132,136, 146, 153, 156, 157, 167, 172, 176, 178, 179, 180, 183,185, 190, 198, 199, 201, 202, 205, 206, 210, 211, 214, 217,220, 222, 228, 229, 231, 262, 265, 274, 278, 286, 287: n = A,T,C or G
  misc_feature 295, 300, 301, 309, 324, 327, 344, 348, 355, 363, 369, 373,379, 394, 395, 401, 431, 441, 444, 483, 489, 493, 498, 501,514, 520, 521, 529, 533, 546, 567, 572, 584, 585, 588, 603,612, 616, 629, 638, 642, 643, 644, 662, 673, 680, 699: n = A,T,C or G
  misc_feature 703, 712, 714, 715, 716: n = A,T,C or G

SEQ ID NO: 5717 - DNA, 1194 bp, Homo sapiens
  misc_feature 8, 9, 10, 13, 20, 23, 28, 30, 31, 33, 35, 37, 38, 39, 40,41, 44, 55, 59, 64, 73, 83, 91, 95, 103, 106, 107, 110,117, 123, 134, 145, 148, 153, 165, 170, 171, 183, 191, 196,205, 209, 210, 212, 216, 221, 231, 244, 247, 248, 250, 251: n = A,T,C or G
  misc_feature 254, 257, 258, 259, 261, 267, 269, 274, 277, 280, 284, 291,294, 299, 307, 308, 310, 311, 312, 317, 318, 325, 326, 327,332, 338, 345, 348, 352, 362, 364, 366, 374, 377, 380, 385,389, 394, 397, 399, 403, 404, 422, 423, 426, 429, 434: n = A,T,C or G
  misc_feature 437, 444, 448, 454, 455, 456, 465, 468, 470, 471, 473, 480,484, 486, 488, 494, 497, 502, 505, 514, 520, 529, 532, 542,544, 554, 558, 561, 565, 567, 570, 573, 582, 584, 585, 591,594, 599, 601, 610, 612, 620, 621, 627, 628, 635, 638: n = A,T,C or G
  misc_feature 639, 640, 644, 652, 653, 654, 659, 662, 668, 676, 677, 678,683, 686, 689, 691, 693, 695, 701, 702, 706, 708, 712, 714,715, 720, 721, 725, 730, 732, 733, 734, 735, 736, 737, 741,742, 743, 745, 754, 756, 758, 760, 764, 765, 776, 780: n = A,T,C or G
  misc_feature 786, 788, 789, 793, 801, 805, 811, 816, 823, 829, 834, 837,839, 856, 859, 870, 871, 875, 876, 880, 885, 887, 891, 892,900, 907, 916, 919, 924, 927, 928, 929, 938, 940, 943, 944,945, 946, 947, 952, 953, 954, 955, 965, 973, 976, 978: n = A,T,C or G
  misc_feature 979, 983, 986, 998, 999, 1003, 1006, 1007, 1009, 1012, 1013,1018, 1022, 1023, 1025, 1029, 1030, 1031, 1032, 1034, 1035,1045, 1050, 1051, 1053, 1057, 1068, 1071, 1082, 1084, 1090,1092, 1095, 1097, 1105, 1106, 1107, 1115, 1116, 1118: n = A,T,C or G
cccccacnnnacncaacacncancaccnanncncnannnnncancaaaaaaaaanccancccanaaacaccanccccaacacncaaacaancccncccaccanccnnaangggcccncaccancctgtcaagcnaacgacccacnacnaagcngccgagaagctncaccnnacacccaaaccncatacagngggcngggcaagcngggnncncatnggganggggaagggngcccggcgcctanccnncnnccnggnnncnacaggngnaccanatnggnccancccccanacnaccangtacccanncnnncacgnnaacaccnnnccaanacaccncccatcnaangcanaaccgaccanangnacctaccnaancanacccnccanagccnacncnagcnncacacccaacccccccanncanggncaccnacngcaaagncccnctcgcnnngatcaccancantnncnaatacancacnancnaccacnccncaaanacnaacgcttanccccancgaccccanacnaaagacccananagcacacacntggnaanaaananacncancgccccccnanncccaanaangcgcncnccaacacancnaaccccanncacccnnaaacccncannncacnggcgacannnggaanacnccccantccccacnnncacanacnaancncnanacacgnnaacncncgancnnacccnnaaanaacanannnnnngcannnanaaaaccccnangncntacnngcacacactcnccanaccagntnncacncaaacgcncacnaccacncaccnccccacnacaccnacgcnccncnacccaccccccaccganacnagcccaaacgnnccanncacnccaangnacannccaagcgncacaccncacacgacncanacccnccnnnacactaacncnacnnnnnacacnnnnccacccacanagcaccanacncnnccanccnagaaccacaccnnaacnacnnanctnncctcnccanncngccnnnntnnccgctcgcanaaacnnancccnccaacacaaanccnaacacaacacntncccccntnaananacaccacnnnaactccannananaancaacnncnnccaccancaancaacacncacnacantacagacnccttanannancnccnccacaaccnccg

SEQ ID NO: 5718 - DNA, 719 bp, Homo sapiens
  misc_feature 8, 48, 119, 120, 121, 287, 291, 305, 373, 389, 405, 425,434, 437, 438, 439, 449, 454, 455, 458, 464, 465, 480, 487,488, 489, 497, 506, 518, 526, 531, 567, 570, 609, 629, 637,644, 645, 647, 668, 671, 673, 674, 675, 684, 685, 690: n = A,T,C or G
  misc_feature 691, 692, 697, 708, 717, 719: n = A,T,C or G
ggtttttnatcacagctacttgttctttttgcaggatcccatcgattngaattcggcacgaggtactttgagtgtttgggggttcaacacacacatgcaattttgcttaacaaaagtgnnntataatacagtttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacaagcantatnaaatacctgtgatntttctttacattacggataatgcataaggaattaatcttcatatatattatcatccctaatgtagcanggggaagtatttaatngcccatgatatgtatnttacttatactatgccaganaggaaactntannntcattacacntgtannctngggttnntcacatatgtacgtnttcattnnnagtaggtngaagatganactaaatatttncatgaatngaatncctgatgggatagcctcaataagtatttaaaagccngtnttctaaaaataataaagggtaggggtcatttttgacttntgttgatcttttgctattgntaatattnaacaatnnangtgttacatttggtacctggnagncnnnaatgccatnnattgnnnaacancctgaggatgntgaacaagncn

SEQ ID NO: 5719 - DNA, 719 bp, Homo sapiens; identical to SEQ ID NO: 5718
  misc_feature 8, 48, 119, 120, 121, 287, 291, 305, 373, 389, 405, 425,434, 437, 438, 439, 449, 454, 455, 458, 464, 465, 480, 487,488, 489, 497, 506, 518, 526, 531, 567, 570, 609, 629, 637,644, 645, 647, 668, 671, 673, 674, 675, 684, 685, 690: n = A,T,C or G
  misc_feature 691, 692, 697, 708, 717, 719: n = A,T,C or G

SEQ ID NO: 5720 - DNA, 761 bp, Homo sapiens
  misc_feature 6, 14, 16, 17, 33, 678, 741, 761: n = A,T,C or G
ttgaanctttaatntnnacccctttggaacttnttgcaggatcccatcgattcgtgtagaggaggtgaggaaatactttaatgtgttggaaaccatgggtttgaacagaagatacgcatatggagtggggaatggaaagaaaactttgtgctacatttactgtaaattatatcttattgattcagtaaattcaggtggaatacggaagttcaaatttaaagattacccatggactcctgacctcaggtgatccacccgcctcagcctcccagtgggctgggattacaggtgtgagccaccatgcccagcctcatcattcttattaactggtttaatcctttcaataatcctattaagtagaattattaggtaattagaattaggttaaaaagagctgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtcccaaacattgccaagagaaaatgcaatgtgaggtaaaagatgaaaaagatgacatgaaaatggagactgatctaagagaaacaaaaagactcttntagaccacatggcagtcccatatggatgaccaagcaagaaaagctgcggcaagcagagaaaanaagggaaaccaacaaacatn

SEQ ID NO: 5721 - DNA, 687 bp, Homo sapiens
  misc_feature 278, 365, 370, 393, 394, 408, 414, 502, 507, 517, 518, 540,548, 552, 560, 607, 612, 614, 617, 634, 642, 643, 646, 647,664, 667, 668, 674, 680, 686: n = A,T,C or G
agacaagctacttgttctttttgcaggatcccatcgattcgaattcggcacgagtattggtttgtagaaatgctactgatttttgtacgttaatttttgtatcctgaaactttactaacgtcatttatcaggtcttttggagggattgttagggtttttttaggtttagaatcatattgtgagtgaacagagataatttgacttcctctttttctatttagatgccttttgtttctttttcttgcccgattgctctgggtaggacttcagtactatgntgaatagaggtggtgagagtgggcatccttgtcttgttcttaggggggatgctttcacctttgcccattcagtatgatattggctgngggtntgtcatagatggctcttattatnntgagaggtatgtcncttcantgcctagttagttgaggatttttatcatgaagggatattggactttatcaaatgcttttctacatgtattgagatgatcatatggccntgggnttaatctggnntatgtgctaaacctattcccanatcaaaanaaangatttctnctaacacattctacgaaccagttcacctgaaccaaatctgcaaggcncacancnatnataaaaaaaaatcgctntaaacttnnggnnatactaaaccaactganagnnctgatnagttgncacccnt

SEQ ID NO: 5722 - DNA, 724 bp, Homo sapiens
  misc_feature 2, 4, 382, 443, 495, 553, 588, 596, 625, 630, 657, 664, 715: n = A,T,C or G
gnangctacttgttctttttgcaggatcccatcgattcgaattcggcacgaggaggggagagaggagggccattacaactctgccttcaagactcatctcttaaaaacaaaacgaaacaaaactacaaccaccatcaaaaccacacgcaaaaaaaaaaaaaggataactttaaccgaaggaagggtttggttccattcaactccacattcattgtgcctttacttgcattagatttctgtgctttcttcctttccctctttgaagcaattaaaatcttccttgataactgctgtttctttctactcttgtttctggcaatttagtgggttccttctctagtggtcttaaatctcattccactggtggcaagatggggcctanccttcttttcacatgtctaatcttttcctttctcatggtgccctccatggaagtcacagtnaacactgaataaatgactagaatgacacgtgtgcgtgccgcacgcgtgtgcntgtgtgtgttcatctgtctgcatgtgggatcaatttcttttagaaaataatttattgnatgatttattttgggagttatattctgattacagngctccttnttccaaatagcattgatttttcccccttnaaagnataatctggtctcaggttggatctttnggacatntctctctctggatgccatgcagttaattaaaaccttgcttaaaacaaaaanaaaaaaaat

SEQ ID NO: 5723 - DNA, 925 bp, Homo sapiens
  misc_feature 2, 3, 4, 5, 7, 8, 9, 10, 11, 13, 14, 15, 16, 17, 18, 19,20, 22, 23, 24, 25, 26, 27, 28, 33, 34, 35, 36, 37, 38,39, 41, 44, 49, 66, 73, 74, 82, 83, 84, 97, 98, 101, 106,237, 262, 268, 271, 409, 416, 418, 464, 528, 559, 568, 572: n = A,T,C or G
  misc_feature 580, 598, 609, 615, 627, 641, 650, 665, 678, 694, 699, 700,707, 719, 738, 742, 752, 754, 756, 769, 772, 790, 792, 794,806, 807, 820, 826, 830, 835, 838, 855, 858, 864, 889, 897,901, 910, 914, 919, 921, 923: n = A,T,C or G
tnnnnannnnntnnnnnnnntnnnnnnnggggnnnnnnntnggntttanactcgggaacgtttctnagcaggnngccatcgnnncgaatgcggcacnnggnggtanccgaattcggcacgagggggacaaggctataaatatcattaataccaggttcaggagtttgcactgcactaaaaatcaactcagctatttgagcaccttttatagagtggaaatggggttgggcagtaganaagagcacttttagagaggcttttntgcagnagncaggggttacacctgttaaccagccataattttttttttaagcggctgtgctgaggatgagccccatgtagttggtgcaggtggggacacactgtctgtgtaactagaaaaactaggcatggccgggcacggtggctnacacctntnattccagcactttgggaggtcaaggggggaggaacacttgaggccngagacaatataatatataatataatatattggccagccttggacaatataaataaagagccctntctgtaccaatttaaaaaactaaaaagcctnggggtgggngggnacaatacnctgtagtccttggcttanctttggggaangcttgngggcaaggtggnatttgctttggaancctacggantttcaattgcctgtnaagtggaagcctntgggaatcgttgcccncttgnnatttccnaccctggggttngggaggaaaaaaacccttntttntacaccaccncncncccccccaaaaanaanttggcccaaatgtggctntnantaaaaggggaannccgaaataggggnttcttngtanttaanggnggcaaaaaagggggggnggntcctgnggaaaaaaaaggcccaccccttttngtgttggnggtngggaaaaantttnaaaancncnct

SEQ ID NO: 5724 - DNA, 1170 bp, Homo sapiens
  misc_feature 3, 5, 6, 7, 9, 11, 14, 15, 17, 18, 21, 24, 25, 28, 29, 30,34, 35, 36, 37, 38, 39, 40, 42, 45, 48, 49, 50, 52, 54,56, 58, 61, 63, 64, 67, 70, 72, 79, 80, 81, 84, 86, 89,90, 93, 95, 97, 98, 99, 103, 104, 106, 107, 108, 110, 113,115: n = A,T,C or G
  misc_feature 116, 117, 118, 121, 122, 124, 131, 132, 133, 136, 137, 138,140, 142, 143, 145, 146, 152, 153, 154, 155, 157, 158, 159,160, 161, 162, 163, 165, 168, 170, 172, 174, 175, 179, 183,185, 191, 195, 198, 201, 202, 208, 209, 213, 222, 224: n = A,T,C or G
  misc_feature 231, 232, 236, 237, 241, 244, 245, 248, 250, 262, 264, 265,268, 271, 275, 281, 282, 283, 284, 288, 293, 294, 295, 303,305, 307, 313, 315, 319, 325, 326, 327, 331, 334, 341, 355,359, 363, 366, 367, 369, 373, 383, 386, 390, 395, 396: n = A,T,C or G
  misc_feature 402, 408, 410, 413, 414, 415, 418, 419, 423, 427, 429, 437,438, 441, 447, 451, 452, 454, 455, 459, 467, 472, 473, 480,483, 485, 486, 497, 510, 512, 513, 518, 522, 524, 528, 531,532, 534, 535, 536, 539, 541, 559, 563, 567, 570, 571: n = A,T,C or G
  misc_feature 573, 574, 575, 581, 597, 607, 609, 612, 616, 623, 624, 626,632, 639, 644, 645, 647, 649, 651, 653, 654, 655, 657, 661,668, 670, 677, 680, 681, 682, 687, 692, 705, 708, 709, 710,715, 719, 720, 722, 724, 727, 728, 730, 731, 734, 740: n = A,T,C or G
  misc_feature 753, 764, 765, 768, 776, 778, 779, 785, 788, 789, 790, 802,803, 804, 806, 807, 808, 809, 811, 813, 815, 817, 818, 822,824, 826, 830, 841, 859, 864, 871, 874, 879, 881, 884, 885,894, 897, 899, 902, 903, 912, 916, 918, 920, 924, 927: n = A,T,C or G
ccnannncnanccnnannccnaanngannnaccnnnnnnncnacnacnnnancngncnacncnnacnacncncgcccannnacncnacnnaanancnnncgcnnannnanccncnnnnccnncnacactcnnnccnnncnanngnncacccnnnncnnnnnnncnacncnananncccncacnanccccanaacnccngcnntggcanntttnaaatcaaancncttgggnnaacnnccanaannctncnaccaccaccgananncgnacncacngcccgnnnnagcnccagnnnccccaacncncnatcccntncgcncgaacnnnctanccnggggggngggggcgggggcangggngaancgnngnccancccgcccacnccnaccnacacnnccccanacccancnccnnnacnncaancccncncccatacnncanaccgancccnnanncccnacgcaccnccacnngacccgnaancnnaaacacacacncacaccccgaccncnnacaanaccncncacncanncnnnccncnacaaaacccacaccgccncccncaanccnncnnncacccnacgaccacccaacacncccaaccgcncnaancccncaccacnncnccaccncccaccncgacnnanancncnnncnccancacgccnanaccaccnaannnccccnccccnccccaaccaaccnaannncacancagnnancnacnnanncanccccancccccataaaccnaccacacctanncancccagacnanncaacgnccnnnccctacaccgannncnnnnancnanannacantncnacanccacaccaatnccgcagcagacatcgcanacacncagcccncanacacnanccnnaccaccaanacntnacnnacacacacnaacncnanaacnatntnccacgcncacannacaantcnatcnccccacgnacnnctcanncacancgancaatacanancacganacacancnacgannnccanacnccaacncgcgacngncacacacaccacncncancncacgacnctannanacncacanacanncctccanaacagnacncngcncncacagcaccacacgatnacacngnagcacagacncaacncgcgacanaatnncacacacnnacgcc

SEQ ID NO: 5725 - DNA, 795 bp, Homo sapiens
  misc_feature 2, 3, 7, 10, 11, 27, 31, 546, 604, 658, 679, 792: n = A,T,C or G
gnntttnaannttttaaatttatacancttnttgttctttttgcaggatcccatcgattcgaattcggcacgagggtagactggctagggatcctggacccagggttccacgtagcaacacctgctgagttctctgggttttcttcctgcctcatgtagcccagacttggagctgaagaagctggaaacatggaaacaccaacagctacagaccaaaaaaagtcccaacaaaggcctgtcagtctgccagcctgttctgtggatttccaactcaagatggcagcatcaactcacacctgaagttctggcttccctacaaactttgaacttgccagtccccacaatggcataagccaattccttaaaatgaatgtctagttctagataatgtgtgtattctactggttctgtttctctggagaagcctactaatagatcatttgtcttaatcaattcaagctactgttacagattaccatagactgggtggttaaaactacaaatacttattactcacagttttggagtctggaagtctgagatcangtttccagcaggattgagttcttggtgaacatcctcttcctggtctacagagtactgngttacttaagtggaaaaagtagggtgagctggttcttttggcctcttcttttangggactaattcatgagggctncaccctcatgacctatttaccttccaaaggctccatctccaaataccatcacaatgggggattagaattcaacataggagttttgggaggacacaaacatttagtccttacancca

SEQ ID NO: 5726 - DNA, 789 bp, Homo sapiens
  misc_feature 18, 22, 44, 45, 53, 56, 83, 225, 497, 526, 620, 636, 658,682, 685, 700, 719, 737, 745, 750, 760, 765: n = A,T,C or G
ttcaaaccagcttttgancttnttgcaggatcccatcgattcgnntcaaacanagnattgtgatattgtcaaagagaaaaacnaatcctgaagatacatggaaatgtaacctagtttagggtgggtatttttctgaagatacatcaatacctgaccttttttaaaaaaataattttaaaacagcatactgtgaggaagaacagtattgacatacccacatcccancatgtgtaccctgccagttcttttagggatttttcctccaaagagatttggatttggttttggtaaaaggggttaaattgtgcttccaggcaagaactttgccttatcataaacaggaaatgaaaaagggaagggctgtcaggatgggataatttgggaggcttctcattctggcttctatttctatgtgagtaccagcatatagagtgttttaaaaacagatacatgtcatataatttatctgcacagacttagaccttcaggaaacatangttaagcccccttttacaaagaaaaagtnaacatacttcagcatcttggagggtagtttcaaaactcaagtttcatgtttcaatgccaagttcttattttaaaaaataaaatctacttataanaagaaaaggtgcattncttaaaaaaaaaacctttaaangaaaatgaaagaagaacccttttncangatacttactttgangactgttttcccctttttnatgagatatagcttaganatcggcgnggggnatttctttantaatnctctgggttttggatctggccttg

SEQ ID NO: 5727 - DNA, 732 bp, Homo sapiens
  misc_feature 3, 6, 13, 17, 28, 66, 79, 95, 150, 154, 160, 167, 203, 213,231, 232, 252, 262, 266, 273, 398, 416, 456, 462, 488, 554,666, 679, 704, 713: n = A,T,C or G
tcnctntcatctnaacnctttgcaattnccctttttgcaggatcccatcgattcgcccagggccgnctgcctgagcctntctgcagctgctcacnttttgctgaggcctctgccttcagagctagtggggcctgctcacacattccagcngttncctctntatttgncctgaaccaagttgtagaatttaaaggaggtgaagnaaggcgattnctatggaaaatatattgnncttctttactcctcatgctnagtgcataanaatntattatntcccctgaatgttcaaagtggtgtgtgtgtgtgtgtaaaagaaccaggagcaaacaatcttaataggaatgtgcgatcttgcgcctatctttagcacacttaattagctacaacccgggactgtngccatttgaacaaattgntaacaaaatctgccatgttttgctctttttcaaaaggaangactcnaataaccatagcaacacttactcagntttgtgatccactccaagattatgggagcaagaacagatactcctgaaagcaaccctcacctcctnccccgccccctgccctcagcaagtcctggcctgtgtgaactgaagggtttggaagctctggtttctaggagtgcccagaagcttgaaagactagggtgtactagttattgangggcagttgtcantggcagtgtgggggcaccccaattngtattccanggcactgcattgctttttt

SEQ ID NO: 5728 - DNA, 769 bp, Homo sapiens
  misc_feature 3, 14, 28, 36, 96, 440, 466, 477, 546, 553, 580, 606, 608,630, 635, 636, 643, 644, 649, 657, 662, 664, 670, 672, 676,677, 681, 684, 688, 690, 692, 695, 699, 701, 702, 711, 714,718, 719, 722, 724, 729, 730, 731, 733, 737, 738, 740: n = A,T,C or G
  misc_feature 745, 748, 751, 756, 757, 758, 760, 762: n = A,T,C or G
gantggtcgaactnaaccctttggaaantccctttntgcaggatcccatcgattcgaattcggcacgagggccactccgcctcttccctcccttcnttttttcttcctctcccttttttccttcttccttcccctcctcgccgccaccgcccaggaccgccggccgggggacgagctcggagcagcagccaggtagaactttagacttcatagcactgaattaacctgcactgaaagctgtttacctgcatttgttcacttttgttgaaagtgaccatgtctcaagttcaagtgcaagttcagaacccatctgctgctctctcagggagccaaatactgaacaagaaccagtctcttctctcacagcctttgatgagtattccttctactactagctctctgccctctgaaaatgcaggtagacccattcaaaactctgntttaccctctgcatctattacatccnaccagtgcagntgcagaaagcataaaccctactgtagaactaaatgcctgggcatgaaacttggaaaaaaaccaaatgtntaagccntgttgaaccttactctcgggatgcagnccacctataactaccaaacatggagnanggaaggaggtttaaatcccccnagggnnacttttnncccantttctaantcgcnancctttncncttnnaaanggngatncntntangcgngnnggccagcanatntcanntgnantaggnnnancccnncntcctngcngangaacnnncncnactcccg

SEQ ID NO: 5729 - DNA, 719 bp, Homo sapiens
  misc_feature 12, 13, 95, 96, 194, 203, 210, 299, 428, 460, 532, 550, 560,563, 585, 591, 660, 664, 666, 670, 671, 674, 684, 686, 691,698, 704, 708: n = A,T,C or G
gtcttgtcctcnnaaaccctttgcacttcctctttttgcaggatccctcgattcgaattcggcacgagagagggtggggtctggccacataggtnnctctgtggctctggtctggggttagacactgttagggactagcatttattggacttgtaaagacagcacctcagaattagtaactacttgcattttanggtctgttntatgaanccaacaagtgaatgtaaaataggctctgcatcttttctgagagccctgtcactgggcagtgagcatttccaaaattgcagctctgtcanaatgaaccatgaatacttaagaaagggaaagtaggaacagggagcagagcaaagcataacttgctgtgttccagggatttaaaaataaattactgtcaagagcaatataagggtcatgggtttgatcangaactttttgtaaatgaaaaagttcacaattnggaaaaaacagtgctagatgtgttatggaaattgttatcacaaattattccactgaaactcaagtatataanacaacaatatattgctgngaaatcttanttntgacatatggaaggtaaccaanaataanaaccatacctttttgcttgaagtgcacggtggtaccaatttctaaaattagaaacatttaagccaaaanatantnaacnncantaccccctcntngaaanaaaaaancctcgnaccnttttgaacttt

SEQ ID NO: 5730 - DNA, 783 bp, Homo sapiens
  misc_feature 3, 7, 8, 23, 24, 25, 29, 33, 36, 40, 43, 62, 82, 87, 88,92, 96, 103, 106, 107, 116, 118, 123, 136, 155, 162, 163,165, 171, 173, 178, 182, 203, 207, 210, 211, 213, 214, 224,227, 232, 242, 249, 252, 254, 280, 282, 290, 296, 306, 315: n = A,T,C or G
  misc_feature 320, 326, 339, 341, 342, 345, 348, 349, 366, 373, 374, 375,396, 400, 402, 418, 428, 441, 446, 448, 463, 464, 475, 481,483, 492, 497, 498, 499, 507, 510, 514, 515, 518, 519, 528,531, 535, 542, 569, 572, 575, 579, 580, 585, 595, 596: n = A,T,C or G
  misc_feature 601, 602, 604, 608, 616, 617, 623, 625, 628, 640, 645, 658,673, 684, 685, 693, 694, 697, 700, 703, 706, 711, 720, 721,725, 729, 730, 738, 753, 760, 762, 768, 771, 773, 776, 779,783: n = A,T,C or G
agnaggnntttcagaaagctggnnnaggnagcnggnagangcnttgaaggcccttgctaatngcttggaaagctccatctanagagnngganggtngggagcncgnnaaacatgcngnaacanctctaggaagtgngaatctgatacaagctganatgttgnntnatgganangatcncacngaatggattgctgtgaacacngtgnatnncnngaaccagatnaanatgtnatatggaacnattacancantntgcactgaagcaagctggccaagcangnctgcatgnccgaanattgaatatnactgggcanatggnactaanattaaaaagccanannaantgnnctgcaccaacatacatntgactannnggatgacttgggttcaacgancagncntgatagatgaaacccncgtttccttntaagattggtgtnccatntncccaaaaactttatnnctgtggcaganactatncntaaaagcgncttgnnnagggtttnaangccnntannaatcaccangcnctantgattcngtgatgccatctgccaactaggaggcncanctnaacnnctacnttaagcactnnattcnncnttgnttcagggnntttaancnagntttgataaggcntgaanctgggcacctctncaagaattagtacanaaacttggatnncaagaccnnatnaanggncantctangaacacagnntccncccnngcttaatncattggtagaaccanctcaatngntatccngtnantgnacnactn

SEQ ID NO: 5731 - DNA, 728 bp, Homo sapiens
  misc_feature 2, 3, 4, 6, 7, 8, 9, 10, 11, 12, 13, 15, 16, 17, 18, 20,22, 23, 24, 25, 28, 29, 30, 36, 41, 85, 89, 97, 106, 108,115, 134, 139, 177, 185, 207, 232, 275, 283, 303, 320, 327,356, 414, 451, 469, 551, 566, 582, 588, 591, 605, 631, 656: n = A,T,C or G
  misc_feature 661, 678, 681, 687, 689, 702, 706, 710, 711, 713, 722: n = A,T,C or G
gnnngnnnnnnnngnnnnantnnnnggnnntttgcnaatanacaggctacttgttctttttgcaggatcccatcgattcgaattnggcncgagctcngaccttatnancagcatnacgcatgactaccacctgnatgancaggatgctgagggccggctggtacgctggatcattcncattagtncccgaaagagccgtgcttggcnacagactccgagggtcgttcaactnggctgctgtcccaaacgctgctgaccctgacagtggccatganaccatggngggctcaggtcttactcagnatgagctgacagtgcanatctccnaggagacgactgcagatgccatcgcccgnaagctgaggccttatggagctccagggtacccagcaaagccatgactcatcctttcanggcaccgacacagactcgtctgggggcacccttgctncaagtgtactgataaccnctgacaggcccatctggcacaccctttctgggagaagcatggcctacagaatgaacagggggaccaggaacccctgtggganaggcttaaacctgancagtgcccactctggntcctcntgncttggctgactggnttctggaccatgtgcatttcactggnccatgggatctacatctcttgcatncccanctggctgatcctgccanggnccgttncntcctgctcatggncttnaggnngnctgatcatngaaagg

SEQ ID NO: 5732 - DNA, 808 bp, Homo sapiens
  misc_feature 10, 11, 13, 18, 20, 21, 22, 23, 27, 29, 32, 35, 37, 44, 60,62, 69, 89, 95, 102, 110, 115, 118, 119, 120, 129, 130,133, 136, 139, 140, 154, 157, 159, 165, 170, 180, 186, 194,197, 202, 203, 204, 208, 210, 219, 221, 224, 243, 252: n = A,T,C or G
  misc_feature 254, 260, 267, 269, 272, 279, 281, 282, 297, 302, 305, 312,319, 321, 322, 323, 326, 332, 333, 346, 350, 360, 367, 371,374, 376, 380, 382, 396, 398, 404, 412, 423, 430, 435, 444,446, 461, 471, 473, 478, 491, 495, 497, 498, 501, 502: n = A,T,C or G
  misc_feature 520, 528, 535, 552, 553, 556, 561, 580, 582, 583, 586, 592,593, 595, 611, 614, 615, 621, 626, 627, 628, 631, 635, 639,641, 644, 652, 658, 662, 676, 679, 685, 686, 703, 707, 713,714, 718, 737, 767, 776, 791, 795, 796, 798, 804, 805: n = A,T,C or G
  misc_feature 806: n = A,T,C or G
tttgttggcnncntagtnannnnggananacntcntngctctanaagaattgggttggtncngcacgangagatgtgtccagtgccccntgtggngtgtgantagaaacncctgnggnnnaagtgactnngtnggnccnnctggcttcgtgcangangnctcgtnactgnatacgacccngccacngtgttctnaangacannnccananatgggttanantcnctgctgtgggagtctttantcccacacncnggacangctggtnanctncactgtncnngatgatgcacacccngaccnatnacgtcangacgatncnnntcncgacanntatggtgaagatncctnccgtggtccnattcttnctgnacntnctgngnccatgacgctcacntngctgtngagctcgntccgtgcccangtgttgnacatntaacagatncnacactgtcttacaangggaccaccnangattngggtctctacaanagancnnacnntgatccttaattattctnagggcctnccgttgnttttggctctgcctggnnttntaggncaacgggacaatccaaccntnnccntttgannanccttatgaacaatttntgnncttcanaattnnntangccntttngnagnaataaccnttttancctnattttgacctgganttnattccnnccaatgccttcggaagntggncctttnncacnaaggggaccaggtggaaanccctcttgatttggaccaaaaaaggccccncttggcttnatctcccttaaactngatnncncgtgcnnncg

SEQ ID NO: 5733 - DNA, 727 bp, Homo sapiens
  misc_feature 2, 8, 18, 22, 32, 37, 101, 171, 302, 362, 408, 409, 437,468, 483, 498, 522, 529, 531, 552, 557, 581, 613, 626, 640,655, 664, 692, 714, 720, 721: n = A,T,C or G
tncttaantggcttggcnactngttctttctncaggnagcccatgcgattcgaattcggcacgtaggtcagacatgaaaactattttaaagctgactttgntgccttatcttgaaaagaatctagataggtgcttttaactggggtattaacttttttagaatgacacagntgaacagtgttaataatagtgtgtcaagattgcaaagtcgacatactcatttggtttaagcaggaatcctagaagcaaatggatggggataagaataggtcattttctattcaccatcctttactattaanggaaaggaaaagaacactagctaaggaagggaaagggaagtgatctcataaaagtagcanccttcattttacattctgtctgttgttcttttcctgctttgccagnntgtgctaatttgggaattgtgtactccnaaacaagtagaaaagtgctgctgagggattntattaaatctttttntaatggaatgtggcncaaattgttcatgttaccaaagcnatatttncntgggaatctaattcaaagttngtggnatacaacctgagccttttcttatntaacacaagaatatgttcacatcttggtatgnggccatatttatngaatgctgaactcnattgtgcaagttgtnctggatgcngtttgtaaataactgaaaataatttggntgacctttttattcaattctgnatagannttaaaa

SEQ ID NO: 5734 - DNA, 748 bp, Homo sapiens
  misc_feature 3, 67, 69, 80, 81, 83, 96, 98, 102, 112, 114, 126, 127, 130,131, 144, 163, 223, 249, 250, 275, 277, 281, 331, 339, 367,377, 390, 419, 434, 443, 460, 463, 468, 480, 481, 494, 499,509, 511, 514, 522, 526, 532, 544, 550, 555, 577: n = A,T,C or G
  misc_feature 581, 589, 592, 597, 604, 605, 606, 618, 628, 629, 633, 642,643, 647, 650, 654, 665, 667, 668, 671, 672, 695, 715, 733,736, 738, 739, 740, 747: n = A,T,C or G
ttnctactaattgcttggctacttgttctttttgcaggatcccatcgattcgaattcggcacgagcntngcttttcttgnnancagcagtttttcngnacanatttgctttntnttacaaaaagannacnnaaatgctgttgtnttaacatttcagaacaganattgtgttgatgtgatcagtgtttgggggttaactttgcgttaattcctcaggctttgcnatttaaggaggagctgccttagaaannaaataaaggccttattctgcaatantnggantgaaccaatattctatagaacatataggtacagctgatatcgtgtatatnttccttanagaatagctgaacaccttgagccttaanacggagctgntgggaaacattangcactcttttatgcgtttactcctgcctntgcttggcactgcantcttaaganagattcaaaaggctgcnaangagangaaatctgttcnnggaatgtttcacnggccnataagatgcncnaanactctgtnctcngatgtntgcctgggcccnatgtgnaaggnaggatgcctgctcgttcttgcncctntgcctctnagnacacnatcagtnnncccttcaagacnttccacttgnntaanatatttatnnatgncangganaaggctttaantnnatnnggacaaataatgctttagttttnttttccaaattaggcccttntttaaaaacaaggttggntgnannntccctcna

SEQ ID NO: 5735 - DNA, 748 bp, Homo sapiens
  misc_feature 3, 9, 19, 20, 23, 28, 31, 36, 37, 42, 44, 46, 47, 71, 94,166, 356, 380, 407, 416, 457, 459, 489, 544, 581, 583, 585,606, 619, 636, 639, 655, 660, 670, 679, 701, 702, 710, 740,744, 748: n = A,T,C or G
ctncttaanggcttggcanntcnttttngcncgcannccaangngnntgggagccactgcgcccggccaangacactttcaaatactcatgatnggatatgcctctgtgattgacagtgagcatttcaaatgggttaaagattgctctgcaaagaggttaactgtngagattgatacaggctatcttcaacatatgtacattgctgtatatgacatttacctaccattgtgcatctgggacttcctgatggaccacaggaattcccttttcttcccattctcttccagatctttcttctacttgaaaccccttatctacaaaaatgaataaacaacccaatctcatttctgatcgngtcctggaattgatctaaggcaangtctggagaagtggtgggagacagcanacagctttngttaagtcttctaaccccagcactttctcagcctcatctgngngttcctgtctcactctgcagacctcacttnacaatgctcttcagatcctttaatgaataggaaattgattttgggtatttctatnaaatacagcagagtcttagaaacttgcagtggccttnanangaaagaaccccttcttaactncctggccagattnatctttcttttatgggntcnaacactaactgggaanttttncccatggganggtatttgngcctttcagactggctttttgnngaactggntttggagggacataaaccgtaggactggtnatantttn

SEQ ID NO: 5736 - DNA, 714 bp, Homo sapiens
  misc_feature 4, 6, 7, 18, 79, 81, 84, 89, 96, 97, 98, 99, 103, 105, 114,115, 116, 117, 120, 125, 126, 133, 140, 150, 158, 161, 163,164, 172, 174, 178, 181, 194, 199, 205, 209, 225, 231, 237,247, 249, 255, 258, 260, 272, 282, 291, 292, 299, 308: n = A,T,C or G
  misc_feature 310, 320, 325, 328, 330, 337, 341, 346, 347, 355, 357, 360,362, 370, 386, 397, 410, 413, 415, 419, 423, 427, 428, 437,441, 445, 460, 467, 468, 471, 476, 477, 486, 490, 491, 495,526, 527, 544, 560, 562, 576, 582, 587, 590, 591, 599: n = A,T,C or G
  misc_feature 604, 606, 624, 630, 634, 636, 638, 639, 640, 643, 646, 649,650, 670, 673, 675, 681, 684, 699, 703, 707, 708: n = A,T,C or G
ttgncnncttaatggctnggctacttgttctttttgcaggatcccatcgattcgaattcggcacgaggtctcataaccntnttngacancaataannnnacgncnagaaccttnnnnaantcggnnaatctgnccatacnccacacgganctaatctngtncnngacattanancttnaangcatgcgagtttnctaanaaggcngttntctttccaaagtggtngccaantttatnacttatgtgnanaattgnttncngatgactgccanaaggcttttnaagatctanngctgtgnaggaagttntntaagaaaatngctgnacnanttgctanatanttgtnngccatatntnatnantgtaccanttgatacttggctgtnccttctataangcatagtgagaanttncnctancgantttnntaaatgctnttcnggtnacattgccaagaatntgttgcnncanaatgnntaataattntacnngatngaacgtctacctaggcttaggactcaagctnnatggaatgctgtgtagnacacatttgtaaccgngnccgacatggaaatngtgggnaaacnganntttcctgngaaananaactcaggttttactttngcaggngcantncnnnatnttntcnnccctacaactgtgtgagcgnagntncctttntcncacttgtgggatacntggntaanncggcca

SEQ ID NO: 5737 - DNA, 778 bp, Homo sapiens
  misc_feature 3, 5, 6, 8, 9, 10, 11, 18, 20, 27, 29, 60, 61, 82, 86, 97,103, 109, 155, 162, 207, 224, 274, 281, 479, 488, 575, 622,641, 660, 694, 725, 726, 751, 752, 774, 778: n = A,T,C or G
agngnntnnnnggttctncntctcctngnaaacccttaatggcttggctacttgttcttnntgcaggcagcccatcgcttcnaatncggcacgagcntatgtnatgctntcacctcccctgtgtaggaaagacctttaactaccagctggtagtngtctcancattcttcaaatagtccggtcttgtttaatattattattattatngttatttaattttattntattgcaactgtacttagagaatagtctggtcttgagaccttttcactgnggtctgntctggtgtacggctcccaccagtgtgaagcagaaggatgactttgctctgttgtcaggacaaccttgaaggaaggagccaaatgtgtggaggtctgtgggaagagagagccacctagcatgtccccactgaaccagtcagcaagaaggccttccccaggaggcctccaacagatccctgaatgccacataaacctcanaggcttggngatcccaggaccctccaggcgctcaagatctccctttgccgtggtcctttccgtcatcacactggccacagtcctctccaatgcctntgtactcaccaccatcttaactcaccaggaaagcttcacacccctgncaactacctgattggcttnccttggccaccaccgaccncttgggttttccatcttgggtaatgccccatcangcatttgccttattcccatttaacccaacannctgggaacttttgccaaaatcttgnngtgaacaatttggctggcctcngacn

SEQ ID NO: 5738 - DNA, 787 bp, Homo sapiens
  misc_feature 2, 54, 64, 67, 76, 96, 100, 111, 113, 124, 137, 154, 159,166, 168, 171, 172, 178, 180, 181, 185, 187, 188, 191, 193,195, 198, 206, 214, 220, 221, 222, 231, 232, 238, 249, 251,256, 266, 274, 279, 283, 289, 296, 297, 307, 339, 348: n = A,T,C or G
  misc_feature 349, 351, 359, 360, 381, 401, 431, 432, 442, 452, 479, 484,494, 496, 504, 506, 508, 514, 529, 550, 551, 553, 557, 558,562, 571, 574, 575, 576, 580, 582, 585, 599, 602, 607, 612,613, 616, 622, 625, 642, 652, 661, 678, 683, 705, 709: n = A,T,C or G
  misc_feature 714, 729, 740, 741, 750, 759, 771, 772, 774: n = A,T,C or G
gncaggctcttgttctttttgcaggatcccatcgattcgctagactgctatgantagtgatgancancatctcagnctgccaagggagaacatgantccncatgaacaaantnggttccctgancagggggaaatgnaatgctgagactcacancaggnggtgcgncntanngacctntnnctgnanngananantgnaggccacnatacactngatgannnaatggactnnctcttnaaagtgctggnantgctnctgccataantatagtanatatnacanttgccntggtccnncttctacctnagaatgctgtgtcttacgctctgtcttcccanatctcccannanttgggaanntctgaggtcagagggcaaaangagaaccttttaattctgantctgacataatcagatctggaaccagttgnnaagctgtaanacttatgcangcgtaaggtggttggtggtttaagccntatgntagctgtggntntctaaaanantntgaatntatctctgtcatagngtttgacctgcatttgctaanngngtcnntaanggatgtggngannntggnanttnccccatgcattccnagngtctnggccnntanaaaccnggnccaattgaagttcaacntttaactttnggcctgtanaggaccatttggccatnggtgnccttgtttaaagggaacgaatnttgngaatncgattaagccatttntaatttccctnnttggccttnaatcccccntggaattctttnncngggaacccctttt

SEQ ID NO: 5739 - DNA, 863 bp, Homo sapiens
  misc_feature 1, 2, 7, 13, 17, 18, 19, 22, 26, 41, 43, 47, 48, 52, 56,63, 77, 88, 93, 95, 98, 101, 116, 123, 135, 136, 143, 150,159, 197, 228, 250, 264, 274, 293, 316, 344, 365, 400, 433,454, 456, 458, 491, 494, 502, 503, 506, 549, 559, 579: n = A,T,C or G
  misc_feature 581, 590, 594, 606, 618, 624, 644, 653, 661, 662, 676, 686,692, 693, 719, 728, 737, 767, 785, 788, 792, 810, 829, 836,838, 844, 846, 847, 850: n = A,T,C or G
nngtccncctttncaannnctngganacccgttctttctcnanacannaagntctnatgctgnggcacgaggtctcnagttttttttntttgntngtnganacaggctcgctctgncgcccangctggagtgcannggcgcantctcggntcactgcancctccacctcccgggttcacgccattctcctgcctaancctcccgagtagctgggattacggccgcccnccaccactcccggctaattttncggattttttagtngatacagggnttcaccgtgttagccaagnatggtctcgatctcctgaccttntggatccacccacctaggccttccaaantgctgggattacaggcctganccacttgcgcccggcacattcaggttcttatcaangaaataacccagactttaatcttgaatgatacnattatgccccaatgtttaagntnanaaaaatttccttaaaaaggttatctttaaaatnagnatctttanngcnaaaatacccaagcttgatggaaaggccatcttggatgcccttncattcttgtntcaattccatcttcccaaananccaggttcnaaantaaccccctttnttggttggggcnatatgnaaattttttaaagggagttnaattccaanatggattnnaaaccagactgccntgaattgganaaattnntgatttccttcaaaattgtggtttcntttctaaanttggctggncccttaatttggattaatttaaatccatgntattattgattaaatctngangcangatgaaactttaccagtnttggaaattaattactaanttaatcncnaatatntnnaantttttccttgatc

SEQ ID NO: 5740 - DNA, 723 bp, Homo sapiens
  misc_feature 3, 6, 7, 23, 34, 559, 718, 720: n = A,T,C or G
ttnttnntttcaaatttcaaatnctaggctactngttctttttgcaggatcccatcgattcggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgnggtgatcattgttgtgtatgagaagaggaagaggccagatgaggttcctgacgatgatgaaccagctggaccaatgaaaaccaactctaccaacaatcacaaagataaaaacttgcgcccatagaaacacaaattaagtactgcttacaatatctttangntcc

SEQ ID NO: 5741 - DNA, 771 bp, Homo sapiens
  misc_feature 6, 7, 19, 22, 30, 33, 38, 44, 47, 48, 49, 50, 57, 58, 60,71, 75, 97, 100, 102, 113, 118, 124, 125, 126, 129, 130,133, 134, 136, 137, 139, 140, 143, 144, 148, 150, 155, 157,162, 165, 166, 169, 171, 176, 182, 185, 195, 201, 210, 219: n = A,T,C or G
  misc_feature 221, 226, 227, 230, 231, 232, 243, 245, 253, 255, 256, 278,286, 287, 289, 295, 310, 311, 326, 329, 338, 342, 345, 346,348, 349, 360, 366, 367, 370, 382, 391, 419, 438, 439, 442,472, 474, 477, 483, 484, 490, 491, 495, 505, 510, 521: n = A,T,C or G
  misc_feature 546, 558, 560, 565, 566, 568, 571, 576, 579, 580, 588, 601,612, 623, 628, 630, 639, 643, 644, 651, 654, 663, 665, 667,682, 687, 696, 700, 704, 720, 731, 734, 741, 743, 749, 750,754, 762, 764, 770: n = A,T,C or G
gtttannaccagctcttgntcnttctgcangancgatnccatcnatnnnnattccgnncnagggggctgangcgnccgaggacagctcgcgatgagnggncnacgaaggctcntctgnactggnnncanngtnnanngnnctnnctcngngtatncngttcncannctnancgatncatgtnctntacttgatcnggatanaactgtatnagaaccaangnacttnncannngctactgaccntncccatgtncnnctgcacgtagttggatagatancactaccnntnaccagntcgatgaacccgatnngtcctgcagctggtncanactgtctgngcanctnncnncttgcagttgnaccttnnggnccttgttaatgncactaccantgtgctgtccttatgccatggatgttgntcccagatctgtactaacnnctnccaggacatggccaatttgggtagcccctnantgnagatgnnctgacnntganatcactgatnactanatggggctcancgtgatttacatgccactcttggtnatatggtcttantngatgnnanctngatgntgnncaaccttntggaatgacctanatgagctgganccatgaaaganattgncncaagcattncccnntgacggngantatgggctnantncccttattactattnccttngtggacttnttantaanattctgcaaagctcangtccaaattgnatnacctttngnaggcannaccnttcatggntnttgtgnt

SEQ ID NO: 5742 - DNA, 732 bp, Homo sapiens
  misc_feature 2, 5, 8, 9, 13, 22, 580, 614, 637, 647, 649, 667, 675, 679,696, 723, 730, 731: n = A,T,C or G
gnttnttnntttnaaatctcangctacttgttctttttgcaggatcccatcgattcgaattcggcacgagactgctccttcattcccaagaagaaaagacaagtactgctacttccaaaactcagacacgacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggggtggcacagaatcaacaagatatgcagttcaactaatcaatgcactcattcaagatcctgctaaggaactggaagacttgattcctaaaaatcatatcaagaacacctgccagcaccaaatcaattcatgctaacttctcatctggagtangtacccacagcagctttcagttaaaatgcatttnctttgggtgctccaactctttgnaactttacangngaacaaccgttttctacngtttcaancccntttattaaacctttatnaggaatgttcttaaaaaaaaaaaaaanaaaaacnnt

SEQ ID NO: 5743 - DNA, 751 bp, Homo sapiens
  misc_feature 1, 8, 10, 11, 12, 13, 14, 15, 17, 63, 68, 88, 99, 109, 128,131, 134, 144, 151, 152, 154, 156, 159, 162, 166, 167, 172,184, 187, 193, 195, 199, 212, 213, 214, 221, 235, 238, 242,244, 250, 251, 254, 257, 269, 274, 275, 281, 285, 287: n = A,T,C or G
  misc_feature 288, 294, 295, 303, 305, 306, 308, 309, 312, 356, 360, 362,371, 403, 410, 412, 424, 425, 429, 431, 433, 444, 446, 450,451, 452, 453, 454, 460, 469, 470, 472, 474, 500, 508, 509,517, 527, 530, 540, 549, 550, 553, 558, 594, 608, 623: n = A,T,C or G
  misc_feature 625, 629, 636, 651, 658, 666, 669, 672, 681, 685, 694, 695,709, 725, 727, 735, 741: n = A,T,C or G
nggagggntnnnnnntnatagacagctacttgttctttttgcaggatcccatcgattcgaatncggcncgagcctgtgtggggtgcgngtacattgcanacgctctagngacctgttgtgatgaactnttntcnatggagagantcactcnngncntancancggnnccggnggatcaagaganacngtgtancnctcngaggatataactnnncaagatntactactgatgcanccnattntngccttnnacntgngggcattacacntgctnntgatgntagntnnaaatgnnttaacagnanncnnccnattcatgactgccgtgggatctaagggaatcaatgccaactgtntacntntggactctnaaagctaatattgtacatggtctatcagtccnggaaatntngcttataatatnnatgngncnttttaatgacntntatnnnnnagatcnctcactttnncnanagggctataatgagattcacgaagtntgcttacnngagagcanacatccggtnatnatactgaaantcctgtggnnatnaaggnttttgaacacttgcaattatttgaattaattcagcncctggtaagaactnccaggaagttcacananagantccattntgttgaaactgcctntggatantactccantgntgnatgctctgntganatcttccanntgggctaccgattnaaggccatggtcaagntnctcacttngcaggnctgaattacc

SEQ ID NO: 5744 - DNA, 719 bp, Homo sapiens; identical to SEQ ID NO: 5729
  misc_feature 12, 13, 95, 96, 194, 203, 210, 299, 428, 460, 532, 550, 560,563, 585, 591, 660, 664, 666, 670, 671, 674, 684, 686, 691,698, 704, 708: n = A,T,C or G

SEQ ID NO: 5745 - DNA, 719 bp, Homo sapiens; identical to SEQ ID NO: 5729
  misc_feature 12, 13, 95, 96, 194, 203, 210, 299, 428, 460, 532, 550, 560,563, 585, 591, 660, 664, 666, 670, 671, 674, 684, 686, 691,698, 704, 708: n = A,T,C or G

SEQ ID NO: 5746 - DNA, 779 bp, Homo sapiens
  misc_feature 7, 8, 9, 11, 16, 17, 29, 32, 35, 41, 48, 51, 64, 85, 88,103, 112, 128, 133, 157, 159, 165, 171, 173, 175, 186, 187,188, 189, 190, 193, 197, 207, 211, 213, 215, 219, 220, 226,228, 229, 230, 232, 234, 237, 242, 248, 251, 253, 257: n = A,T,C or G
  misc_feature 259, 266, 271, 275, 281, 320, 326, 330, 334, 338, 353, 361,363, 364, 369, 400, 402, 405, 407, 408, 411, 412, 421, 422,425, 426, 459, 463, 467, 469, 470, 473, 476, 482, 492, 497,504, 510, 535, 539, 541, 545, 547, 551, 555, 560, 562: n = A,T,C or G
  misc_feature 569, 578, 582, 592, 600, 606, 611, 621, 622, 634, 636, 638,642, 644, 651, 656, 660, 665, 676, 679, 682, 686, 688, 698,699, 708, 709, 723, 725, 734, 738, 744, 752, 754, 765, 767,777: n = A,T,C or G
tcattcnnntnctagnncttggtgcgganccntcncttcgnattcggntcnaggtcttcactgntggctggttcccaagcaggantgncgagctctggtcctntcaaaactnaaggtcggcttgaacntgacntagactcctaatgccttgtttgcncnactacngaaccntncnatagacatcgnnnnntcngatngtgacacagncttngncnatcnntatacngnnncngnctntatantaaggnttntnggantntggacgnacgtngtcnagatgnatagactcagactcatctgatgtgatgataagacagaantggagngccngacntganttgtctgcaggatgngtctgaancnnatgtncctgtgtgtgatcttaaagatgtgaatgctntnagncnnatnnccttaatgnntgnnacgagttcgacaagatttgcgattgacttccanactntacncnntgntgntcctgntagatggctntaaanacttggntctccnatgtggtcatatggagaaccccttnctgngncgancnttgntcangcctngncttttcncctggaagnaggntcccactttnggcttgcncaattngggcnaatggcattnncccttttggggngncncccnancttggtnggttnaacnttccntaagggccaanaanccntttnanctcccctttnncctgcccanntctcaatccacctntnaatttcccnaagnggtttntaaaactntnaaaccttttcnanaaagcccctnct

SEQ ID NO: 5747 - DNA, 779 bp, Homo sapiens; identical to SEQ ID NO: 5746
  misc_feature 7, 8, 9, 11, 16, 17, 29, 32, 35, 41, 48, 51, 64, 85, 88,103, 112, 128, 133, 157, 159, 165, 171, 173, 175, 186, 187,188, 189, 190, 193, 197, 207, 211, 213, 215, 219, 220, 226,228, 229, 230, 232, 234, 237, 242, 248, 251, 253, 257: n = A,T,C or G
  misc_feature 259, 266, 271, 275, 281, 320, 326, 330, 334, 338, 353, 361,363, 364, 369, 400, 402, 405, 407, 408, 411, 412, 421, 422,425, 426, 459, 463, 467, 469, 470, 473, 476, 482, 492, 497,504, 510, 535, 539, 541, 545, 547, 551, 555, 560, 562: n = A,T,C or G
  misc_feature 569, 578, 582, 592, 600, 606, 611, 621, 622, 634, 636, 638,642, 644, 651, 656, 660, 665, 676, 679, 682, 686, 688, 698,699, 708, 709, 723, 725, 734, 738, 744, 752, 754, 765, 767,777: n = A,T,C or G

SEQ ID NO: 5748 - DNA, 779 bp, Homo sapiens; identical to SEQ ID NO: 5746
  misc_feature 7, 8, 9, 11, 16, 17, 29, 32, 35, 41, 48, 51, 64, 85, 88,103, 112, 128, 133, 157, 159, 165, 171, 173, 175, 186, 187,188, 189, 190, 193, 197, 207, 211, 213, 215, 219, 220, 226,228, 229, 230, 232, 234, 237, 242, 248, 251, 253, 257: n = A,T,C or G
  misc_feature 259, 266, 271, 275, 281, 320, 326, 330, 334, 338, 353, 361,363, 364, 369, 400, 402, 405, 407, 408, 411, 412, 421, 422,425, 426, 459, 463, 467, 469, 470, 473, 476, 482, 492, 497,504, 510, 535, 539, 541, 545, 547, 551, 555, 560, 562: n = A,T,C or G
  misc_feature 569, 578, 582, 592, 600, 606, 611, 621, 622, 634, 636, 638,642, 644, 651, 656, 660, 665, 676, 679, 682, 686, 688, 698,699, 708, 709, 723, 725, 734, 738, 744, 752, 754, 765, 767,777: n = A,T,C or G

SEQ ID NO: 5749 - DNA, 720 bp, Homo sapiens
  misc_feature 5, 24, 28, 34, 39, 43, 48, 49, 386, 406, 418, 458, 460, 464,484, 485, 511, 516, 528, 548, 578, 583, 586, 611, 625, 633,637, 639, 642, 646, 659, 670, 688, 691, 695, 702, 709, 720: n = A,T,C or G
ttgcnaacttaatggcttgggganactngttctntctcnaggntgccnngcgtttcgcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaanaagcaacaggcaccattcangaagattacctnagagagctgctgacaaccatgggggatcggtttacagatnangaantggatgagctgacagagaanncctattgacaaaaaggggattcaatncatcnagttcacacgcntcttgaaacttggagccaanacaaaattactgaaaggaacttagctaaanctttncanttccatggcttactctttttacttnttaaaccttccccnccttttanaacntntgnattncaattaatttaanaattttggccntttttttttgggggtttnttnccanctttttncctttgnctttggttaan

SEQ ID NO: 5750 - DNA, 1593 bp, Homo sapiens
  misc_feature 9, 16, 25, 28, 65, 86, 89, 94, 114, 140, 148, 179, 185, 198,205, 207, 217, 219, 226, 233, 235, 236, 238, 239, 240, 244,247, 248, 252, 265, 266, 272, 273, 274, 275, 281, 286, 298,306, 307, 308, 314, 323, 329, 336, 339, 347, 353: n = A,T,C or G
  misc_feature 370, 374, 376, 381, 383, 386, 387, 390, 392, 395, 398, 400,401, 403, 405, 407, 408, 409, 412, 414, 425, 432, 433, 434,438, 439, 445, 454, 460, 466, 467, 473, 483, 486, 490, 492,502, 506, 510, 515, 516, 519, 520, 525, 536, 542, 546: n = A,T,C or G
  misc_feature 548, 559, 562, 565, 574, 578, 579, 583, 585, 588, 590, 594,595, 604, 605, 607, 615, 618, 620, 622, 626, 637, 641, 646,653, 659, 660, 675, 678, 681, 684, 686, 692, 695, 696, 703,705, 707, 711, 712, 720, 721, 722, 724, 725, 727, 728: n = A,T,C or G
  misc_feature 737, 739, 744, 747, 754, 774, 777, 780, 783, 792, 794, 801,804, 807, 810, 821, 823, 827, 828, 838, 841, 849, 851, 852,856, 879, 887, 889, 912, 916, 919, 937, 941, 947, 949, 951,959, 962, 966, 973, 974, 975, 976, 992, 993, 994, 998: n = A,T,C or G
  misc_feature 1003, 1008, 1017, 1020, 1021, 1026, 1028, 1031, 1035, 1036,1039, 1043, 1047, 1049, 1050, 1052, 1059, 1062, 1076, 1087,1088, 1091, 1103, 1106, 1107, 1110, 1121, 1122, 1123, 1124,1126, 1129, 1130, 1135, 1148, 1153, 1156, 1158, 1160: n = A,T,C or G
  misc_feature 1167, 1177, 1204, 1205, 1207, 1211, 1220, 1227, 1236, 1239,1240, 1245, 1247, 1253, 1255, 1256, 1259, 1263, 1265, 1267,1269, 1271, 1275, 1276, 1278, 1282, 1291, 1292, 1294, 1298,1299, 1305, 1307, 1312, 1316, 1317, 1318, 1323, 1325: n = A,T,C or G
ttttttggnaaaaaancccccaaantanccaagggcccttaacctttgggttttctttttttttnggccaggggggaatccccccnatnccggnaattttcccgggaaaatttnccgggggccaaccggaagggaatttnggttaagnccaaaaggttttccaaggcctaaattggggngaaatntggggctctttcnctcatcnanggcactactncntcgctcntaacaanannannntatntanntttntataccttatcanncacaannnnctcctnctacntacgtatacatnttataatnnnatttanctatccatnctactnccctcantcncttataantacctntcctactcctacatatngacncnctgantnttnnctnanacnaancnncntntnnnatntnttctctattanttaaaannntccnnctagtncttatatantatcantacttnntctatnaccgatcacntcntaancnttatctttcntatntacnctacnnatnnccatnattatcgtctnatttancttntnatttactacangantgntctatcatnctcnnatancnacncntctnntccatactnncnatttgacnacngnancatngttgttctccntatncatgntcgtttnatacannactacattatcaatnatntcnctnantattcnaanntacgcantncncatnnctactcannnanncnntacctactnanttctnacnatgtctntgttaactatattaaccgtncgnacntanacatcaagntnacatacntanccnganacataccaaancnatanntaacatatcnctnacttacananngacnattctactacatcaatctacctntctgtaangnaccctttatgatactaccaaaancatncgntctacttctctcactccntacncatacnantnttgcattngcnatcncacgtannnncctacactatagctannnttgntctcnttttntctcactantcnncactntntanatanntantctntctnanngnctctgtngtnaaactccacgcatntacaccgctcnnaanctccctacccanctnnctntatcccttccnnnntnaanntatangtctctatatacnctctncanantnacatctnttattctccnctatgtccctttcaacaaaatacacannanactnactcttctnaacatangacatactncgnntctanantcatcnanntantcananantncntacnnantcancttctttannanaccnncgtatntntcttntctnnnatctntntncnntntctaaatttagttncttncctcncatgtnttancncaanacactntcatncatgcannttcnatacnaatacntanntacatntcatncanntnnattactnaangacatancngccatatatactangattgtaacattcatnannancnncngnatntacacnttattctctatatnatatcttgnatntcacnncttctntcnatctntacnanntcangttnncancacnatctntctnacntcancctccaaaccc

SEQ ID NO: 5751 - DNA, 749 bp, Homo sapiens
  misc_feature 2, 3, 7, 16, 17, 20, 23, 86, 112, 219, 260, 319, 334, 359,361, 455, 481, 502, 516, 518, 523, 554, 569, 571, 572, 611,626, 629, 686, 689, 694, 717, 723, 729, 739, 744, 745: n = A,T,C or G
gnncttngaatttaannccnttngctacttgttctttttgcaggatcccatcgattcgaattcggcacgaggttcctgatatggcnggctatcctcacatgtcgttacattncatcaggattggatggaacatcattcagaggtcctttcacgggcaattttgaggaactgattcatttggaagaaagattaggcaatgtcaatcgtggagcatcccangggacaattgaaagatgtacatatccacataaatacaaaanggttacaactgattggttctcacagaggaaactgcactgcaaacaagatggggaagaanggactgaggaagacncacaggaaaaatgtactatctggtngnctattttagaggaaggtgaagatgtgagacgtcttgcatgtatgcaccttttccaccaagtgtgtgttgaccaatggttgattccaataagaantgccccatatgcacagtggacattgngcccatctgccaagtgaaagntgacaccatgtttnanaactnttgccctccctctcatcccattacttcctgntgctgtacttcaacncnnagatggcatgacttacctgcgcagatttggaagcattgnaacttataatgctgnctntgctatatgggacaacttatgcttagacctacagtttatgtatcaagtggctttgangtnttatnaaagctttttttctagattgacnttttcngctcanttactggttnttgcnnggtc

SEQ ID NO: 5752 - DNA, 789 bp, Homo sapiens
  misc_feature 5, 10, 11, 12, 13, 14, 19, 23, 24, 476, 500, 514, 603, 638,662, 674, 735, 747, 768, 782, 786, 787: n = A,T,C or G
ttatnctgtnnnnnttttnaaannatagctacttgttctttttgcaggatcccatcgattcgaattcggcacgagccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttaaaaaaaaaaaaaaagcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacccaattgcattcattttatgtttcangttcagggggaggtgtgggaggtnttttaattcgcggncgcggcgccaatgcattgggcccggtcccacttttgttcctttagtgagggttaattgcgcgcttggcgtaatcatgggcatagctgtntcctgtgtgaaattggtatccgctcacaatttccncacaacataccaacccgggagccntaaagtgtaaancctgggggtgccttaatgaagtgagctaacctcacattaaattggggttgcgctcactggncccctttccagncgggaaacctttcttgccaanctggcatttaaagnaatnngg

SEQ ID NO: 5753 - DNA, 1214 bp, Homo sapiens
  misc_feature 3, 14, 17, 23, 27, 51, 52, 56, 59, 62, 69, 77, 80, 81, 86,88, 89, 91, 92, 93, 94, 97, 103, 105, 108, 109, 115, 123,124, 126, 127, 130, 134, 136, 151, 153, 156, 163, 168, 171,172, 176, 180, 185, 190, 192, 194, 197, 202, 209, 212: n = A,T,C or G
  misc_feature 217, 218, 220, 226, 235, 238, 244, 250, 252, 257, 261, 266,267, 270, 275, 279, 280, 286, 287, 289, 292, 296, 297, 303,310, 311, 315, 319, 320, 341, 343, 348, 349, 359, 365, 366,367, 373, 379, 381, 385, 387, 392, 395, 402, 410, 414: n = A,T,C or G
  misc_feature 416, 418, 419, 425, 431, 439, 442, 443, 452, 457, 459, 464,466, 467, 478, 479, 485, 488, 491, 506, 508, 511, 513, 520,522, 531, 533, 538, 541, 547, 549, 551, 554, 562, 563, 567,574, 575, 576, 578, 580, 583, 584, 585, 586, 587, 589: n = A,T,C or G
  misc_feature 593, 597, 605, 608, 612, 613, 624, 627, 629, 632, 635, 637,638, 639, 646, 647, 654, 655, 657, 664, 666, 667, 671, 672,673, 674, 677, 678, 680, 682, 683, 684, 686, 687, 691, 700,704, 710, 714, 715, 717, 719, 722, 729, 730, 734, 736: n = A,T,C or G
  misc_feature 737, 739, 740, 742, 744, 749, 750, 751, 758, 764, 765, 767,768, 769, 772, 773, 775, 779, 780, 782, 787, 789, 790, 798,802, 804, 808, 817, 819, 820, 821, 823, 824, 827, 829, 831,832, 835, 837, 840, 841, 843, 844, 847, 848, 849, 850: n = A,T,C or G
  misc_feature 851, 852, 856, 857, 858, 859, 861, 875, 877, 890, 894, 897,898, 908, 912, 915, 916, 919, 920, 929, 938, 946, 947, 951,953, 965, 970, 971, 973, 975, 982, 984, 986, 987, 990, 994,1007, 1015, 1018, 1035, 1036, 1047, 1049, 1050, 1056: n = A,T,C or G
gcncttcccccttnttnaaaccntttnaaaacccttggttaaaccccttcnnattnctnatngcttggnactacctnctnnacctnanntnnnnatncacggntngcnnttttcnacgttttnncnnccncttntncactcagcaactttntnacncttaatntgcanctnntctnctancgggnggccnanantanatggnataacanggntgtcnncngactgntcctggccntgnaaatancatctntnatggntaancacannttntccanagcnnaatagnntnggngccnnctgaanccccaanncctnattnncagcacccacctttattattnantatgnnatcataccanctcgannncctatnggtggntntctngngccantgnaatatangccgcagncatntngnntaacgntatcgntgcaacantcnntccaactgnaacantngctcntnncttcgccactnntaatanttncgntcattaccaagtatnanaangntatcttntncacactaantnagcgngcncaaagntngnatnatcactcnnatcnataactnnnantnatnnnnnanggtncaanatcttttntanatcnntatatttatantcnanttntantnnnaattcanntgcttgnnancacatgnannctannnntanntnannncnntatnctctttatngctnttcccntttnnantncanttagacnntacntnncnntnangcgcnnntattaancaacannannnttnnantcanntncctcntnncgattctntcgncncccntcactgccncnnntnntcncntnnctntnccnntnnctnnnnnngtcnnnntntctccttcttcagncnctgtcacgctctnatantannacgtatactntctnctnntannatactcganacacactgntgatatanncttntntacatctatcantacgnncnanatcatanantnntcnatanctctcacactctntcacgatngtntcatcgcaccacttcgnnactcatagatntnnatatanntaccnngtgntantctnntnnatcantaanaangcangcacgacgnacatcttgctntcnnncnatntcnnctctcnatnatnnantnacactaancacnatacncactaactatattactcncatntcancnctactctatgactctanctangcc

SEQ ID NO: 5754 - DNA, 1192 bp, Homo sapiens
  misc_feature 2, 3, 11, 12, 13, 15, 18, 23, 24, 34, 44, 50, 52, 54, 58,60, 64, 90, 94, 104, 106, 109, 113, 114, 125, 126, 129,134, 135, 140, 144, 148, 149, 175, 176, 184, 199, 211, 213,239, 247, 273, 274, 294, 296, 326, 330, 332, 336, 345, 361: n = A,T,C or G
  misc_feature 383, 386, 396, 399, 401, 415, 419, 423, 428, 432, 442, 446,456, 465, 466, 468, 471, 472, 489, 497, 520, 526, 531, 537,541, 542, 546, 555, 563, 568, 605, 611, 617, 623, 628, 640,647, 652, 655, 659, 666, 668, 669, 670, 674, 680, 701: n = A,T,C or G
  misc_feature 713, 715, 729, 736, 740, 749, 755, 763, 790, 793, 797, 798,801, 805, 809, 824, 828, 842, 845, 847, 852, 858, 861, 865,868, 880, 886, 902, 908, 915, 929, 935, 936, 945, 948, 952,959, 977, 980, 985, 988, 993, 998, 1003, 1005, 1006: n = A,T,C or G
  misc_feature 1009, 1019, 1027, 1036, 1039, 1054, 1056, 1059, 1060, 1066,1067, 1068, 1076, 1077, 1089, 1092, 1111, 1119, 1125, 1133,1155, 1160, 1162, 1166, 1176, 1181, 1182, 1192: n = A,T,C or G
gnnaaggggtnnncnttntcttnntctgctttgngtcatcgtcntcgacngngnctcngnctgntctagatgacctctccgctttttttncatngaaaagctcnanacntgtnnctaaatataannctnaagannggacnctanaaanngctcactatacatgctcaactaaacnncccctganctatatgcgctaggngaagcatgctcntncactagacaattgactctgctttagntaattccnattccggaaactcgcgcaacccggtnncctggggacctcctatctcntngaaacgatgaaaaagcccaacccttttagngtcncncctngaggaaatnggcgccattgggcganattcgccctccaaagggaaaanggngggttagacncangnccttttcacccctngggnaggngttgnaagnggaatagggnctcnaaatcccccnaatttcctnngngtnnaaatgggggccacctcngtaaccantcccttgttgggggaaaaatttngccttnattancccttnactnngggnaaacctttnccggaatngttangcaaaaattttttggcttgggggcctttttggggccntaaggnatttcngggggntttancccccaaaattntttcgtnggggncanattnaccaagngnnnccanttgganaccccaattggttgggccctnccccttgggttntnggggcttaccttanaaaaatnctcngagggggcnttaaanccttggtnggaacctttttttggaaaaggttttcnccngggnnttncccntttnaaagggcgttaatancccnggggtcttagtttnggnanaaaanccaatnttnttcnccnaaattgggtttnggggcntttggtatccccccgnaaattnccaattncaaaaaatttcccntggggnnccaattttnccntaanccctttnaaaccggttaaaaacctnggnggggnccnatttnttttnggggntnnaanaatttgcccnaaccgttnttaaccttnttncccctttaattcggngnttnnccccannntttttgtnngcccctaaacgngcntaaccaggggacctttttnggggaaancctttntccatganaaccctttccttaaaaaaaggnggtgncnaccntgggaggaancattnnttggggaatn

SEQ ID NO: 5755 - DNA, 1006 bp, Homo sapiens
  misc_feature 3, 6, 7, 12, 13, 14, 17, 20, 24, 25, 28, 29, 30, 31, 33,36, 40, 46, 47, 49, 64, 66, 75, 89, 95, 110, 120, 121, 124,125, 127, 131, 134, 137, 140, 142, 157, 161, 172, 173, 176,202, 205, 207, 232, 243, 251, 277, 282, 296, 302, 306: n = A,T,C or G
  misc_feature 308, 313, 314, 315, 316, 320, 327, 330, 332, 335, 346, 350,355, 356, 362, 364, 371, 374, 382, 389, 391, 392, 403, 408,411, 421, 424, 433, 434, 442, 443, 449, 450, 457, 464, 467,469, 476, 479, 483, 490, 491, 503, 510, 513, 515, 524: n = A,T,C or G
  misc_feature 526, 528, 529, 532, 546, 551, 558, 560, 564, 569, 571, 575,581, 582, 589, 591, 598, 599, 600, 606, 609, 612, 614, 615,616, 617, 619, 630, 633, 637, 652, 656, 668, 669, 670, 673,676, 677, 679, 687, 688, 694, 704, 711, 719, 721, 726: n = A,T,C or G
  misc_feature 728, 735, 746, 751, 752, 760, 766, 767, 769, 777, 779, 787,791, 793, 796, 799, 801, 803, 810, 818, 820, 823, 824, 825,831, 843, 844, 848, 850, 853, 854, 871, 894, 895, 896, 898,899, 905, 917, 925, 928, 929, 931, 936, 939, 940, 943: n = A,T,C or G
  misc_feature 945, 948, 951, 961, 967, 974, 978, 979, 980, 987, 989, 993,996, 998, 999, 1002: n = A,T,C or G
gcncannccgannnccncanccannccnnnncnacncccnaaacgnnanaagccgacgccacangnccccgcgancgcccaggctgaancttgcnttcaaaagctggaancgacacgctnnagnncnagcnacngcncgngncacgaggcccatgtncagnctccaagaccnncangacaccgcccaatgggaagcccccgnggncnggaggcgcacaggaagaaggggatnggggcaggaanaagcccanggcccaaggaagaccggaggacccanaaggncaggaagagacacncacgcnccgncncacannnncgcnacaaganacnancanggggagcgacnagcnaacanncacagnangagaagngancaccatgngcgacgnanncacacgcaccnagcgngcnagaatggacncanagaccacanngtgagaannaagccnnagacganaagaacncangngccgcangcncccngagaggnncccccccggcanaacatgncancnactacaccngncnnacnaaggggactcaggngatangaaggcncnacancgccngnaggnaaaacnngcacacncnggaaacnnngaaccntgnaangnnnncncaaaaaaaccncangggnagaaaagagcaaagngcgngcacgcaggggnnncgnaannanaaaacccnngcaggngaaaaccacngggctanaaccaggncncaagngnacggaanaacaacgagcnaaagnnacactaangaaagnngngcgcaacngnaaaggggnaacnanccncangncncacgcangggaaacnancgnnnaccganaaaaggggcaanngagncnccnnggggaaaaggcaccaanaagctataacccgagagcagagnnnanngccccncgccagagaaancccagagnaannangacgnaannaancntcnaanaaacagcgcncaaaangcgtggnacannncaaacancnaacnccngnnaancccc

SEQ ID NO: 5756 - DNA, 757 bp, Homo sapiens; identical to SEQ ID NO: 528
  misc_feature 2, 45, 63, 69, 76, 92, 101, 121, 123, 146, 148, 151, 155,170, 182, 209, 249, 258, 261, 268, 295, 303, 334, 344, 399,404, 419, 499, 501, 531, 532, 535, 547, 572, 580, 582, 594,595, 604, 632, 635, 711, 746, 748, 757: n = A,T,C or G

SEQ ID NO: 5757 - DNA, 711 bp, Homo sapiens
  misc_feature 3, 43, 53, 58, 62, 65, 70, 72, 74, 76, 77, 81, 82, 87, 89,93, 98, 100, 101, 103, 121, 137, 170, 184, 205, 210, 217,251, 254, 255, 257, 276, 300, 303, 305, 307, 310, 311, 318,326, 331, 337, 339, 342, 343, 346, 357, 366, 371, 374: n = A,T,C or G
  misc_feature 377, 380, 383, 394, 399, 401, 402, 404, 406, 413, 425, 430,439, 454, 497, 508, 523, 567, 568, 583, 606, 620, 628, 668,671, 675, 681, 690, 698, 710: n = A,T,C or G
gtnactaatggctgggctactcgttctttccgcaggagcccancgattcgtcnagtgntcgnggnttgtnantntnngccnnggcantnattnattgncnntngatgattgatatcaacanttgaggtaaaaatatncatgaggtctaaatataacatgtaaatgcaatntcatactttatttncattggcaagataacattgantaccnatactgnggtatttgacaaacaagcttgatgcatcgtgatntcnncnttatttcccttttccttgntttaaaaagatgcactgcgttgtnatncncnggnnatatgantactatgngcacnaaaacnanaanntcngatcattcgantagaggganaatcnganctncantcncattcgttctnattcngnngnanggatctngtaggtcctccnttctnagatgtggntttaggccagcagcntaggcatccctgagactccttataaatgcataaatctcaggcncagcccagatnacttggagcataatntgcagtttgcaagatccccaggcaattcatgtgcatgtgaaatnnggacaagcacctttntgggcgatgcaaagccactcatnctcgcgtgcctatnacggtttncaaacacatcggatcccatctcaggagcctgacccgtgtntanctanattaancttcactgntgatcttnatgatgcatatna

SEQ ID NO: 5758 - DNA, 749 bp, Homo sapiens
  misc_feature 5, 6, 7, 8, 9, 10, 11, 12, 13, 20, 21, 26, 51, 58, 490, 632,646, 661, 670, 710, 728, 736: n = A,T,C or G
agagnnnnnnnnnttgtcgnntactnaatggcttgggttggttgttctttntgcaggnagcccagcgattcgccgggtctagccaacatgtgactacaactgcatgaaagaccttaaatgagacctactcagccaaactcttcctaagtcctgtccaaacaaaaccatgaaggataagaaatggttattattattttaagctaccaccttttggtgtgattattatatgcaataataggtagcagacactggctttggttggacatgtatgttctctgcatattctgcttttgtgcatgtggagaaatgggctttctgggctgctgacaatgaggaggtagagatgttgttcaggcagatgcgtttagacttcgagtccactttctccttccaagaactatgtggccttacaaatgctggggttggtttaagaaaacagaactcttaatgtttgtaaacattcctgtacgagagttcatccatcatttgngtctctctagaaaggtcatacgcagaaaatgtagtggtgtagcaaaattttaaacttttcagactggcaaaaccctttctttaatgtatagtattactactcatgtccattatgaaccatgacccagggagactctgctganacaggctgcatctnctccaccttatcctnctaagacangcttctacctaaggggacatagaatttacccctgtttgtngggtggtgtggattcttnccaactgncttaatccactgg

SEQ ID NO: 5759 - DNA, 542 bp, Homo sapiens
  misc_feature 8, 9, 12, 17, 36, 37, 40, 43, 47, 51, 53, 65, 68, 72, 77,78, 87, 102, 103, 104, 105, 109, 110, 132, 138, 140, 142,159, 161, 162, 165, 169, 183, 203, 215, 228, 238, 247, 253,256, 273, 277, 283, 287, 296, 314, 330, 374, 388, 397: n = A,T,C or G
  misc_feature 403, 424, 426, 435, 440, 441, 446, 453, 457, 483, 487, 489,507, 516, 519, 542: n = A,T,C or G
atccctcnnttntcaantcatattcctcacaagcannctntanaatntctnancactttgttctntcncgcnaaggnngacgcgatntgaggactttggtgnnnntgannacttggctgattcacatgccanggcctngnangaagcaggagaaagganannggngacngacttaaacgtgtncaataccatccttaccaccngaagctatccanagcttctcagagngttgcagaantacaccaantacacnaancatgacatgaacaaagntctngacctngagnagaaaggtnacattgctaagtgccttnacagctctcgtgaacngcgccacaggcgaaccagctttctttgcagagaagctctatcangccatgaaaggtgntggaactcnccatanggcattgatcacgattatggntncccgttctnaaatnnacatnaatgatntcanagcattctatcagaagatgtatgggntctncntttgccaaaccatcctgnatgaaaccngangagattattgaagaaaatcctgn

SEQ ID NO: 5760 - DNA, 1285 bp, Homo sapiens
  misc_feature 6, 9, 14, 32, 35, 37, 38, 40, 46, 48, 49, 50, 56, 61, 63,64, 70, 71, 75, 77, 83, 94, 100, 102, 107, 111, 115, 117,122, 123, 127, 132, 135, 139, 149, 154, 158, 161, 162, 169,171, 173, 175, 176, 180, 182, 186, 188, 189, 193, 199: n = A,T,C or G
  misc_feature 200, 205, 211, 218, 221, 233, 235, 240, 246, 248, 250, 251,254, 258, 260, 261, 265, 277, 284, 291, 292, 294, 298, 301,304, 309, 311, 314, 318, 327, 328, 336, 338, 349, 361, 362,363, 364, 376, 383, 388, 389, 390, 397, 405, 406, 412: n = A,T,C or G
  misc_feature 416, 418, 420, 422, 423, 435, 449, 450, 454, 459, 466, 469,471, 475, 477, 480, 488, 492, 494, 499, 506, 510, 511, 512,517, 521, 526, 527, 534, 547, 553, 560, 564, 566, 590, 592,593, 603, 612, 620, 623, 631, 633, 636, 639, 646, 653: n = A,T,C or G
  misc_feature 655, 657, 659, 661, 667, 673, 692, 697, 700, 705, 708, 709,710, 711, 721, 722, 724, 729, 734, 739, 747, 749, 751, 753,758, 773, 775, 783, 788, 803, 805, 822, 830, 832, 836, 839,840, 843, 846, 847, 853, 854, 856, 857, 863, 868, 873: n = A,T,C or G
  misc_feature 874, 884, 886, 887, 889, 896, 898, 902, 916, 919, 926, 927,928, 938, 942, 950, 959, 960, 965, 971, 980, 981, 982, 989,991, 993, 996, 997, 1005, 1006, 1011, 1013, 1019, 1042,1052, 1053, 1061, 1065, 1068, 1072, 1086, 1092, 1101, 1105: n = A,T,C or G
  misc_feature 1109, 1114, 1117, 1119, 1122, 1125, 1134, 1138, 1139, 1145,1151, 1152, 1153, 1156, 1162, 1163, 1169, 1176, 1181, 1189,1190, 1191, 1204, 1207, 1209, 1210, 1213, 1216, 1217, 1218,1219, 1231, 1240, 1249, 1252, 1253, 1255, 1256, 1273: n = A,T,C or G
gaaagnacnaaagncagcttgacagggatttnaangnntnggaacncnnnttctcnaagcngnntggtcnngatnanttatanatatgtcttcncatatnangaacnaaantatntntgggnngggnttctnctngagngatttctgtnactcntganttnntaatgcntnananntgtnancgantnnggtnaattgnncctancagcancatgtanccntaaaaacgcatncnatatntcttancncnnagnggtncnncgcnattatctaatgncttcttnaactganntntaanggnctntgtantncgngaanctttaagtnnattcacgncntatattctaantcatgttccaannnncctatcctgcanaattacnctgcnnntgatccntggcatcnnggaagntcantncngnncaattattcatnatattgtggcattnntctnatttnatactancgncntccncntanatatatanaagncngcaanctctgtngaannncttcnaatntgacnnacccgtntattatatgcatnaacccntatcctnatcnanctctagtgtggctcttaggcaccnannatttatgggnaccctgtgntcaaattnggntctccgtnanctnacngctctcnatttaangntnangnctaacntaaccntctttgctgggtacaatanggcgnacnctccnctnnnnacatttttgnnanaaagnctacntgggntcactatntnananctacnccttttatcggtacntngcgtaatnattgnccatatgtgatacgngnccaacaaaatgtcactntatataantntggntcnnacntcnncgttanncnncctatntaacnttcannttttacatananncntaaaacntnttgngcaaacaaccaatnggngatcttnnngaaaaattancatnggtttttnggctacttnnctatntcattnaattaccgnnntatctcnancntanntaactacnnttttnanaaaggngtcaatgggtgtcatctctcagngacaccctcnnctatatancatnctntatntagtataatctcanaaaacnctccctctnaaancttntgggnacntnaanaanacgtgactntcanntcgaanccttgnnnttnttaatnnggatantaggggngtacnaaaaaaannngtgtttataaacncancnnttnaannnnttctctatatgngcaatttcnacggtattnctnncnngtccccatatatactanatcacantatnn

SEQ ID NO: 5761 - DNA, 782 bp, Homo sapiens
  misc_feature 2, 3, 5, 8, 9, 12, 14, 21, 25, 29, 30, 48, 85, 92, 102, 108,109, 111, 113, 118, 119, 120, 121, 127, 139, 140, 142, 150,160, 163, 165, 179, 186, 188, 201, 205, 228, 234, 241, 242,244, 253, 263, 266, 271, 272, 273, 280, 281, 284: n = A,T,C or G
  misc_feature 289, 290, 291, 292, 293, 295, 298, 299, 305, 306, 313, 319,324, 327, 330, 333, 347, 355, 356, 361, 366, 371, 372, 374,375, 376, 382, 383, 389, 400, 412, 417, 422, 436, 442, 444,449, 450, 456, 458, 459, 460, 465, 469, 470, 476, 481: n = A,T,C or G
  misc_feature 494, 495, 503, 510, 511, 520, 529, 535, 536, 539, 543, 545,546, 554, 557, 559, 566, 575, 588, 589, 593, 595, 599, 602,611, 613, 623, 643, 648, 651, 652, 658, 663, 671, 677, 678,679, 689, 696, 704, 708, 710, 711, 743, 749, 751, 754: n = A,T,C or G
  misc_feature 760, 761, 767, 771, 781, 782: n = A,T,C or G
gnncnctnnttncngcctttngaancccnnagttccaaatgctggttnagatcagctcttgttctttttgcaggaccctcgtcanaattccnacagggaganttcggnnantntttannnngagacngagtctggctcnntngccagccngaggcggganaancncctgaacctgagangtggacncngcgctgagccganatcnttacactgcactccagcctgtcnacagantgagacnntntctcaaagnatgtataatnctnacaannnctccacnngancaaannnnnangannccggannacggagnctcctnccctnaanganccntggaagaatggagncacccagnngctcnatttntgggnntnnncacttnngccgtnaaatggatgancaagggctcaancagtnccctncataatctgccctnaacccntncaaannaacatntnnngccantctnncttcanaaacnggaaggagccccnnatgacatnccagtcnnagcccccancgaggaacnaggccnntgncccnanntgagtgcnagnanaagggcnccctgccanagcccctgccggnnttcntncaanaanggaaagaanangaagcaaccntggaaactcgctctgccaangagcnccnngacaanggttnaaccgggnggcccnnntctgagcttngccgccnttttctgngggncnnccccaagaagtgtttacaccccttaatccccnctttancnctngatttnngggggncccnaacccggatnn

SEQ ID NO: 5762 - DNA, 812 bp, Homo sapiens
  misc_feature 2, 3, 4, 5, 6, 7, 8, 9, 13, 14, 15, 19, 46, 113, 120, 127,157, 166, 185, 197, 201, 219, 223, 224, 227, 248, 249, 250,300, 309, 314, 345, 368, 369, 382, 392, 395, 428, 430, 476,490, 494, 507, 515, 518, 533, 572, 653, 655, 667, 690: n = A,T,C or G
  misc_feature 702, 752, 754, 755, 763, 768, 804, 807: n = A,T,C or G
gnnnnnnnntttnnngctnttgaaaacccctttgtttcaaagaccnagttcttgttctttttgcagggatcccatcgattcgaattcggcacgaggtcacaggtaaaaaaaangtgcgtnataagtnttgttatcggtggactttataaaagcaaangaaattgangtaacttttgattctggtntcaagattcatntttncatacaggtcataactgncttnntgnaaccctttcacagggcactgnnngatgggattaaaggtggcaattactggataactgcacatgcctctacttngttctaaantctangtcatgaggtgatttgatttactttatagangctggattttgaagatctaatgnnaaatgttatgatnatatcagtgngtncaaaaaaagcaccagcaactgataaaaatcgcntntttgtgcgctacccaactggttaaagccaatgtgatcttttatggngaaactcctaaganacangtggttttgctgnaaacttgncanacccttaattatagncggtgctaatgagcctactgcaatataaagccaccattnttttttatcaaacatctgaattcattttacaaaggctattgttagggcattattttgagcatctattttgaggtgatgttnanaaaactttaacntcaaatcaaattgaaaattaatntaaatatattgncttaaggaccttctaaagaatgtgccaccagactttaatggatagttgcnannatccttgnctaanaacaaaaaagttgcttaaacatttcttttacaaganggnttttt

SEQ ID NO: 5763 - DNA, 782 bp, Homo sapiens
  misc_feature 10, 21, 30, 31, 35, 42, 57, 86, 89, 107, 127, 134, 136, 140,142, 143, 144, 148, 155, 161, 162, 164, 166, 170, 180, 190,193, 197, 200, 201, 202, 205, 208, 218, 224, 234, 271, 279,282, 300, 333, 395, 417, 419, 428, 429, 558, 602: n = A,T,C or G
  misc_feature 623, 628, 638, 647, 666, 701, 709, 715, 727, 753, 762, 767,770, 771, 781: n = A,T,C or G
ttctaatgcnaggttctagtnctgttgaanncccngctattngattcggcacgaggncctggctactggggaggctgatgcccganaancatgttggcccaggagtnaaggctgcagtgagctttgnttgcacngntgcnannncatnctggccngcccanngngncccngccacaccanaaattatgtnctnagtntannngcntcngaaggcctantctcgnaccagagttnctcttactggattatttttagattgttattaacattnctggtctntanctttactcagtctggatnagaaaaagaataccatgcaattgttaactattngatgtttactagattaactattaatatattgttgtggtccatatttaagagttactttgttnctagagatttcattatagtggngnttaatatanntttgggtatttttaactaaaaatcattgctatccttcaactgtagattctactatgaaatgaggaaaaatcagcaatagaattaattgggttcaaagtatataaataatgatgtgggaaagggaagtcngagggtatctctggaagaactgatttatctgaaggtaatactgngtgaaagaacctaagattgtngacanagcatgcttnatgcaattntgctggtccatagtagtantagaggctctataaaatgtgttggggtgtttttgncttttaangagacnagtgtctcgctntattggcccaggagtttcaaacctgnagtgccccngtggnttnncacctgtgant

SEQ ID NO: 5764 - DNA, 781 bp, Homo sapiens
  misc_feature 5, 6, 9, 10, 22, 28, 29, 30, 31, 32, 35, 43, 44, 63, 84,90, 94, 119, 120, 122, 123, 136, 139, 147, 166, 172, 182,184, 196, 197, 230, 232, 238, 240, 248, 256, 257, 259, 267,268, 273, 280, 290, 293, 294, 296, 298, 302, 303, 308, 319: n = A,T,C or G
  misc_feature 327, 337, 340, 344, 345, 346, 353, 356, 365, 385, 386, 393,403, 404, 405, 412, 454, 462, 472, 481, 509, 526, 531, 589,591, 616, 621, 626, 628, 631, 655, 673, 674, 682, 704, 705,708, 712, 721, 724, 728, 735, 737, 741, 744, 746, 757: n = A,T,C or G
  misc_feature 760, 763, 771, 775: n = A,T,C or G
agggnnccnntgttctctcctnaactcnnnnntgncagccttnntcgcctaccagaaggggtngggccgcgctgacggcccagntggcgntttntctccattgtgtatatgtacatagnntnnatcactagattgnacnctcctcangggcacgaaccgcaacatntatgcngtgcctgcancncctaatgtgaanngcctggcacactggtagcgtgcatcatgacccntngaatgngngagtaacnacctgccnnancacgatgnnatgcngttcacntcccctgtgnacnncncngcgnngcaantcctgccatangagggcgnagttccaacncgngggnnnactggcncanctgggttgnaccatatcatcccacatccnnaccactngctaacccannntcactgnagattacctgtcagagacctgcgttcgctatctaatattcgngctgaggntcctaggaanatctggaantggggaagattatggagaaaatgaaaanggaaattcggggagggnggttngcagtataaagccctgtgggggaaaacatattttagctcttacttggtaaaaagggtnancagaacctctggtttctttaccaangtccnctggntnggnccatttcttccaattggatgaacnacccctttgggtttttannctcctttnctcaattttggggaattccccnntcnaatnggctttacnatngaantctgggnancttnaanangtcctaaatanaanttncctggggnaatntggtac

SEQ ID NO: 5765 - DNA, 730 bp, Homo sapiens
  misc_feature 29, 84, 177, 179, 202, 213, 239, 266, 296, 301, 311, 367,368, 369, 415, 423, 438, 463, 472, 497, 501, 512, 516, 522,545, 573, 582, 590, 592, 593, 594, 605, 610, 622, 628, 631,641, 645, 650, 661, 666, 671, 680, 691, 696, 701, 702: n = A,T,C or G
  misc_feature 704, 705, 708, 716, 721, 724, 729, 730: n = A,T,C or G
cacgagggctgccagaaactcattgaagnggacgatgaacgcaaacttcgtactttctatgagaagcgtatggccacagaagtngctgctgacgctctgggtgaagaatggaagggttatgtggtccgaatcagtggtgggaacgacaaacaaggtttccccatgaagcagggtgtntngacccatggccgtgtccgcctgntactgagtaangggcattcctgttacagaccaagganaactggagaaagaaagagaaaatcagntcgtggttgcattgtggatgcaaatctgancgttntcaacttggntattgtaaaaaaaggagagaaggatattcctggactgactgatactacagtgcctnnncgcctgggccccaaaagagctagcagaatccgcaaacttttcaatntctctaangaagatgatgtccgncaagtatgttgtaagaaagcccttnataaagaangtaagaaacctatgaccataagccncaanattcagccgtnttgntacttncacgtgtcctgcatcacaaaccngcggcgtatttgctctagaaagaagcancgttccctngaaaaaantnnnggaagaaggcntggangaatattgctanaacttnttnggctaagagnaatngaaangatgcctaaanggaanaagcnccaaggaancaaaattggtnaaagnagacnncnnacnttttcctnttgtngcnaagcnn

SEQ ID NO: 5766 - DNA, 675 bp, Homo sapiens
  misc_feature 2, 4, 5, 7, 8, 9, 10, 11, 12, 13, 14, 15, 16, 17, 19, 20,23, 24, 25, 26, 27, 28, 29, 30, 31, 33, 34, 37, 40, 41,42, 45, 47, 48, 49, 53, 55, 109, 118, 121, 132, 134, 135,139, 145, 148, 149, 152, 153, 160, 164, 166, 170, 172, 173: n = A,T,C or G
  misc_feature 174, 175, 183, 184, 185, 186, 192, 193, 197, 199, 200, 202,212, 214, 219, 229, 233, 241, 250, 256, 265, 266, 268, 270,275, 281, 285, 290, 297, 298, 299, 306, 327, 340, 347, 362,374, 391, 393, 407, 409, 411, 417, 421, 426, 446, 450: n = A,T,C or G
  misc_feature 453, 464, 472, 480, 496, 504, 509, 510, 532, 534, 542, 543,545, 546, 562, 571, 572, 592, 593, 594, 604, 610, 622, 632,637, 644, 645, 647, 648: n = A,T,C or G
gngnngnnnnnnnnnnngnnagnnnnnnnnngnnagnttnnnagngnnntttntnatacagctcttgttctttttgcaggacccatcgattcgaattcggcacgaggcnctcctgacnacngccaagcactntnncggnttccgngtnntcnnttgcagntatngnaaantnnnncattcgtnnnnactggnnatangnntntatgaatacnanatgtnggacttcatnatgntcacaccnatagcatcntatganagaattagnngncncagantttacnacanagtanatgtccnnngtcatgnacgcagatatacacaattctnaaaagtttacctnattcagntgcacgacttggatnaatggactggcnataaggattacatagtnangactgtcacaattntnanagccgntcanacctnccagttcatggagactgatntgcncanagaagcactgngcttgcancggggtcnatgtgcgtctgatatntgaccagnaacgnncaatagcttggtattaaaaccncngcaatgtnngnntgattatgacactacnaatgttgtnnacacttgtacgctacacatnnnctaccttacnaatatntacttgtattgntagagggctntccanagaaatnntnntatataccgaatgcaacacctgctacg

SEQ ID NO: 5767 - DNA, 675 bp, Homo sapiens; identical to SEQ ID NO: 5766
  misc_feature 2, 4, 5, 7, 8, 9, 10, 11, 12, 13, 14, 15, 16, 17, 19, 20,23, 24, 25, 26, 27, 28, 29, 30, 31, 33, 34, 37, 40, 41,42, 45, 47, 48, 49, 53, 55, 109, 118, 121, 132, 134, 135,139, 145, 148, 149, 152, 153, 160, 164, 166, 170, 172, 173: n = A,T,C or G
  misc_feature 174, 175, 183, 184, 185, 186, 192, 193, 197, 199, 200, 202,212, 214, 219, 229, 233, 241, 250, 256, 265, 266, 268, 270,275, 281, 285, 290, 297, 298, 299, 306, 327, 340, 347, 362,374, 391, 393, 407, 409, 411, 417, 421, 426, 446, 450: n = A,T,C or G
  misc_feature 453, 464, 472, 480, 496, 504, 509, 510, 532, 534, 542, 543,545, 546, 562, 571, 572, 592, 593, 594, 604, 610, 622, 632,637, 644, 645, 647, 648: n = A,T,C or G

SEQ ID NO: 5768 - DNA, 750 bp, Homo sapiens
  misc_feature 5, 6, 7, 8, 9, 11, 13, 18, 25, 31, 35, 39, 44, 710, 723,727, 737: n = A,T,C or G
cgggnnnnntncntttcntcctaangaaacncttntgantggcntggctacttgttctttttgcaggcacccatcgattcgattcaaggcctctcgagcctctttaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaattcgcggccgcggcgccaatgcattgggcccggtacccagcttttgttccctttagtgagggttaattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggttttgcgtattgggcgctcttccgcttcctcgctcactgactcgctgcgctcggtcgttcggctgcgcgagcggtatcagctcactcaaangcggtaatacggntatncacagatcanggggataacgcag

SEQ ID NO: 5769 - DNA, 1302 bp, Homo sapiens
  misc_feature 2, 16, 24, 55, 57, 68, 70, 72, 73, 75, 80, 81, 84, 88, 92,94, 96, 97, 98, 106, 111, 123, 129, 130, 133, 135, 137,138, 140, 143, 149, 151, 153, 154, 157, 159, 161, 169, 172,176, 177, 181, 182, 187, 193, 194, 197, 199, 201, 204, 206: n = A,T,C or G
  misc_feature 207, 211, 216, 219, 222, 223, 227, 230, 233, 235, 239, 247,252, 258, 263, 265, 275, 282, 288, 293, 295, 300, 303, 308,309, 310, 312, 317, 321, 326, 332, 338, 339, 343, 349, 355,361, 365, 368, 370, 372, 375, 380, 381, 385, 388, 389: n = A,T,C or G
  misc_feature 390, 391, 396, 397, 399, 406, 414, 425, 426, 431, 434, 443,447, 449, 455, 456, 457, 458, 460, 462, 466, 468, 473, 475,477, 478, 479, 484, 486, 489, 496, 497, 505, 507, 511, 515,516, 517, 520, 523, 524, 527, 530, 531, 536, 542, 543: n = A,T,C or G
  misc_feature 546, 547, 548, 549, 550, 553, 554, 555, 558, 559, 560, 562,564, 571, 575, 576, 577, 579, 581, 583, 584, 586, 587, 593,594, 595, 596, 599, 600, 601, 602, 603, 607, 609, 611, 613,614, 617, 618, 622, 624, 631, 634, 641, 647, 649, 650: n = A,T,C or G
  misc_feature 651, 654, 660, 662, 666, 672, 675, 681, 682, 687, 688, 690,696, 698, 701, 702, 709, 713, 714, 715, 720, 723, 726, 728,729, 732, 735, 740, 741, 747, 786, 789, 796, 798, 803, 810,815, 818, 819, 820, 827, 829, 838, 841, 842, 847, 848: n = A,T,C or G
  misc_feature 854, 858, 859, 865, 867, 869, 877, 887, 888, 889, 891, 892,895, 896, 904, 911, 913, 919, 924, 929, 931, 935, 949, 950,954, 959, 967, 977, 992, 994, 998, 1000, 1002, 1004, 1006,1007, 1010, 1013, 1014, 1016, 1017, 1023, 1026, 1028: n = A,T,C or G
gnccggcgccagtgcngtacccanagcagaacgacccgtaaaaccccttgggaangnccgggacgggncncnngngccgnnccncacncgcncncnnnacaccccnttttncccccattttancaccannatngncnnancangggggngnannacngngnaaaacccnggngagnncccnnccgcngggganncanangngcngnnaagnaaccnggngcnncaancanccngngcgngcccacanacacnggccanaagananacgcaagcgnacgcggncgaagncgggngnacagnaanaaacnnncngcacngcgnaaaangccgcncaacannagcnaagggngaacgngacacngccngancncncgncgganncacngannnncgcannancgcacangagcgganaccacccagcnngccanaangcggcacanacgncncggggnnnncnanccgngncccanangnnnagacncnggnacacccnnccaccccnangccnagannncanaannccnagnnacccnagacannacnnnnngannnccnnncnanccgaggnacannncngnanngnngacccnnnnctnnnnngccnananannccnnacancncccccanccncccgagngaaacncnnnaangaccancncaanacgacnccncgacannacacnngngcccancnaanncaacacnaagnnnaccanacngcncnncgnacnaaacnncacgcncgcggagcccgaaccaacgcacgacacgcgacgaccgancancaagaangngaccncacacgnagcgnccnnncgcgcgnancgccggacncanngacannccgaanaganncgcggnangngcacgaancaacggccannngnnganngaggagcnacaaccncnacggangcgangccgnanagangacggaccaagacnngaanaccgncgaggccnaacaaacggncgacgcccgcggaancncacnancncngnnggncanncnngacccnganancacacancgcncaccacangnnngnggaacacgacaangccacgnacanaacgacgaagcangaacanagnngncgcaanngnnancnagnnnggaanacacacncgaaccgaacacanacgaagnaanaccaagagcannagnagaagcnnacacagacacnaaacngnaaccggcccnnagnancccancgcncnngcancagngcacaanaanncgganncccacgccaaaacngcnacagnncgcaacgnangncncnacgccanacgcc

SEQ ID NO: 5770 - DNA, 818 bp, Homo sapiens
  misc_feature 3, 4, 7, 8, 22, 28, 86, 150, 159, 223, 225, 249, 253, 291,304, 308, 310, 312, 317, 337, 344, 347, 363, 369, 376, 381,383, 387, 388, 391, 410, 411, 412, 417, 419, 425, 428, 443,447, 448, 462, 470, 480, 488, 494, 508, 510, 525, 534: n = A,T,C or G
  misc_feature 550, 551, 554, 555, 558, 564, 567, 574, 576, 584, 586, 596,597, 602, 605, 607, 611, 614, 618, 620, 623, 628, 630, 632,642, 644, 653, 660, 672, 676, 685, 687, 692, 693, 694, 695,698, 700, 706, 707, 710, 714, 718, 719, 721, 728, 736: n = A,T,C or G
  misc_feature 738, 741, 749, 750, 756, 758, 759, 769, 771, 773, 774, 775,776, 788, 789, 791, 792, 801, 805, 809, 810, 813, 818: n = A,T,C or G
tgnnggnntagatcagctcttntctttntgcaggatccctcgattcgaattcggcacgaggctatttgtgttttgttgcactgttntttttgtttgtttgtttgtttatttggttggctttttggagagggaaatgggggtgaaatattnctttattgntgaatcattttgtgaatgtccccctcaaaaaaagctaatggaatatttggcataaagggcattngntggttctatttttgtttgaggggnattntcagaaaatcccttttctctcttacgcctaactgactngggaaccattgangatntncntagcnttggaatacttgacattatntactctnacnaataacacattaagcnagaatnaccaatnttccnanaatnngcncttgatcacaaaatgtgannnacctntnaatgtntanaactttatcaaattnagtnntattttccccttcnaaatgtcnccctttcccnggcatttncttccnttaaaatattggtnanttccctgacataccnatttccatngttcaacagctttgtnnccnnagntataanaantttttgnanccctggananattttcaatnncgccnatnangtanccnttcnancantgttngngnaaaacccccntngcaagcccntaaaaangttaagccttanttgnctttaattncnctttnnnngcntnactaannccncatnttcnnanttccttnaaaaatcntnttnggagcccnncccttntnnttacctttgnantnnnncccaaacttcanngnntatccaatnctgntttnnccnaaacn

SEQ ID NO: 5771 - DNA, 742 bp, Homo sapiens
  misc_feature 6, 101, 173, 180, 292, 313, 352, 407, 444, 451, 452, 455,457, 476, 514, 517, 521, 523, 533, 534, 543, 562, 569, 572,586, 589, 594, 596, 597, 598, 599, 602, 606, 622, 623, 627,629, 636, 645, 648, 655, 663, 666, 679, 680, 681, 682: n = A,T,C or G
  misc_feature 686, 691, 703, 709, 714, 720, 721, 722, 724, 727, 734, 740,741, 742: n = A,T,C or G
atcagntcttgttctttttgcaggatcccatcgattcgaattcggcacgagggtgactgtggagggcgagctgagccctggccgccgtcacaatgggccgngagtttgggaatctgacgcggatgcggcatgtgatcagctacagcttgtcaccgtcgagcagcgcgcctatnccacgtnttcactaaaggaatccccaatgttctgcgccgcattcgggagtctttctttcgcgtggtgccgcagtttgtagtgttttatcttatctacacatgggggactgaagagttcnagagatccaagaggaagaatncagctgcctatgaaaatgacaaatgagcaacgcatccgnatgacggttccctgtctctgaaagacctttctctggaagaggagtctgcattgtntgtctcaaagacacaataaacttcctatggtctgcanaacacannatntnttaaaaatttaaaaattanctgggcatggtggcaggtgcctgtattccactactcangangctnangccgaaatcnntagaacccnggacgttgaagtttcagtnagctgantcnttccactggacttnaanctgancnnnngantgtnactccatcccaaattnnaaanangtgggantattacttntcntgaaacntgcgcctntangccaattcttaannnnttangtggnaagaacatttancccagnatttnaggttnnntnacnatgctgngggggnnn

SEQ ID NO: 5772 - DNA, 760 bp, Homo sapiens
  misc_feature 28, 37, 43, 47, 48, 50, 52, 53, 54, 62, 63, 65, 68, 70, 77,84, 85, 89, 91, 93, 99, 102, 106, 129, 149, 150, 247, 397,467, 506, 578, 614, 681, 723, 733, 746, 759, 760: n = A,T,C or G
aaccgggtgggccccttttttgaaaggntttttttancccttngttnncncnnnctaaatanngnggntncatcgcntcgctanngccngntntgggangcnatgntatacttggctaccttcctatgntccttctcacagcaaaactnngggactgatcatttgaagtcacccctctgtgtcttcttgtgaaatggcttgggcgtctctgggctctgacttgctcatctgggaagagatggggtanagggagttggattataaatcatgcttcactcagtcaacagaatgctactcaggcactaaaaatgatggcgtagccctacgtattctgacatgggaagatggccacaatatcttattatgtggaaaaaactagttgcataggatttatggnttgattacattttagtaaaataaattcatttatggtggtatatgcaaagaaaaaataatgccgggcgcantggctcacgcctgtaatcccagcactttgggaggctgangcaggtggatcacttgaggccaggaggttgagaccagcctggccaacatggtaaaaccccatttccattaanaatacaaaaaattagcaccaagcgttggtgggcacngtgcctgtagtcccagcttactcaggaggctgagatgggagacttgcttgaacctggaaaggtggangttgcggtggagcccaagatcacgccactgcacttcggcctngggctacagnccagactctgtcntcaaaaaaaaaann

SEQ ID NO: 5773 - DNA, 887 bp, Homo sapiens
  misc_feature 2, 4, 8, 10, 11, 16, 17, 21, 25, 26, 27, 28, 30, 33, 43,49, 54, 59, 66, 67, 72, 80, 83, 86, 91, 105, 121, 125, 154,161, 175, 178, 181, 190, 219, 220, 242, 245, 254, 262, 284,287, 302, 319, 327, 333, 419, 474, 478, 514, 535, 536: n = A,T,C or G
  misc_feature 537, 538, 545, 548, 579, 593, 594, 595, 600, 608, 610, 611,612, 614, 620, 626, 631, 636, 642, 658, 659, 664, 666, 667,668, 674, 678, 686, 696, 700, 715, 721, 726, 727, 738, 756,757, 760, 766, 767, 777, 780, 782, 786, 797, 807, 832: n = A,T,C or G
  misc_feature 835, 841, 845, 849, 853, 854, 862, 876, 877, 881: n = A,T,C or G
gngnaggnannatttnnaganagcnnnngnaangtttggggtnaagagncattnaaacncttggcnncaggnatcccaangtngcnaattnggcacgaggttgtnttggaaacagtcgtgnggangaattgcgagagaacctaaacgggatctnctgtggnttgctctggatganatnganttggctaanggtagaggaacatttccctgggatatttnngcccttgatattcatcaagatntanactggaatnctaacgcncctaccctgaatgtctggcctntgnatatctgtgatgatngtgcggacatatttcancgggatanaacagncgaattaatggaattgacagatgagcaaagaaatgaactgatgaaaaaagaaagcagtcgactccagaagactggacatcgtgtancatactcacctcgtaaagagaaagcactaaaaatatatctggatggagcaccaantaangatcctgctcaagactgactctgatagttgtagcanttttcccttggggggaagttnnnngtttttnaanaaggatgggttccactacccacttggggaangttgcccattttcnnnccggnaccaatgngnnngnggggtnaacccncaggngaacnaaccantcgccttggaatgggnnacctngnnnccttancaancctcttcnagaaagggcnttcnagtgggcccccaaanaggggncccanntgggtcccatngaacttggggaaatccannggntttgannccacccaatnagngncaanaaatggtcccngggaaaaatntggtcaataagggggattgaggccntanatcaantttncctnggcnncccaaccntaaaaaaaggcttnnccgngatccc

SEQ ID NO: 5774 - DNA, 804 bp, Homo sapiens
  misc_feature 3, 9, 16, 17, 24, 31, 32, 33, 38, 607, 646, 657, 708, 730,742: n = A,T,C or G
tcncccccntttgaannccctttntttaatnnncatanagctacttgttctttttgcagggatcccatcgattcgaattcggcacgaggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggaagcaatatccaaggcagtgtcatctgcaacaatgctgtgatcgagaagggtgcagacatcaaggactgcttgattggaaagtggccagaggattgaagccaaagctaaacgagtgaatgaggtgatcgtggggaatgaccanctcatggagatctgagttctgagcaagtcagactccttncttttggcctncaaagccacagatgttgggccggcccacctgtttaactctgtatttatttnccaataaagaaggctttcaaangcatgcttgganacttgtggagcagtccaaacttcatgtcaggtgggcttccagtgtacacaaaaaaaaaaaaa

SEQ ID NO: 5775 - DNA, 887 bp, Homo sapiens; identical to SEQ ID NO: 5773
  misc_feature 2, 4, 8, 10, 11, 16, 17, 21, 25, 26, 27, 28, 30, 33, 43,49, 54, 59, 66, 67, 72, 80, 83, 86, 91, 105, 121, 125, 154,161, 175, 178, 181, 190, 219, 220, 242, 245, 254, 262, 284,287, 302, 319, 327, 333, 419, 474, 478, 514, 535, 536: n = A,T,C or G
  misc_feature 537, 538, 545, 548, 579, 593, 594, 595, 600, 608, 610, 611,612, 614, 620, 626, 631, 636, 642, 658, 659, 664, 666, 667,668, 674, 678, 686, 696, 700, 715, 721, 726, 727, 738, 756,757, 760, 766, 767, 777, 780, 782, 786, 797, 807, 832: n = A,T,C or G
  misc_feature 835, 841, 845, 849, 853, 854, 862, 876, 877, 881: n = A,T,C or G

SEQ ID NO: 5776 - DNA, 807 bp, Homo sapiens
  misc_feature 1, 2, 3, 4, 5, 6, 7, 9, 10, 11, 12, 13, 14, 15, 16, 18, 19,20, 21, 22, 23, 24, 26, 27, 28, 29, 30, 31, 32, 33, 34,35, 36, 37, 38, 39, 40, 41, 42, 43, 46, 47, 48, 49, 51,52, 53, 54, 55, 56, 58, 59, 71, 83, 103, 106, 111, 115,123: n = A,T,C or G
  misc_feature 124, 127, 135, 140, 141, 147, 152, 153, 159, 167, 178, 182,183, 185, 186, 190, 215, 217, 241, 260, 261, 262, 268, 292,302, 322, 323, 349, 353, 366, 402, 403, 404, 405, 413, 415,416, 417, 419, 422, 452, 462, 463, 471, 481, 482, 488: n = A,T,C or G
  misc_feature 490, 503, 504, 508, 511, 513, 522, 523, 530, 542, 546, 556,560, 561, 569, 573, 577, 579, 582, 590, 595, 597, 607, 608,625, 628, 632, 642, 649, 652, 653, 654, 655, 658, 659, 660,661, 665, 671, 675, 676, 680, 684, 691, 693, 695, 696: n = A,T,C or G
  misc_feature 697, 698, 715, 716, 720, 724, 726, 739, 741, 742, 745, 750,755, 756, 757, 758, 763, 776, 779, 792, 793, 797, 804, 805,806: n = A,T,C or G
nnnnnnnannnnnnnngnnnnnnnannnnnnnnnnnnnnnnnnccnnnnannnnnnannagttgaacgcangaaagccgtggnaaggcgggaaccaaccgaancgnggaanggcnataacaannagnggatgtgnccagnnctctgnatctnngacttngatgctanatacatcatgncatnngnngctnctaagggaataagccatagaggctncnccaggtagaaaagaacagtaaagnacctggaaaaccaacattnnngaatgnatggacactggacatgagatatgnacaatgaaancttaaaagaatctaagaatnngccctctttgccccactccacccagnaatnagacattactagngccatgtataggacccaactgagtattagaatcagnnnngactatgncnnngnatngcctaaatctgttaatgcataaaccgaatnagggtccagnnggcctgtnaatggtaaanntacatnanaaatgactcagcnngagnatncngggcgagtnngcaatgngataatcagatngggnaaaactgatnaatnngcaaactngagngggngnacncacagacnaaagnangaaccacagnnaactagggggaccaggnggnaagnggaaaacacncacaagngannnnggnnnngggnaagggngggnngaangganggaaaangngnnnnaggagggaagcaaaacnnaaangggncnggaaccaaagccngnncgnaaagnaaaannnngggcnggaagaagggggnggnaaccgcaaaccanngccnagggggnnnc

SEQ ID NO: 5777 - DNA, 925 bp, Homo sapiens
  misc_feature 3, 13, 16, 32, 34, 39, 57, 66, 104, 107, 116, 123, 144, 148,160, 175, 179, 187, 193, 195, 196, 203, 204, 219, 221, 225,227, 228, 229, 235, 238, 245, 251, 253, 257, 259, 266, 277,301, 303, 308, 314, 317, 324, 332, 333, 342, 343: n = A,T,C or G
  misc_feature 347, 352, 355, 366, 369, 374, 382, 386, 390, 393, 396, 398,400, 404, 406, 407, 409, 413, 415, 417, 418, 419, 422, 428,436, 451, 459, 460, 472, 474, 476, 477, 484, 486, 489, 490,497, 504, 508, 509, 511, 517, 518, 519, 520, 523, 527: n = A,T,C or G
  misc_feature 534, 543, 545, 547, 548, 553, 558, 559, 571, 573, 577, 579,580, 581, 587, 590, 592, 594, 597, 598, 604, 605, 611, 612,615, 616, 618, 619, 620, 623, 627, 628, 642, 644, 645, 656,659, 664, 665, 679, 682, 683, 686, 691, 707, 710, 714: n = A,T,C or G
  misc_feature 717, 721, 723, 724, 725, 738, 740, 741, 745, 750, 753, 755,762, 781, 786, 787, 789, 803, 804, 808, 809, 811, 812, 813,814, 820, 825, 828, 833, 837, 839, 840, 841, 842, 844, 848,850, 852, 853, 857, 860, 866, 869, 871, 873, 875, 878: n = A,T,C or G
  misc_feature 892, 893, 895, 900, 903, 904, 905, 907, 909, 910, 911, 914,915, 916, 921, 922: n = A,T,C or G
cgngctttaactnttnaaaccctttgcacttncnctttntgcaggatcccatccgantcgaattcngcacgagagagggtggggtctggccacataggtttttntgnggctctggnctggggntagacactgacagggactagnattnattggacttgcnaagacagtccctcanattnagcaactncttgcntnntatggtnngcattatgaagccancntagngnnngtaaantanagccctncatctntnctgngnagccccntcactgggctngatgtcatcatccaaaatctgcanantctgncacaanganccatgantacttaannaaagggaanntctngaacnggntagcaagatcnaancatancttgctgngctnccanggnacncnancctnanncnctgncnannngcnatatanacggtcanggggctttgatccangaactctnntgtactatgatnanannccacaantntgnnaaacctncatgtancctnnanagttgnnnntgngcanaatcgtnctcaccaanantnntcccnccgannaactctaacttntnattnannnctaccngtnantnttnnaatgtnnacaacnnctnnannnccntccnnattctaaggaaaangnntctacccctantanatagnntcagcatccactanacnnctntgctngcctccgatcccactngcncgcnctntgtntnnngactgcccccctngnncttnctctngananattcttnggatactacccaaatattntgggnnanctactgcacatctnntcanntnnnncgcatntcatnatntatantcancnnnncnaatncncnngctnctncttacnaanantncncantcgcggcggggcgnncncatantannncngnnncannnaaagnngcg

SEQ ID NO: 5778 - DNA, 1025 bp, Homo sapiens
  misc_feature 4, 10, 17, 22, 23, 24, 25, 31, 40, 44, 46, 49, 52, 54, 56,57, 97, 99, 104, 126, 144, 190, 222, 263, 273, 275, 280,290, 296, 307, 315, 329, 342, 361, 375, 382, 385, 390, 396,398, 401, 407, 413, 423, 426, 439, 442, 449, 460, 461: n = A,T,C or G
  misc_feature 467, 470, 477, 479, 483, 502, 509, 526, 528, 536, 542, 546,547, 548, 557, 563, 571, 582, 585, 587, 588, 590, 597, 598,604, 608, 615, 618, 620, 623, 627, 637, 641, 643, 649, 650,656, 664, 667, 669, 675, 679, 685, 686, 687, 695, 696: n = A,T,C or G
  misc_feature 699, 702, 707, 712, 715, 736, 763, 771, 785, 792, 798, 799,807, 818, 819, 821, 827, 829, 839, 844, 847, 851, 864, 878,885, 887, 890, 891, 895, 897, 908, 911, 915, 916, 917, 933,936, 938, 948, 950, 954, 956, 957, 965, 967, 969, 972: n = A,T,C or G
  misc_feature 978, 981, 985, 987, 993, 998, 999, 1000, 1015, 1018, 1020,1022: n = A,T,C or G
gttntcattnactttcntaatnnnntgggantctctgaangacncnatngantngnnttcggcacgagtactgctccttcattcccaagtaagaaangncaggntctgctacttccaaaactcagncacgacttgaaggtgaantgactcctaattccttgtcaaccagctacaagacagtgacatctgncattaagctctccaaacataaagctgaatctnactagccctaaaaggggtcagaatagataagaaaggtgganagaagttgtncnaaggncatagaaatngtctgntccagcctcantggtgtcnaggataatggcgangaggaggatgcancattcacttgcaataccangatgtttactggancccatanttnatgtnggattnanacnaataangataangaaatgggcnaangaagaattggatncancaattanagggggtcggnncaatgnaantcatacnangcantattgctaattttcaaacnttaattncaaatgcaacattcatntnctaggatncctggntttnnngtaaacttnggtaanaaactttnggattttcctnaanannanttcaatnnttcatnatancatcccnttngnacnaggntactcctaanaatncnaatttnnattgcnctaaaccnttntnctcaantctnggggannntaatgggnntcnccntatantagtnatntgaatttttctaagatcacanaaaaaaatgggccatttgtctcacatntatatggnggatggcctctccntaaaacntccttnntggggtanaataccttttnncncacaangngcttacatcnctaantcntctnttgttatatactnatacacagtatttnctctaananctnnccgngnttctaacattntcnaaannnctctttaaaaattctntgnanaaaattcgtngnctcncnntatcatcncnanttnataatnctngtantnattctnttcannnacaaaatacgcctcncgntngntcc

SEQ ID NO: 5779 - DNA, 750 bp, Homo sapiens
  misc_feature 2, 6, 8, 9, 10, 11, 16, 17, 22, 693, 750: n = A,T,C or G
antgangnnnntttcnnagagncagctcttgttctttttgcagggatcccatcgattcgctgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattggtgcatccctacttcttcagtcaggtttttttgtgcttacaatttgtgataactgtgaataactgcttaaaaattcacccaaatgggangctgaattttttcttcagccaaaagtaagttttgattaggaactttggttcaacccn

SEQ ID NO: 5780 - DNA, 1500 bp, Homo sapiens
  misc_feature 24, 26, 47, 56, 64, 72, 74, 79, 84, 86, 87, 89, 90, 92, 95,96, 102, 103, 107, 116, 121, 145, 153, 156, 157, 167, 170,172, 175, 176, 182, 188, 190, 192, 196, 197, 202, 208, 210,211, 217, 222, 223, 224, 227, 228, 229, 230, 237, 240: n = A,T,C or G
  misc_feature 245, 246, 248, 251, 252, 257, 264, 266, 269, 277, 278, 279,282, 285, 291, 292, 297, 299, 306, 312, 316, 318, 320, 323,324, 328, 337, 345, 347, 348, 349, 350, 352, 353, 354, 357,374, 377, 383, 384, 385, 391, 393, 395, 404, 407, 408: n = A,T,C or G
  misc_feature 414, 419, 423, 427, 429, 431, 434, 440, 447, 449, 457, 459,461, 464, 472, 474, 485, 493, 494, 495, 503, 504, 506, 515,520, 532, 534, 535, 538, 542, 548, 550, 554, 558, 559, 560,564, 565, 566, 570, 576, 577, 579, 580, 581, 584, 587: n = A,T,C or G
  misc_feature 588, 592, 593, 595, 598, 601, 602, 607, 609, 615, 616, 619,623, 628, 632, 637, 645, 646, 648, 653, 654, 657, 662, 666,668, 669, 675, 680, 681, 688, 689, 691, 693, 696, 700, 706,707, 710, 717, 720, 722, 726, 730, 733, 736, 737, 738: n = A,T,C or G
  misc_feature 744, 745, 747, 749, 750, 752, 758, 763, 765, 766, 769, 771,782, 787, 788, 797, 808, 810, 813, 816, 819, 824, 834, 843,850, 852, 854, 856, 857, 858, 866, 870, 879, 880, 881, 886,888, 891, 893, 895, 901, 907, 914, 916, 919, 920, 925: n = A,T,C or G
  misc_feature 932, 933, 934, 940, 941, 943, 945, 947, 950, 952, 971, 973,982, 995, 999, 1007, 1010, 1014, 1021, 1023, 1024, 1026,1028, 1029, 1033, 1037, 1039, 1048, 1050, 1056, 1058, 1060,1061, 1063, 1065, 1071, 1072, 1073, 1077, 1079, 1084: n = A,T,C or G
cgcccttgtccaaaacggccttgngncccaaatcagtcttggaaaancctcaaatnctctctanacagaatngnggctnggggnanncnncnttnncatggnncggntttatctcnactcnttttttatgaggctctttttttcnatctctangannccttctaacnggnantanncactcncggggngnanctcnnttcgngggggntnnactaantcaannntgnnnntctatanatntttanntnctnnacatnccactcntntantcctctgnnnatnccnaacatnnatacncntcacccntttacnctancncncannacanatctatctnatcactcngnnnncnnnaantcggccacataatcatnctnctcacnnntactantncntcattctcnacnntctctnttctntacnatantntntanctcctntttctcntnttcctctncncncanttctctancnctgcctaatanacttactnnntctcctcnntncacaagtcngtacntccgtctccctntnnatnacanactatntnctcntatnnnacannncttncatatnntnnnatnttnnaccnntncantcnnttacntntccctnncantagntctantctnctacnttactctnntnatctnnctnttcanctantnntcacanttcanntcctatnntngnccntctnattcanntcntcttatntcngnacantctnacncannntctccnncntnntntcatanctctntnnacntntaacctactantcttnnactctcgtnctacctactcncnctntantgntactntacctcctantaatctatnctctctngntntnnnacctcacnactnctctatacnnncgatnanagntntnacaatntctcgntagttanangtnncgcgncctaccnnnataccnntntncnttnanactactctctctctctaancnctctgctcntatactatactcnatcnatatgttnatncatntctctcncnntnanncgtngttntntaccctctntntatctntncnncngntcaacnnncttntnacatnncnttnacncatatnnatnccgntaatctacatncngctctnctctntncctcacatacgctccncnnantcatcttctnatattnaatgacacntatntcatnntacgtnttntgntantttaatcnctttccataatctactctcttatnctannngctctcnncnatanctatnctcnatatnntaactctcnnnnncactacngatcctaatgtnttntctnncnntnantgatatctanaatnnanntcttttncnataaactnnangcctctctaatncgacagtctnctctanatantanganaccaanatccatacctntnntctttnanatactntcnattgactaactncttnntataantacgtatcnatnccanatatcttgcntctctntttcncncccccgc

SEQ ID NO: 5781 - DNA, 812 bp, Homo sapiens
  misc_feature 6, 35, 40, 45, 210, 490, 515, 518, 526, 550, 559, 561, 563,571, 573, 574, 580, 583, 591, 601, 609, 612, 616, 618, 628,629, 634, 635, 636, 643, 644, 652, 655, 656, 657, 658, 660,663, 687, 695, 701, 706, 711, 712, 715, 719, 720, 721: n = A,T,C or G
  misc_feature 725, 727, 732, 733, 738, 740, 741, 750, 753, 754, 756, 760,761, 762, 765, 769, 773, 774, 782, 783, 785, 789, 795, 798,799, 804, 812: n = A,T,C or G
ttgtanctaatgctggttggtcgttctttctccangaccnagcgnttcgaattcggcacgaggggaaggtctggctccagcttgagcccactcacaggatgtcagggggaagtgtgactaaggtcacggccacgccacgtggtgggccagctggatccagagcaggggccgttgtggccacacatcctgagtttccatggtctaatgcantgggcttgaaaaaaaagggtggatgcaggatgctggctgggactgtggagtgcgtgggcagtaagtcttaagtgacagtgggtggagattacagcatttcatctgcttttcctttgacaccttttaaagatacaacccacagttttcaagggtttatgccaatgtctgctagagggatcttgcagtagatcttaaaccctatagtattcttaagagcacaaggaaattcttatttgggttccatttacaacaaaggtggaaatttaaaactaggcttganatttgaaatgctggtcacatttaancantttatttngggggggtaattttttggaaatcngtctttaantnanttttaaananngttttnccncatttttnaaaaaggggntacctttncantttngntcctttcaannttttnnnttttggnnaaaaaatnttnnnngnttnaaatggaatgtttttaaccagggntttggggntttttnaaaanttttnnaangggnnntatntntgggnnccttntnnaattccagnttnntnccannnttngaantttnncccccttnntngggnaaaaanggnnattgntttttttn

SEQ ID NO: 5782 - DNA, 783 bp, Homo sapiens
  misc_feature 28, 610, 741: n = A,T,C or G
ttgaaaccctttgaaacctttttgcaanctacttgttctttttgcaggatcccatcgattcgcaaatacctaatgcatgtggggcttaaaacctagatgacgggtagataagtgcagcaaaccaccatggcacatgtataccagaaacttcacattctgttcatgtatcccagaatttaaagtaaaatttaaaaaaagaaacgtactggaaaatctgaatagaccctctgctggaagcattatgaaaagtaaataaatggatatactgcatcatcctcagaaaaaataaaaaagaaagaaaatgcctgcccccttctgcccacaaaacagattaagcaggggctcattgttggtgtcagaagagttgagtgtaatacactgatggtatgcacttgattttagaaatatcttactggtgacatttctgaaaatttgccaactcataattttaagaatttcaaaatgtaagtttttatttaattgcatttgaattctactaattgcatgtaattttttattactaattcagaactaagaatataggccttaaattcctcctaaattaatgtgaggcatttttcctaattcattgtcacgaattattatgaangtcatctgctgtattacagcagtccatactcgattgttccttctgtgtcttcagataggttctttttcttttcctgtgagtatgtaaaacagcaaaccaagtagatgggcttattttggtacatccatacngaggaattttatgggcttattaaaaggatgcttacaggagat

SEQ ID NO: 5783 - DNA, 1150 bp, Homo sapiens
  misc_feature 2, 8, 9, 10, 14, 15, 16, 26, 33, 39, 45, 48, 53, 71, 100,101, 113, 168, 217, 235, 253, 268, 271, 278, 301, 332, 359,379, 391, 399, 403, 406, 441, 442, 458, 481, 483, 484, 487,496, 512, 513, 519, 526, 527, 534, 541, 545, 549, 551: n = A,T,C or G
  misc_feature 554, 561, 578, 581, 582, 596, 598, 600, 602, 603, 608, 609,612, 617, 622, 629, 634, 635, 636, 653, 654, 663, 671, 673,676, 680, 690, 694, 712, 713, 716, 718, 727, 729, 740, 746,752, 754, 758, 760, 762, 768, 773, 777, 780, 783, 786: n = A,T,C or G
  misc_feature 788, 789, 805, 806, 808, 815, 818, 823, 824, 826, 827, 831,832, 834, 836, 840, 841, 843, 847, 848, 851, 852, 864, 875,877, 886, 894, 906, 929, 930, 933, 938, 944, 947, 951, 952,955, 956, 958, 960, 962, 977, 984, 985, 995, 996, 1001: n = A,T,C or G
  misc_feature 1014, 1018, 1020, 1024, 1029, 1030, 1046, 1050, 1051, 1062,1065, 1067, 1072, 1074, 1075, 1078, 1082, 1094, 1098, 1111,1116, 1118, 1119, 1133, 1137, 1138: n = A,T,C or G
tnccgttnnnattnnntgtgaacccnttcttcncacctncctggntgngaatnctgcacgagaggcattgnctgccttcggctttatttctgctgactanntatctcctattnagagctacggcaatgcccaaaagaaaggctgcaggtcaaggtgatatgaggcatngagccaaagagaagatctgccaggttgtctgctatgcttgtgccagttncaccagaagtgaagcctnaaaagaacatcaagttcnaggaaaatgaagacnaanagtgatntgatggaagaaaacatagattcnagtgcccaagccagttgctgaaacccaagcnagaagcaagttgttgaagaagactacnatgaaaaatgctaaaaaatnggagaaagcccnaaatttcnagangcncccagctttcttgaaaaaaagaaattgttgggaanntttaaaaggaatgaanaattatttgaacgattgcccccnannaanaagggggtngggatgaattaggaannggaaancccgttnnccatgcngcgaaantttnaaananatnggtatcnaacgaattgcattctcnaannggaaagttttgcantnanannattcnntanaccgnaaatnatcaaanggggnnngaaagccctttggtaannaatgtatgngtcccttntnggnttgnaaaaaaaaangggngggggaaatagtaaagtnnttngngtaaaatangntaggggatttntcaacnaatttngngganananattggnagggnaaanaanggngcncnnataactaaattgcccnnantatggtnaancttanntnntgtnntngnatanngngggnnacnntatatttaaaanggggcgtgcgnanattgaaccngggggtanaaaatatggggnaaaaaatttgggggaatataaanntantttgngtatanaanatcnnttnntnananaggggggtcttatangggattnngatatcaatnntattnatggtgcaatgtntaanancacnctcgnnaaaaatcgggttaaanaccnnagggtcatganatntngtggnannatncagntggttaaatttngtanatatattttgggngtaananngtcttgcttaaatngggnntaggtcatttcc

SEQ ID NO: 5784 - DNA, 991 bp, Homo sapiens
  misc_feature 3, 4, 5, 10, 11, 13, 15, 21, 25, 30, 32, 33, 36, 37, 42,43, 68, 73, 74, 83, 84, 87, 88, 100, 104, 110, 111, 119,127, 128, 141, 143, 146, 150, 151, 152, 155, 157, 160, 163,166, 170, 172, 176, 178, 182, 184, 197, 208, 214, 220, 226: n = A,T,C or G
  misc_feature 227, 228, 233, 245, 248, 269, 273, 279, 281, 283, 300, 310,313, 323, 329, 336, 342, 346, 359, 367, 371, 380, 383, 390,394, 401, 414, 428, 437, 440, 441, 442, 451, 454, 466, 468,472, 474, 485, 489, 497, 504, 524, 528, 529, 531, 538: n = A,T,C or G
  misc_feature 539, 544, 563, 595, 613, 615, 620, 624, 625, 639, 642, 643,646, 654, 665, 672, 674, 676, 689, 696, 701, 703, 705, 712,717, 721, 740, 741, 745, 750, 754, 758, 761, 762, 764, 774,785, 802, 804, 807, 811, 814, 833, 848, 849, 855, 863: n = A,T,C or G
  misc_feature 864, 866, 868, 871, 872, 878, 884, 885, 886, 894, 900, 901,913, 917, 918, 921, 925, 929, 936, 937, 940, 942, 948, 957,962, 963, 966, 967, 969, 972, 983: n = A,T,C or G
ggnnngccgnnancnggaccntcancgatntnnacnntttgnnaaccccccccccgagcgcgggcggngagcnngtgatattnngannagatggaaacanctcnagttgnngccttttntgtcaccnnagtgcgagggggngnatnggtnnnaananacntcnctnccangncctncnttanancacccatctaaancacaaaattcntgaagnggccgntcagtnnnggcanacccggcctccnagntatgtataccctgtctgttcntatngggatntntnctccatgtgagatatangatgcgtgcnatncgtaaaaggnggtgcnagtgctncttgtnaggncccgacacattangcgcttantccnttaattagnganccttgcntcangggaaangggcttttctatngaatggggaataanataatgggntannnctttttttnaanctcccgagctcnantaangntgcttaatggngcanctacaatnctccganacttccaatgtgggttgtcnatanncnacccttnnattgncggggtggtccaaaagaantgcaaattcctacctcttgggcccatccaaangacccctttcaaccatgncnctttntcgnncggggagagaaacnatnnccnggggggtnaaaaggcctcnccccccntntnttttcaccccaanagggggnaatananangttctanctccntatnccttttccaagcctatttnngttnggggngggngttngcnntntctccaatangcccccaaagnattttcatttgtttaananttncccnacnttccttgatttttaaaaanataaaaatgttcctnntaagangaaagggnngnanttnntaaacnaaagcnnnaagaaagnagaaanncctttttagaantttnntanactnttcncaaatgnnganantacctnattcggggntggtnnctnntnatnttggttacgantggctggc

SEQ ID NO: 5785 - DNA, 1075 bp, Homo sapiens
  misc_feature 2, 3, 4, 9, 14, 15, 22, 23, 28, 34, 38, 40, 101, 198, 200,209, 222, 233, 283, 294, 303, 304, 314, 315, 316, 329, 346,347, 348, 400, 430, 433, 436, 440, 448, 458, 467, 470, 472,525, 531, 537, 568, 579, 583, 631, 638, 642, 643, 645: n = A,T,C or G
  misc_feature 651, 667, 669, 677, 682, 685, 693, 695, 698, 704, 712, 726,727, 728, 729, 730, 734, 742, 745, 756, 766, 767, 778, 781,782, 795, 815, 818, 820, 821, 822, 826, 829, 831, 837, 842,856, 860, 862, 863, 864, 865, 866, 868, 869, 871, 872: n = A,T,C or G
  misc_feature 875, 876, 877, 878, 879, 881, 882, 883, 884, 888, 889, 890,893, 894, 896, 898, 901, 902, 903, 904, 907, 908, 913, 914,916, 918, 920, 923, 924, 925, 926, 928, 929, 930, 931, 934,935, 937, 938, 939, 940, 942, 944, 948, 949, 951, 954: n = A,T,C or G
  misc_feature 956, 957, 958, 959, 960, 961, 962, 963, 966, 969, 973, 975,976, 977, 979, 981, 982, 983, 984, 985, 988, 990, 992, 993,995, 996, 997, 1000, 1001, 1002, 1004, 1005, 1008, 1010,1011, 1017, 1019, 1020, 1021, 1024, 1028, 1029, 1031: n = A,T,C or G
  misc_feature 1032, 1034, 1036, 1038, 1039, 1040, 1041, 1042, 1043, 1044,1045, 1046, 1048, 1049, 1051, 1052, 1054, 1055, 1056, 1058,1059, 1060, 1061, 1062, 1063, 1065, 1066, 1067, 1070, 1072: n = A,T,C or G
cnnncttcncctcnntgaaccnntttgnaaaccncccntnatgcaggatcccatcgattcgaattcggcacgagggctgctggagctggcaaggtcaccantttttgcccagaaagctcagaaggctaaatgaatattatccctaatacctgccaccccactcttaatcagtggtggaagaacggtctcagaactggntngtttcaatnggccatttaagtntagtagtaaangactgggttaatgataacaatgcatcgtaaaaccttcagaaggaaagganaaatgtttggnggaccactnnggttttcttnnntgcgtgtgggcanctataaagggattagtnnncaaaaatcagtacctttttaatgggaaaacaacttgacccaaaaaattttgntccacaagaaaattttggaggaccccattnaanaangagnttaaaatngaggaaaaanaaaaaacgngcntnagagaaaacttccggaggcccctcttaagaacctaattaggtggaggatccgnaatttnaccggncgggaatccccaagaaccaatgggaataaangggattacccntttnggattggaagccttttggggacccaaaaacccaaccaaaccttaaggnaaatggnccanntnggaaanaaaaaaaaatggcccntncaaatttnggggnggnaaaaattnanggnggaatngcctaatngggcctttgaaatnnnnngggnaaccccanttnattaaaggccngggcaaagtnnaaacccaaggnttnngacccaaaccaancccaaattgggcaatttccnatntnnnaaanggntnctccanggggnttccaacggggcgnaaangnnnnncnncnnacnnnnntnnnncaannnacnncnancgnnnnctnntacannantnanaannnntnnnnccnncnnnncncnccannanccncnnnnnnnncanacncganannncncnnnnncgnanannannnccnnnannaancnncatctnannnacncaannannananannnnnnnnnanncnnannncnnnnnncnnncgncnacc

SEQ ID NO: 5786 - DNA, 741 bp, Homo sapiens
  misc_feature 2, 12, 24, 514, 616, 654, 655, 675, 700, 721, 726, 733, 741: n = A,T,C or G
tntttccttacnaccagctactgntctttttgcaggatccctcgattcggaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtacttcaaaaagatttttaaataggtccggcacggtggctcatgcctgtaatcccagcactttgggaggctgangcgggcgaatcacctgaggtcaggagttcgagatcagcctggccaacatggtgaaaccctgtctcaactaaaaatataaaaattagccgggcgtggtggcangcgcctgtaattcccagctactcggggaggctgaggcnngagaatcactttgaacccanggggcagaaagctgcagttagccanaatcgcctcattgcactccancctangggacangagcgcgn

SEQ ID NO: 5787 - DNA, 887 bp, Homo sapiens
  misc_feature 2, 3, 4, 5, 6, 8, 9, 11, 12, 14, 15, 16, 17, 18, 21, 23,24, 25, 26, 27, 30, 31, 33, 35, 36, 37, 38, 39, 40, 41,45, 46, 48, 49, 50, 51, 52, 55, 60, 73, 83, 88, 91, 94,103, 106, 107, 108, 109, 115, 116, 123, 250, 271, 287, 288,342: n = A,T,C or G
  misc_feature 422, 424, 439, 469, 471, 478, 484, 487, 490, 508, 519, 528,534, 535, 549, 560, 563, 564, 578, 581, 582, 583, 586, 587,589, 599, 607, 611, 630, 637, 667, 671, 681, 682, 686, 694,701, 705, 706, 707, 709, 718, 722, 724, 725, 727, 736: n = A,T,C or G
  misc_feature 741, 753, 754, 758, 761, 773, 774, 777, 778, 779, 783, 785,801, 805, 809, 810, 818, 827, 828, 829, 832, 833, 845, 846,850, 855, 856, 860, 863, 866, 868, 870, 875, 877: n = A,T,C or G
annnnnanngnntnnnnnggnannnnncanncnannnnnnnaggnnannnnnacnattcncccctttcctaanagacttggcnactcngcnctntccgcaagnagnnnngcgttnncggttgngaggaaatccaaagctgaccaaaacatggtccccaccttttggagcttacagtctgtactggggaacagagattcagccaaagtcaagaaacactggatgccagctagattatctgttctgtgcttnggtgtctataagtacatatgnggatatgggttcattnnatccctaaacttagtaccaaaccagcatttaatatctaattataaatctaattnggcctaaactttattattgcacactgcctgaacaaaacctatttgcctctatgtaaattttttcctcatggaacaagggngngaaatgaaaatattntaggatttattcaaaaacagactattctgntntcagctncagaantgnacnatgaatcctaaggaaccntctgccaacangttgaggtntgctgnncgaaaagaaagaanaaagaggcggnaanntctcagggagaaantannnccnntncttttctatnttcagcanaccntggaggggtgggcgagaancaagaantgtaaagggaggatcagaaaatggggaatncttnggcagctgtnngaanatgatgangaagaanctcnnnantctcagttncccntnngnttccctatnaactnttggataaaatnngggnttnggccaccaaaannacnnntgcncncaacagcttcattggncccnaatnntccaaccnctgatcggnnnacnntcaaaaggctanngganccgtnncgtntanaantngnaaacnangcccaccccc

SEQ ID NO: 5788 - DNA, 1201 bp, Homo sapiens
  misc_feature 1, 9, 10, 12, 13, 15, 16, 21, 22, 24, 27, 30, 37, 39, 40,41, 44, 46, 48, 49, 50, 51, 52, 53, 55, 58, 60, 65, 67,72, 74, 78, 80, 84, 87, 88, 90, 92, 95, 99, 100, 101, 104,105, 106, 108, 112, 115, 118, 126, 129, 130, 133, 134, 135: n = A,T,C or G
  misc_feature 136, 137, 139, 141, 149, 150, 153, 157, 162, 164, 170, 172,175, 180, 183, 188, 190, 191, 192, 193, 194, 196, 202, 204,206, 207, 217, 219, 221, 225, 228, 231, 244, 251, 256, 265,267, 277, 278, 283, 285, 288, 289, 293, 295, 296, 298: n = A,T,C or G
  misc_feature 300, 301, 305, 311, 314, 320, 327, 335, 336, 337, 338, 340,345, 347, 364, 368, 370, 372, 374, 375, 378, 381, 388, 390,393, 397, 398, 399, 403, 404, 429, 430, 442, 443, 445, 447,453, 456, 461, 463, 468, 476, 483, 484, 499, 503, 508: n = A,T,C or G
  misc_feature 512, 527, 533, 536, 554, 566, 567, 568, 569, 575, 581, 589,590, 591, 596, 603, 613, 621, 622, 624, 625, 628, 629, 630,637, 645, 647, 649, 651, 662, 663, 666, 667, 679, 680, 684,691, 701, 706, 715, 725, 736, 740, 742, 744, 747, 750: n = A,T,C or G
  misc_feature 754, 757, 764, 767, 771, 775, 785, 786, 787, 790, 797, 799,802, 803, 804, 808, 811, 815, 816, 817, 837, 847, 848, 850,851, 863, 864, 865, 867, 870, 882, 890, 892, 902, 904, 908,915, 916, 918, 924, 927, 929, 933, 938, 945, 960, 969: n = A,T,C or G
  misc_feature 970, 979, 986, 987, 992, 993, 1002, 1006, 1008, 1015, 1023,1036, 1037, 1038, 1042, 1048, 1050, 1057, 1063, 1066, 1077,1078, 1080, 1086, 1094, 1100, 1103, 1105, 1112, 1115, 1116,1117, 1121, 1124, 1126, 1128, 1132, 1138, 1142, 1149: n = A,T,C or G
ncccccacnncnncnnacacnnanacnacncacacanannnccnancnnnnnncncancnaaccnanaatananaccncncacnccnnanancanacannnacnnncnccanacnaanaaaaaaanctnncannnnnananacaaaccnnganaganaggancncttttncnaanaaaanacncgggnannnnncnggaaangnannacacgagagngnanactngtnaanagccccttttgcnaaaaacnccttngggcaaaancncccgcctcannaccananagnncatngnncncnntacnacgccnaancatccnaatgccntcagctannnngngggangnggggaaccccacaacanaacnananannacnccnacctacncnacnacannnaacnngaccatcactccaaccaggacaacnncaacaaactacnnananccgacnaanatctnancacanccctctancaaccannacaccaacaccaacncctncatcnacancccacaaaaggcacnacaccncanaccccatcaccatcacanccaaaaaaaatnnnngctccnaccacnccacaacnnncagtnacatcancggaaaccangattacannanngannncaaacanccatcgcncncncntacaacagcgnnaannacatccaaaccnngaanccaaaancgacaacatnttatncccaacaanagggcaacangaacaaccccncganangnganaanatanacngaaaaangcnatantccnatcacccaannncanaaacacntnctnnncccnggnacannnccataaaacacatagccctnaaaaacaacnncnnaaaacccagacnnnanccncaaaaccaaaanatctcgcnanaaactctaananatcnaaccaannanactaanacncntcanaaaanagcctcnacggaggaaaaaaanaacacctannacaaaacancaccacnntggannacaaaaaanctcncncaaggcnctctacanttaaaaaaccccnnnactncacacncncccacanacacanacncgcaacctcanntntcaaantaaaatcnacacanacnanccactanccnnncaanacnantnggangcaaancccnaaacccnntntntcnannnngncccccnaaccctcncanaaatnccaanacaancancc

SEQ ID NO: 5789 - DNA, 769 bp, Homo sapiens
  misc_feature 2, 7, 22, 30, 550, 677, 727, 729, 767, 768, 769: n = A,T,C or G
cnttttnttttcttttcaacangctcttgntctttttgcaggatcccatcgattcgaattcggcacgagcccagatgggggtgtttttcaggtctctcacaaatgagacaagcgaaacaattgtctccttttattctctttggtgcattggtgctggggaaacatgaactagcggcagtgtaactgcagaacatagacccagttctaccaggccaggccagcactgggaaccgccagacagggctgctttgggctttgcttacagtatttccatgtgtagcctggcgtgtgagaaagtattaggtgaaatgccagtttcatggttcaggtgaaagtctgtgatcattcccctcgtggctcgtccttcacatcacttttgcccttcaaggagttgccgcgtccccgctcagtgcccgcctgagccctcagagctcccctgtgcttttctggatggggactggcggggtcacctagcctcaccgtggagccaccgtgcaatgcccatctctgagaggcccacgcagtattcctcgtgccctgtgttagtgcnttctgtataagggacagacagaactgggttttttttcctctgcctggttttagagttaaatgtaactaacttttatttttcccctttatgaaagatagaaaattatttttatggtagttttccaganctttatacaaaaattttttgttaaaaatgttctctgggaaaagttaactncnacgaatgtaaaatattgccttctaattaaaataaccannn

SEQ ID NO: 5790 - DNA, 769 bp, Homo sapiens; identical to SEQ ID NO: 5789
  misc_feature 2, 7, 22, 30, 550, 677, 727, 729, 767, 768, 769: n = A,T,C or G

SEQ ID NO: 5791 - DNA, 738 bp, Homo sapiens
  misc_feature 1, 217, 223, 225, 359, 440, 482, 602, 617, 692, 703, 717,724, 738: n = A,T,C or G
ntttcaaatcgcttggctacttgttctttctgcaggatcccatgcgattcgctactgagcctggcttgcaactggggtgagctccaccttgaacgtcgatcctcctgcctggtggagccatcccagctgatgccacatgaagcagacacaagctgtccctactaagctctgctcaagttggatattcatgagtgaaataaatgactgttactaagtnaaaaananaaaaaaaaaactcgagcctctagaactatagtgagtcgtattacgtagatccagacatgataagatacattgatgagtttggacaaaccacaactagaatgcagtgaaaaaaatgctttatttgtgaaatttgngatgctattgctttatttgtaaccattataagctgcaataaacaagttaacaacaacaattgcattcattttatgtttcangttcagggggaggtgtgggaggttttttaattcgcggccgcngcgccaatgcattgggcccggtacccagcttttgttccctttagtgagggttaattgcgcgcttggcgtaatcatggtcatagctgtttcctgtgtgaaattggtatccgctcacaattncacacaacatacganccgggagcataaagtgtaaagcctggggtgcctaatgagtgagctaactcacattaattgcgttgcgcttactgnccgcttttcantcgggaaacctgtngtgccanctgcattaatgaan

SEQ ID NO: 5792 - DNA, 795 bp, Homo sapiens
  misc_feature 2, 4, 5, 7, 14, 18, 27, 28, 29, 30, 34, 35, 40, 42, 50, 53,71, 78, 80, 90, 102, 110, 118, 119, 120, 124, 127, 128,130, 131, 139, 140, 141, 142, 145, 150, 155, 157, 158, 161,163, 164, 166, 171, 172, 174, 175, 176, 180, 185, 186: n = A,T,C or G
  misc_feature 187, 194, 195, 198, 199, 203, 211, 214, 218, 220, 227, 244,248, 265, 267, 271, 284, 294, 298, 311, 327, 328, 329, 333,346, 350, 355, 380, 382, 389, 392, 395, 398, 399, 400, 404,407, 420, 435, 441, 445, 448, 455, 457, 469, 476, 485: n = A,T,C or G
  misc_feature 490, 508, 514, 517, 531, 538, 539, 540, 547, 551, 564, 569,577, 581, 596, 597, 598, 599, 606, 615, 616, 625, 627, 630,633, 634, 635, 641, 642, 643, 644, 647, 651, 653, 659, 663,664, 665, 666, 670, 675, 676, 679, 680, 681, 683, 684: n = A,T,C or G
  misc_feature 687, 698, 699, 704, 706, 712, 719, 724, 725, 728, 732, 735,740, 741, 747, 750, 751, 757, 762, 764, 767, 768, 770, 771,775, 785, 786, 791, 792, 793, 794: n = A,T,C or G
gncnncncttttgnaaanccccttttnnnnaagnnccttncncctttgcnaancgcttgggcaactcgcantctctcnanacagcaaggnctgtggcgaatncggcacgnagccgccnnntctncanncnntgtcaggnnnnagnctgangctancnnctncnnantgcgnncnnngaancccannngacagcnnccnngcangcacgctnccncacngnacacaanctttaactaactgcccnactnccaatgacgaaaacatntnggantgactgccgaaantgcctttccngatntaaccactagacnatccatctgtatcacnnngttnagccatctttacngatntaagntccactgaacggctgagaaacttgnanaacacantgnacncgnnnaagnctngaacacaactggnccaaggaaaactaanagtgcnatantgnaacccanantggcatccacanaaaggcnctttaaacntgcangctcatcgtcaaagaatnatccanatncctggacactggcnggacacnnncatgtcnatcnatgaacaacctanaggcnttgcctangaancgctgcctaccactnnnnatgatangccgaacannaatatctantnccntcnnnctatannnntcnaagnantaaagnaccnnnntatncaagnnaannnannaanctagcacatgnnctcanangaacancaaattnatacnnganaatngtnccttnnaaaacntcnngggtanacttncncanntnnccancccctaaaanntcccnnnnc

SEQ ID NO: 5793 - DNA, 784 bp, Homo sapiens; identical to SEQ ID NO: 502
  misc_feature 3, 4, 28, 31, 601, 603, 605, 606, 608, 609, 610, 611, 614,621, 623, 625, 627, 629, 637, 644, 656, 657, 658, 660, 662,663, 670, 682, 692, 700, 705, 713, 721, 725, 745, 757, 782,783: n = A,T,C or G

SEQ ID NO: 5794 - DNA, 737 bp, Homo sapiens
  misc_feature 378, 481, 513, 515, 547, 617, 619, 620, 625, 645, 646, 656,660, 667, 669, 672, 678, 680, 688, 707, 708, 735, 736, 737: n = A,T,C or G
gttcttttgcaggatccctcgattcgaattcggcacgaggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcntaagggtagatcagaaatgacaaatgaattcaaaacctagcaggtgcattgtaaatgtgtgcccagttatgttttggaaatggcagttccttggggtcatgtntctactggccaaatttgcaatagtgttctatngnatgtaatttctaaaatttattaggattatccncgttggccaagtaaactgtctgccaatagaattctgggaattgtgagaaattgtatcattgaagttcagntnngatgngtggcttaaaaaatttatcnnggacccccanacanggaaacnanaantatttngntcctgcanggttcattgccacgggcanngaaggtatttcccagaaaaatacctcnnn

SEQ ID NO: 5795 - DNA, 785 bp, Homo sapiens
  misc_feature 4, 6, 9, 26, 28, 34, 51, 93, 97, 100, 112, 118, 126, 149,156, 167, 178, 206, 221, 223, 226, 230, 244, 273, 275, 329,340, 355, 399, 401, 411, 416, 428, 444, 445, 450, 462, 464,486, 510, 533, 540, 562, 600, 659, 699, 706, 710, 725: n = A,T,C or G
  misc_feature 744, 752, 770, 777: n = A,T,C or G
ttgnanccntttgaaaccctttttananttctancatacaagctacttgtnctttttgcaggatcccatcgattcgaattcggcacgagggcnactntgnagaattcgtacngatgangactgcanaatgaagacctactttcaacttncttttgnccccctctagnagaatcaaatngaatcttttacttacctctgtgcaaaanaaagaaaaatgaaanangtncatntattcattctgttnctatatagcaaaactgaatgtcaaaagtncnttctgtccacacacacaaaatctgcatgtattggttggtggtcctgtcccctanagatcaagctncacatcagttttacnatataaatacttgctctaccttaatgatgaggactccttaaagncncatttgctantgatnaatacactgctngggctggccagttttnnatgcntgcagcttgacnantgagcacactcaggcctttgtnttaaaaatgaaaaatgaaaaaacnaattcaaaacctattcaaatggnttctagncaatttgtttagtataaattgncatagctggtttgcttgaaaacaaacacatttaaaatnggtttacctcaggatgacgtgcagaaaaatgggtgaaggataaaccggtgagacgtggncccactggtaggatggacctttgagcttctggtgctccgnccatggngacnatgacacaccctggnggcatgcccctgtatgtgngttaacgntgtctgcattgtctaaantgaacangtgttagc

SEQ ID NO: 5796 - DNA, 1523 bp, Homo sapiens
  misc_feature 8, 10, 11, 15, 16, 18, 20, 34, 38, 39, 40, 41, 42, 43, 44,45, 49, 65, 73, 82, 83, 86, 91, 95, 97, 105, 107, 113, 114,115, 120, 121, 122, 124, 126, 131, 140, 143, 144, 150, 151,153, 155, 158, 160, 162, 165, 167, 169, 175, 176, 178: n = A,T,C or G
  misc_feature 179, 182, 185, 189, 194, 201, 202, 212, 216, 217, 219, 221,232, 234, 241, 242, 259, 263, 269, 270, 275, 285, 292, 293,304, 313, 314, 324, 334, 337, 341, 350, 353, 356, 363, 365,367, 370, 375, 376, 379, 380, 384, 385, 394, 397, 413: n = A,T,C or G
  misc_feature 415, 422, 427, 433, 443, 446, 451, 452, 459, 460, 464, 467,470, 481, 484, 488, 495, 498, 505, 513, 517, 520, 525, 527,528, 534, 541, 542, 549, 554, 557, 561, 562, 565, 576, 584,585, 588, 591, 602, 604, 608, 615, 620, 625, 627, 633: n = A,T,C or G
  misc_feature 634, 635, 639, 646, 650, 651, 656, 662, 672, 675, 677, 689,694, 700, 708, 710, 712, 718, 722, 727, 729, 735, 738, 740,750, 752, 753, 755, 765, 782, 786, 788, 789, 799, 802, 805,807, 808, 810, 811, 812, 820, 822, 824, 825, 831, 832: n = A,T,C or G
  misc_feature 844, 847, 851, 852, 853, 857, 860, 866, 868, 869, 870, 874,883, 888, 897, 900, 902, 903, 913, 919, 924, 926, 927, 932,933, 934, 935, 938, 939, 949, 961, 970, 972, 974, 976, 982,983, 990, 996, 1000, 1004, 1006, 1009, 1015, 1017: n = A,T,C or G
  misc_feature 1019, 1020, 1028, 1039, 1040, 1046, 1048, 1053, 1057, 1058,1063, 1067, 1069, 1071, 1072, 1073, 1074, 1081, 1095, 1099,1106, 1113, 1116, 1126, 1127, 1133, 1145, 1152, 1153, 1155,1162, 1167, 1168, 1173, 1176, 1178, 1179, 1183, 1184: n = A,T,C or G
gggggggngnngcgnngntngggggggggggttnttcnnnnnnnntggngacacccctttttttngggggganaaaaacccnnggngaggngcgngngggggctngnggggannnctggnnngngnggggngggggggcnggnntggagnngngnggngncncgngngngggcgnngnncgnggngggnggggngggggtnntttttttttngggnncngngagggggggancnaggcggnnggggggggggggggggntggngttgcnnggggnggaggggggngggaggnngaaggggaggnggcggggannggcgggcagnggaggggggncgngggngggtggcgnggnggnggcgggngngnggngccgnnttnngggnngcgcggcgnctngggcgccggcggggangngcgcggncgtgngagggnagacgggagncgnggcanngagctgnngtcnggngcngggcggggcgnagngagnaggctcnatnggggggnggcggggngtgnggnggggncnncgaggngggggannaggcgtngggcnggntcgnnggngcgggggcgancggggagnntgnggngggggccaggngngggnggggggncgggnggggngnatcgcnnngcgntgacggngtgnncgggnccggcngggcgcgcgngancncgggaggaacgncgcangggggncagtggtngngngccgangtcngtgtngngcgagnggngngagagggagngnngntgggtggggncgaggggatggccgagngtcngnnggggggaggnggnggngnngnnngagggcgntngnntggctnngggggcccaggngcnggcnnngcgnggnaggggngnnngggnaggcgggcntgggntggccaganagngnnctgggggggntagagngcggngnnggggnnnntgnngagacgggcngagcgggcgggnggcgggcgngngngngcgtgnnagagcgngcgggngcgngtgngnccnggcggncngnngcagaggngggacacagcnncggagngnggtgnatgnngagangagngngnnnngtggcgnacggttagcgggcngcgnggagagngaggtgncgntgggggagcnntcgcgngctagagaggcngcggcgnngngataggnggggnngagcntgngnngganncggatctagggagcgcgagtgggnggnggtngacgngagggggnngtgntnggagagngggngagccgngngcngntgtagagagncagnggcgtgccgngtgggcanagggcgngtgcnncngtaganatggntgnngcnctgcggcgngcgaggcnntaggnngngtgnngngggangagcgngtgtgggcgngcgcgnnggggggcggcngagtgacgntnngcgcgatngnnnggccnccgnngcggncgcagangngangggngnngcnnncgcgnggaganngnnaggnacagggcgagggangcgangngntgtgtgnnaggngcggnnggt

SEQ ID NO: 5797 - DNA, 758 bp, Homo sapiens
  misc_feature 7, 13, 16, 18, 19, 22, 30, 32, 34, 35, 42, 44, 51, 391, 510,520, 566, 583, 602, 615, 616, 618, 621, 622, 665, 672, 701,717, 725, 739, 747, 755, 757: n = A,T,C or G
gacttcnctttcnaanannctnggaagctnantnncctaaananaaggtcntgggcgagagttctggatgagacttggtatggtccattctgggacaaaattcctctctctctctctctgcggacccgtgaaatctagaaaataagttatttgcttctaaaatacagtgatgggacagacataggatagacattcccatttcaaaagtgagaaattgggccaggtgcagtggctcacacctgtaaccccagcacctgtaatcctagctccccaggcggctgaggcaggaggattgcttgagcctgggagatcaaggttgtagtgagccatgattgcgccacctttattgggaaacttttattccagttaccaataacacattcctcatttnctccagagacctcaccagaaacacctttaatattcatatttctagcagccttctgttcataacaatatatgcatcctgttaagatgataggagatttctcttgcacctctcctctttgngagcctgcangggacattcccttttaatgtccatatttctaccagcagttctcttnaaagcaagtctaaggtntttcctaacattacacctnaaaattcttgcanntnttnnccaagcacagtgccttacatctggtaattcctaacactttganaaggccnaacatggaacaggaatgcttgagctcaangagttcaagaccagcncgggcaanattatggaaccctnccttttcnaaaaattncnt

SEQ ID NO: 5798 - DNA, 781 bp, Homo sapiens
  misc_feature 5, 7, 10, 11, 13, 30, 388, 518, 706: n = A,T,C or G
tgagncnttnnanccttttgaaatttttanacagctacttgttctttttgcaggatcccatcgattcgaattcggcacgaggttgctcttccatgcgttggtcagggggccctgaaaacactggtaatattaagagtctttctcagggtaacttaatgttttcttaatgaacaatgtttccagctacaaattctttcaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggatangaaacaagtatttctcttctggtatacatgtaatgtattctgtaaaaaagtattcatattggcaattttagttaggcataatattgtggttgtaatttttaaaacttagtgttttgtctgattaaagcangcactgatcagggtatctcctaagaggtaattcacttcttattcctttccaataattattacattctaaattttcatctatgagaaataacaaacaagaagggaatagaattaaattggggtataatctaatcttcattggttaaatggtttgccttctcccattgaagccattttttatagcctcanaaagaggaaataatgccttcacccattttctacctggtgacttgaaaaatggaccttttaagttaggaagaagtt

SEQ ID NO: 5799 - DNA, 939 bp, Homo sapiens
  misc_feature 2, 3, 4, 187, 192, 196, 197, 199, 201, 206, 232, 236, 239,241, 242, 259, 262, 264, 266, 267, 276, 289, 292, 293, 298,317, 319, 349, 351, 359, 379, 381, 385, 386, 402, 407, 409,412, 416, 420, 438, 440, 441, 446, 451, 453, 456, 457: n = A,T,C or G
  misc_feature 458, 464, 466, 467, 471, 472, 474, 476, 478, 479, 480, 483,489, 490, 493, 495, 507, 508, 509, 511, 512, 515, 522, 523,525, 529, 531, 533, 535, 539, 540, 542, 546, 547, 548, 549,550, 551, 553, 555, 559, 564, 565, 570, 572, 579, 589: n = A,T,C or G
  misc_feature 591, 592, 594, 595, 596, 599, 602, 605, 606, 608, 613, 614,615, 617, 622, 626, 632, 633, 635, 641, 644, 645, 647, 650,654, 656, 662, 664, 666, 667, 669, 672, 678, 679, 680, 681,682, 683, 684, 690, 691, 693, 695, 696, 697, 699, 700: n = A,T,C or G
  misc_feature 701, 705, 708, 712, 716, 717, 722, 723, 724, 727, 728, 729,731, 735, 740, 744, 746, 747, 750, 753, 754, 759, 762, 768,770, 771, 775, 776, 778, 783, 788, 789, 792, 793, 794, 798,799, 800, 802, 804, 806, 810, 812, 815, 816, 817, 819: n = A,T,C or G
  misc_feature 824, 826, 827, 829, 832, 835, 841, 842, 846, 853, 855, 858,859, 860, 861, 862, 870, 875, 878, 881, 885, 886, 891, 895,897, 899, 901, 902, 906, 908, 914, 918, 922, 924, 931, 939: n = A,T,C or G
gnnnttctaatttcctaaatggctgggctacttgttctttttgcaggtatcccatcgattcgaattcggcacgagtgaagaggaaaaagttcaaaaaataaattacattttataaataaggcaaggaactggacattacctcacatctgcaattccaaccctctgggaggccaatgcatgtcattcnttccnatanntncnactcnagacacatgatgtgattcacagaacnaganaangnntccacctactgtcctgnttnangnngggatgctncataaagaggatnacnnttaanccactaacagttatgcctntnatcttgaatctgttcctactagttttcgtntncctgggcntgttactttatgtttccttncntcannttacctttaatatganaatantnatnattntttnaccatggtcccttacttnanngatanttttntnatnnntgcatngnnatannancntnnngtnctttcnncantntaaattcttaannntnntcnttattcnntnttcntntntntttnntnattnnnnnntntntacncttannttccncnacatcanccaatttttntnntnnnttnttncannanaattnnntnttttnatanattttnntntacttntgnnanatngggntnattttncntnncnaantggttnnnnnnntttttnncncnnnannnaacntcntttnatcnnttctnnnatnnncnattnattantctntnnctnttnntatcnacncaattncnntatnntnatctntatannttnnnaatnnntnanantacntntannntnttctntnntnttntanaatccnnaatntatcttntnttnnnnntctaaaanagctnttnccntttnnaatcncttntntntnnattntnttttantctntacnanacttttnttacttcn

SEQ ID NO: 5800 - DNA, 780 bp, Homo sapiens
  misc_feature 5, 19, 29, 37: n = A,T,C or G
ttgancctttatacagctnttgatttganacctttanacagctacttgttctttttgcaggacccatcgattcgaattcggcacgagggaacatctttaccaccaacgttttacctctgcttcaacaatttggccttgtcaaagacacctgctcatatgtaaatgtggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaatctgcagagcctggttcaaaatcagtcactcccttcagaagcagacatggcatctgttccttgcttgcttgttggttgtgtcctttcacgagacctgaattttagaattgcccagtgctgccagagtg

SEQ ID NO: 5801 - DNA, 1210 bp, Homo sapiens
  misc_feature 3, 4, 5, 9, 16, 18, 42, 50, 57, 64, 83, 84, 87, 90, 93, 94,95, 110, 117, 120, 122, 127, 128, 131, 134, 135, 137, 140,143, 144, 145, 147, 153, 155, 159, 163, 177, 189, 191, 199,209, 216, 217, 226, 229, 239, 245, 253, 254, 256, 264: n = A,T,C or G
  misc_feature 269, 274, 276, 278, 280, 323, 337, 341, 344, 347, 350, 351,360, 363, 372, 375, 391, 397, 400, 402, 403, 404, 414, 416,420, 421, 425, 428, 436, 438, 476, 484, 491, 492, 508, 518,525, 526, 528, 530, 540, 554, 557, 561, 564, 573, 575: n = A,T,C or G
  misc_feature 590, 593, 596, 606, 609, 611, 613, 616, 618, 621, 623, 634,637, 641, 648, 654, 656, 657, 671, 673, 674, 675, 677, 679,683, 684, 686, 696, 704, 708, 710, 725, 738, 746, 753, 758,762, 771, 789, 799, 809, 811, 817, 828, 837, 839, 854: n = A,T,C or G
  misc_feature 856, 865, 869, 872, 874, 883, 885, 889, 892, 903, 905, 906,910, 939, 940, 950, 951, 956, 959, 960, 961, 977, 978, 988,1000, 1003, 1005, 1009, 1015, 1027, 1030, 1035, 1039, 1042,1044, 1046, 1049, 1051, 1057, 1058, 1079, 1083, 1088: n = A,T,C or G
  misc_feature 1089, 1093, 1105, 1106, 1116, 1132, 1133, 1134, 1141, 1146,1151, 1155, 1168, 1174, 1187, 1188, 1189, 1194, 1198, 1199,1204, 1206: n = A,T,C or G
gtnnnaacngttaacncntctgtctttgaggtccatcgttcnatcggacnagtatgnatgcatncctcccctgtgcgatgagnntgncangannnacagcacatgggctntaggacnttnangtgcnnaanctnncngantgnnncngcacgncnacgngctncttgcccgcctaangtgaatatcgtncncgacatgnagtgcatcangagtganngagcccctngcntgaatgtatntcgtcntcaatacnntntatcgccnacatnccttnancntngctaccacttcagcatgatcccactgctcgaatttgccattcngtaattccttaacnaggngcntgnaanngcggaaacnttngtccaagtnganacccctagctctttanaagcgnttntnnntggggaaaantnccanncctnggngacaagantnggatttttaacccaattgggggaaacccgccttgggcncactttgngggtttnnccccaaaattttcccncccttgggantaaaaanncntnttttcaaggngagcgggccttcancanattnccngttaaaggngntttctgattcaaagnccntgnccggtggaantcnangnggnanagngnaaaaaattccnttngggnactgcanaaattncnncgttcggattgggngnnntntnccannanggcccctgtntcccatangggngnaaaactccgggccantttttttttaaanaaaacctngggaaantcccntttnttaattaancaccctggggacgtccanattggggggngacatttgcncnatggcnttagcctatanttcgtaccncngaaaaatcgggagantnccctttganaaanttntnccagaaacntngccncanaacctttcggncnntggngtttggtcaattgaaaatccaaaaattanntggcccctgnnagacnggnnntcaaataggccgcttnntggtacttcncctaaacaatcnttngntagngcattngcgctcaatggnaanttcancctnccngngnacntngggaannggattttaaacccggaaaaantttnaaccnnaacnactgggctcatnngctacttggnttccattaaacccgcnnntgattancgggncttancagnactttgcacggcnatgcanctagtgacccggnnnggttncaanncttcntntgcc

SEQ ID NO: 5802 - DNA, 837 bp, Homo sapiens
  misc_feature 18, 20, 21, 32, 33, 56, 64, 65, 68, 70, 84, 93, 95, 101,109, 113, 119, 122, 125, 127, 140, 153, 162, 167, 173, 186,204, 212, 217, 227, 232, 236, 237, 254, 256, 282, 294, 302,310, 323, 326, 331, 334, 343, 345, 355, 364, 379, 385: n = A,T,C or G
  misc_feature 386, 406, 414, 433, 436, 438, 444, 462, 467, 482, 490, 494,500, 508, 511, 527, 532, 535, 536, 537, 546, 547, 556, 561,566, 572, 593, 595, 616, 625, 627, 628, 631, 640, 661, 662,663, 675, 676, 679, 685, 688, 693, 698, 702, 704, 708: n = A,T,C or G
  misc_feature 727, 736, 742, 749, 754, 759, 762, 772, 774, 795, 796, 797,801, 804, 816, 828, 834: n = A,T,C or G
ttttttttacttaacatntnngcctactcggnnctttttgcagggatcccatcgcnttccgaanntcngngccgagggtgtggntccaagttntncatgantagcaacnaganggtgtnganatnantgtgtaaggctgngaattcttgctgnaggaatcgnagaanacctgntgctgcaaaatcntacatgttccacatgganagggaagnctaancgctattcanaacanttcnnttttgtatttaattaancnattgcagctatctgggattttcgggncagaatattaanttcctggntgattctncatattccaatgnatnaaatncanaaccattgngnctttaagatngtgtcaatnttcacctaacaactngtgccnnaagcacctgcattggtaatnatatttcncttaaagggcaaattctgncantntcctgntaactcaaaagtgcattnttccncttcaaaaatgttgntctcagtnatcncacatnctgcaganatntatttatatctatacntatanctnnntgaaatacnnttactcacnaaatntattnctgatnaacattcccatgttaaatctnangccccaaacctttctaaattntggcccctnannccnttaatattntaaaaaaatctaaaattctgnnntttcaaatttgnnctntaagcnttnttaanaaatnttcncnaccnttgcctttccaataccctnccccttggnttaacnaaatttnctttnaatanccntcaccttcananactggattctctttcaaattnnntctngcntcgaatcattantaacttttgggnctctcncct

SEQ ID NO: 5803 - DNA, 1302 bp, Homo sapiens; identical to SEQ ID NO: 5769
  misc_feature 2, 16, 24, 55, 57, 68, 70, 72, 73, 75, 80, 81, 84, 88, 92,94, 96, 97, 98, 106, 111, 123, 129, 130, 133, 135, 137,138, 140, 143, 149, 151, 153, 154, 157, 159, 161, 169, 172,176, 177, 181, 182, 187, 193, 194, 197, 199, 201, 204, 206: n = A,T,C or G
  misc_feature 207, 211, 216, 219, 222, 223, 227, 230, 233, 235, 239, 247,252, 258, 263, 265, 275, 282, 288, 293, 295, 300, 303, 308,309, 310, 312, 317, 321, 326, 332, 338, 339, 343, 349, 355,361, 365, 368, 370, 372, 375, 380, 381, 385, 388, 389: n = A,T,C or G
  misc_feature 390, 391, 396, 397, 399, 406, 414, 425, 426, 431, 434, 443,447, 449, 455, 456, 457, 458, 460, 462, 466, 468, 473, 475,477, 478, 479, 484, 486, 489, 496, 497, 505, 507, 511, 515,516, 517, 520, 523, 524, 527, 530, 531, 536, 542, 543: n = A,T,C or G
  misc_feature 546, 547, 548, 549, 550, 553, 554, 555, 558, 559, 560, 562,564, 571, 575, 576, 577, 579, 581, 583, 584, 586, 587, 593,594, 595, 596, 599, 600, 601, 602, 603, 607, 609, 611, 613,614, 617, 618, 622, 624, 631, 634, 641, 647, 649, 650: n = A,T,C or G
  misc_feature 651, 654, 660, 662, 666, 672, 675, 681, 682, 687, 688, 690,696, 698, 701, 702, 709, 713, 714, 715, 720, 723, 726, 728,729, 732, 735, 740, 741, 747, 786, 789, 796, 798, 803, 810,815, 818, 819, 820, 827, 829, 838, 841, 842, 847, 848: n = A,T,C or G
  misc_feature 854, 858, 859, 865, 867, 869, 877, 887, 888, 889, 891, 892,895, 896, 904, 911, 913, 919, 924, 929, 931, 935, 949, 950,954, 959, 967, 977, 992, 994, 998, 1000, 1002, 1004, 1006,1007, 1010, 1013, 1014, 1016, 1017, 1023, 1026, 1028: n = A,T,C or G

SEQ ID NO: 5804 - DNA, 769 bp, Homo sapiens
  misc_feature 3, 13, 28, 30, 31, 37, 39, 42, 46, 49, 63, 67, 69, 74, 75,79, 83, 84, 93, 107, 115, 119, 125, 127, 136, 142, 144,146, 152, 154, 156, 157, 158, 161, 166, 171, 176, 182, 185,196, 197, 204, 221, 227, 228, 249, 255, 261, 265, 267, 268: n = A,T,C or G
  misc_feature 273, 278, 279, 289, 302, 316, 317, 321, 324, 329, 335, 341,347, 348, 355, 357, 364, 369, 371, 384, 393, 394, 398, 401,408, 415, 416, 418, 424, 430, 436, 437, 443, 450, 451, 455,459, 469, 470, 484, 485, 505, 516, 537, 545, 547, 549: n = A,T,C or G
  misc_feature 551, 561, 562, 565, 569, 581, 590, 598, 602, 613, 621, 634,638, 640, 647, 655, 656, 657, 665, 668, 682, 697, 699, 700,704, 707, 713, 717, 722, 727, 728, 731, 734, 736, 743, 753,761, 762, 764, 766: n = A,T,C or G
aanaacgtaattnaacgctagcgctctngnngatccngnagntctntcnttcttccaatgccngaananctgcnntggnatgnngctacatgnatctaggtgttgangctttacncgcnagttgncngatgacgcntggcanangnccaggntntnnntanatccnaacancatantgaggnatnggatgcctacnngcagagncgacagaactcacgctntaaaannaggcgccacacacgggacgantacgtnagaaanaatncnntgtgngtgtnnttcctactcncttactcacagcncatcagaaggaagnngacnacnagctngaagcnggcttnataccnnatatcgncngctacancctgngncaccactgccatngcgatgctnnactncanctaattntaccatnnangatgcntcatgnacctgnnctagcnccggcanncttntggnggcccctatnntagagaacggcttnnctccacactgtaatggtagngattgtggatnttcctctatcatggaaggganttgaaacngntncnctggagggtnnggntgtngactgcacttgnagcattcgnattcatgntganctcggagattnactctggngttccatcaactntgantncaaacangatgatcnnngattaggncgntttccaatgtttgngccaaatttgttaanannaacnacnggattncaanttaanttggnnaanccntnttaaccnttcgggctcntgctcctnncntngcc

SEQ ID NO: 5805 - DNA, 880 bp, Homo sapiens
  misc_feature 2, 7, 8, 34, 41, 421, 458, 498, 508, 525, 529, 541, 554,555, 575, 576, 583, 593, 601, 604, 605, 609, 611, 614, 624,635, 648, 650, 659, 662, 665, 679, 705, 707, 713, 719, 721,722, 723, 724, 725, 732, 734, 740, 743, 747, 754, 760: n = A,T,C or G
  misc_feature 764, 768, 773, 783, 785, 797, 798, 802, 805, 813, 814, 815,816, 826, 839, 841, 842, 848, 851, 863, 865, 871, 878, 879: n = A,T,C or G
tnctttnnttactttcgctcccgttctttttgcngatcccncgattcgaattcggcacgagagagggtggggtctggccacataggtacctctgtggctctggtctggggttagacactgttagggactagcatttattggacttgtaaagacagcacctcagaattagtaactacttgcattttagggtctgttttatgaagccaacaagtgaatgtaaaataggctctgcatcttttctgagagccctgtcactgggcagtgagcatttccaaaattgcagctctgtcagaatgaaccatgaatacttaagaaagggaaagtaggaacagggagcagagcaaagcataacttgctgtgttccagggatttaaaaataaattactgtcaagagcaatataagggtcatgggtttgatcangaacttttttgtaaatgaaaaagttcacaattttggnaaaaacagtgctagatgtgttatggaaattgttatcacanaattcttccncctgaaacttcaagttntatnaagacaaccaantatatttgcctgnngaaattcttaaatttcttgnnccttatngggaaaggtnaacccaanacnntcangnaancccattcccntttttttggcntttggaaacttgncnacccggttnggncancccccaatttttcntaaaaatttaatggtaaaaccttttnanacccantatcantnnnnnccattancnaccccnctncatntaccccngccccntctncttnaatanaaacttctcngntgcccctttttnnaaanaantcttttannnncgaacccccntctttttcccgcntnnatattnccncatcccttttgnanttcacntactccnnt

SEQ ID NO: 5806 - DNA, 880 bp, Homo sapiens; identical to SEQ ID NO: 5805
  misc_feature 2, 7, 8, 34, 41, 421, 458, 498, 508, 525, 529, 541, 554,555, 575, 576, 583, 593, 601, 604, 605, 609, 611, 614, 624,635, 648, 650, 659, 662, 665, 679, 705, 707, 713, 719, 721,722, 723, 724, 725, 732, 734, 740, 743, 747, 754, 760: n = A,T,C or G
  misc_feature 764, 768, 773, 783, 785, 797, 798, 802, 805, 813, 814, 815,816, 826, 839, 841, 842, 848, 851, 863, 865, 871, 878, 879: n = A,T,C or G

SEQ ID NO: 5807 - DNA, 778 bp, Homo sapiens
  misc_feature 17, 20, 22, 472, 582, 586, 604, 628, 631, 642, 646, 647,650, 652, 654, 656, 657, 658, 659, 663, 664, 665, 666, 680,681, 683, 693, 701, 705, 706, 707, 708, 709, 711, 712, 716,717, 719, 720, 723, 728, 733, 734, 742, 745, 750, 753: n = A,T,C or G
  misc_feature 754, 757, 765, 771, 773, 774, 776, 777: n = A,T,C or G
tctttttttggaacccnttntngctctttttgcggacccatcgattcgctctggagtagctgggattacaggcatgcaccaccatgcctggctaattttgtatttctagtagagacagggtttcgccatgttggccaggctggtctcaaactcttgacctcaggtgattcacccacctcagcttcccaaagtgttgggattataggcgcgagccaccatggctcagcctcatgttcgtttttaaaacttaggatggtggctcttttacattgattggtaggaactcttcatattacgaggcagttagctagttgtctgtgaaataaaatactaatgattgaactttctaggaagtacctattctgctaatagtgtaaatatacacttatccagggtcagaaatactcaagtttacccacttaaaagatctagaaaatacatgaacttgggcttacttgccagttaaaattgnttatctcagaattgtaccatcaccttaattaaagtagatatgctaggattatcctgataactaattaacatagcctttcccccttagtgttcttcacctgaatgtagtanttgnactcttcaagtctagcanaggccaataaaaagttcagagttncanaaacatcaaancctnntcnancncnnnnatannnncctcactcacatcnncncatccccacntacaaacncacnnnnncnncccnntnnctnccccnttacnnctacctcnccnttccntcnnaantccctccncacgcncnncnnt

SEQ ID NO: 5808 - DNA, 778 bp, Homo sapiens; identical to SEQ ID NO: 5807
  misc_feature 17, 20, 22, 472, 582, 586, 604, 628, 631, 642, 646, 647,650, 652, 654, 656, 657, 658, 659, 663, 664, 665, 666, 680,681, 683, 693, 701, 705, 706, 707, 708, 709, 711, 712, 716,717, 719, 720, 723, 728, 733, 734, 742, 745, 750, 753: n = A,T,C or G
  misc_feature 754, 757, 765, 771, 773, 774, 776, 777: n = A,T,C or G

SEQ ID NO: 5809 - DNA, 827 bp, Homo sapiens
  misc_feature 5, 7, 30, 32, 46, 58, 68, 71, 72, 74, 113, 118, 126, 130,140, 158, 188, 216, 232, 284, 298, 301, 348, 363, 402, 421,463, 478, 504, 522, 537, 567, 568, 579, 580, 602, 622, 631,632, 633, 643, 645, 653, 679, 681, 682, 684, 692, 695: n = A,T,C or G
  misc_feature 703, 712, 718, 766, 778, 793, 802, 806, 816: n = A,T,C or G
ttagntnaaccctttgaaacccctttgaantntttaaaccctttcnaccgctacttgntcttgatccnagnncncctcaattccgcctttgttccctctttccatgccgtttnttccnggggcccngganaacactggtnatattaacagtctttctnagggtaacttaatgttttcttaatgaacanatgttccagctaccaaattcttatcaanaaatcggcttcctttntgaaaagtactctcatagaagaaatttagcaatttctcgtgactgactcaanctattttaagtatncanaaaagattttgatccccattgagttaatgctctgccttgaaaattanttttctgatccttgntagtgataacattttttttctactgaaggtcagaggatnggaaacaagtattcctctnctggtatacatgtaatgtattctgtaaaaaagtattcatatnggcaattttagttangcataatattgtggttgtaatttttnaaactttagtggttttgncctgattaaagccancgcttgatcagggtatctcctaaagagggnnattccaccttnntattcctttccaatgaattatnacattctaaattttcatctntggagaaannnacaaccaagnanggggaatnggaattaaaattgggggtataaatcnanncntccattgnttnaaattggntgcccttcncaccanttgaagcccatttttttatagcctcagaaaggagggaaataaatgccncccacctttttnttcctggtagacttngaaaaattnaccntttaagttangaacaaagtct

SEQ ID NO: 5810 - DNA, 785 bp, Homo sapiens
  misc_feature 13, 17, 32, 38, 42, 45, 47, 48, 50, 53, 57, 59, 60, 65, 66,245, 247, 257, 268, 278, 290, 293, 294, 300, 301, 313, 316,328, 332, 337, 359, 426, 441, 443, 483, 507, 521, 537, 541,557, 582, 588, 622, 634, 642, 643, 655, 665, 673, 683: n = A,T,C or G
  misc_feature 693, 700, 713, 718, 719, 722, 723, 735, 773, 785: n = A,T,C or G
tttgaaccctttnacancttttgatttttaancctttncacngcncnngngcnggancnnccccnngaattcggcacgagggtgtgcggctgtaattttagctattcgggaggctgaggcaggagaatcacttgaacccaggagacgaacgttgcagtgacccgagatcgtaccactgcactccatcctgagtgacagagcgaaactccatcttgggggaggaaaaaaaagaaagtaatagggangnaaatcagaanttgtgtgggantccccctatntctggctcttgntannatactnnacctgtcaggcnatnctgagagcgaangctnctgcntagggctagtttccattcagantggtttttgataggcatgaactagtctaactcaaagcatacttctgtgtaagctagcatagctcctntacttggcttcatancnttggacattaatcgagaaaagtgaaaaaggagggtttggncctgccttgaatagcatttgattnttaatcctacattntatcagagccccagcntttnaaatgtttaatagccntatgtgctgttttgccacgcttacnaagttngtacttctgtgaatgaaaaagtgtgactggactnacataaactggnattgactnncagtcatcagtntatttccatnttcaaggnaaaacccaangactgggttntcctctnttttcttttgaanatganngcnnctaaaaatcaantaattggggctggggtgtggaagcccaccttgtgaaantcttatgctttn

SEQ ID NO: 5811 - DNA, 975 bp, Homo sapiens
  misc_feature 2, 3, 4, 5, 7, 8, 10, 12, 14, 15, 16, 18, 19, 20, 23, 25,27, 28, 29, 31, 32, 34, 38, 40, 41, 43, 44, 45, 49, 50,51, 53, 54, 56, 57, 59, 62, 65, 67, 68, 72, 73, 77, 82,94, 121, 125, 129, 135, 142, 163, 174, 179, 193, 194, 206,218: n = A,T,C or G
  misc_feature 235, 241, 242, 249, 271, 275, 296, 305, 337, 339, 341, 343,354, 358, 363, 367, 369, 373, 374, 380, 381, 384, 405, 408,415, 418, 424, 425, 434, 446, 451, 452, 455, 465, 468, 469,473, 476, 491, 492, 499, 502, 503, 510, 511, 512, 526: n = A,T,C or G
  misc_feature 531, 535, 540, 560, 562, 567, 568, 578, 579, 581, 583, 585,596, 602, 607, 627, 638, 647, 648, 651, 658, 701, 703, 714,716, 721, 740, 741, 743, 748, 750, 753, 757, 761, 762, 772,775, 777, 783, 787, 790, 791, 796, 800, 801, 809, 810: n = A,T,C or G
  misc_feature 814, 815, 820, 821, 828, 829, 830, 845, 847, 850, 853, 856,864, 878, 883, 888, 913, 918, 931, 934, 938, 946, 948, 951,956, 959, 973: n = A,T,C or G
annnnanncnantnnntnnnatntnannncnncntaantnntnnnatcnnnanncnnanaanatntnnactnnaaanaattnctaatgattaanggggggtctaatgcttggaaactcccncgantaanaggttngtcggcngctctggctgcccggcggttnagcagcatggnctctncaggggcacagtanngcgcctcccganttaccggagcgnaactgccaggtaccgcnaagtcnnctctggnatcagcgctaccaaggcgcagncgantctgccaagctaccttaggancggggactnatcctacttccgtgccctactagagccggagntncngnccgaggaccgnatcnttgtnctangntgcnngaacanngcnctgatctactaatctgttccntangacgctnccntaatgnnaccagtgcngactactcatcnatacnnggnagcttgatangcnngctnacnatgcccatgtgcccnnatcctcnctnngaaaacnnngaatgtgcgcgaangctgngacntttcnccaaagctttgtttttgaantnggttnntcgaaaaaanngncncnacttgggaatncccctnaattngcatggggggaaactaaagnttccccttggnaaccccatnntanccctttntaaaaagggtatttaaccccaactttgggggcaaccccaaaantnttttgtaaacntntaatnttcggaagcccctgggaannantttgngnaancctntagnnaaggggcccnggnanttcttnttcnttnnaacangaannttttttanngccnngaccnncctcgannnttttaaaggggcccnanaanccnttnttggcccnaaaacccttttagnggttnagganccttgaggaatgccccccttttggnaatgnggatttccacttnccnatgngtaacccnancanaaaanggnggaaaagctaaaancc

SEQ ID NO: 5812 - DNA, 1150 bp, Homo sapiens
  misc_feature 2, 7, 9, 22, 26, 31, 33, 36, 38, 53, 61, 63, 65, 73, 86,87, 95, 115, 117, 122, 129, 137, 146, 156, 160, 163, 165,170, 171, 196, 217, 219, 220, 221, 224, 234, 238, 256, 259,262, 266, 272, 291, 295, 327, 374, 377, 401, 406, 409, 411: n = A,T,C or G
  misc_feature 424, 454, 456, 467, 468, 471, 475, 478, 486, 503, 523, 529,533, 538, 540, 542, 544, 550, 553, 556, 557, 558, 569, 570,572, 584, 586, 587, 591, 601, 612, 616, 620, 621, 622, 625,627, 634, 644, 655, 656, 663, 674, 675, 677, 678, 682: n = A,T,C or G
  misc_feature 685, 686, 689, 693, 694, 696, 700, 703, 706, 709, 711, 712,714, 715, 717, 724, 726, 730, 736, 741, 744, 749, 751, 758,764, 765, 781, 784, 787, 788, 793, 799, 817, 818, 820, 829,831, 833, 835, 843, 849, 850, 851, 852, 856, 863, 865: n = A,T,C or G
  misc_feature 866, 872, 874, 876, 881, 886, 888, 890, 895, 897, 901, 908,911, 913, 920, 923, 924, 925, 931, 940, 943, 944, 950, 955,961, 965, 968, 977, 978, 981, 984, 986, 994, 1000, 1002,1014, 1026, 1031, 1037, 1038, 1046, 1048, 1049, 1050: n = A,T,C or G
  misc_feature 1056, 1062, 1065, 1075, 1078, 1083, 1085, 1091, 1095, 1103,1106, 1109, 1115, 1120, 1121, 1126, 1127, 1130, 1136, 1148: n = A,T,C or G
gncacgntnttactccttgggnaatnagttngnttnangccctttctctaaanagaaatgngngntggcgaanttcggcacgagtnngaagcatncacatatccttagaatagtntnacttnggctatnaacccctngccggctgnggctccccantgtngtnantctgnnatgtgctatacccaacctagagcangggcgccatgcctggctaatnannngtnattacttttntcancagatggggtcttcactntgntgnccangcttgngtctagaactcctgggctncaanttgatactcctgcctgagcctcccaaagtgcntgggattatagacatgagcaaattgtacttgggctcaaatttcttgnttnaaattgggcttttttgtcagaagnaatgngcncncctttgaattatnattttgatcttgttctcattgtattacttngnacccctattcnnacnatangantttctatntttattcaatgaaagcngccctggggaatttatttgnaccttngtanccacntncngnggcctntgnggnnntctaaatatcnntngtccgctctacntnnaatntcggggggcnccttatactcnggtncacnnnatngnaaaaatnggttgtcctntaactttcttnncaaaatntgcggcagatnntnnttgnggnntantttnnanagcnctnttngtnanntnncnttttggngncaantttatncactntgngaaanancccctcnttatcnntataaccaatttcggnaanatnngtcanatattntacattatcctctaattnntnccccaatangntnanttactctncaaatnnnnctantattcgngnntctatncnanaattntctanananttctntnccantttctgngantntttctgnaannnttcatncgtgcggantannctatgnggacntaaatntttntancccccggannttnttncntaaaaaangataangnctttttccacanactccaacaaantcctngtggannacttaaantnnntcatcnccctcnggnaacatgtctnctntcttnanagtacncatnttggatcnatntanaaaggnaaatnntgatnnggngctctntctacttatcancc

SEQ ID NO: 5813 - DNA, 772 bp, Homo sapiens
  misc_feature 2, 3, 11, 14, 15, 19, 28, 34, 35, 37, 45, 46, 53, 58, 62,64, 65, 67, 75, 78, 79, 80, 91, 97, 105, 106, 108, 110,121, 125, 128, 129, 134, 135, 150, 160, 165, 168, 171, 174,179, 180, 182, 187, 188, 191, 192, 197, 206, 209, 214, 215: n = A,T,C or G
  misc_feature 219, 222, 224, 227, 232, 240, 251, 260, 278, 284, 285, 297,299, 302, 306, 308, 310, 311, 314, 318, 329, 331, 334, 343,350, 351, 364, 439, 440, 475, 488, 586, 629, 649, 659, 673,712, 733, 736, 769: n = A,T,C or G
gnntttctaangcnngctntcttctgcngctccnncnatccgtgnntacacancacgncgangnntntctgactnttnnnctatgtaatangcaggngtagttgnntntntgctgccatgnatgnatnnacatnncatgtgcagtgtctnacgtaatacnctccnatnaanctngttgnncntactnntcnncaacntggatatgncantttgnncagnacnantgntgcanattggaanatgatggcctnactcttacnatgtgattgcctatatgncctctnnaccttgaatacntntgntatncnanncanagtnctaaaggatgncnatnatagcagcnctctttnnaaataaggaaacntccttgaataatgtaaaagcctcatatacaataatgaataataaagaataatgtgaaggcttcattcaaggttgnngtttgccagatcattgcaacaaaatgacagagcanccaacgtatttangatagtggccaaagtattgtaatgatggcttatggagtgtcagctggataaagagtgaaaatgactaaaaactaatggattgttcagtcgaatagcanatggtcaatggtcatggccagtataatagggggacccaaatanaaattggaagacccagtcanaagtgggganttgatcaattccanccaaaagtgggaatgggcaggggaatcggtaggccccanggttccaaaaatgttaccagnggncaattttgttggccccatggtggggaatccaanggc

SEQ ID NO: 5814 - DNA, 710 bp, Homo sapiens
  misc_feature 4, 12, 710: n = A,T,C or G
ttcnaatagctnggctcttgttctttttgcaggatccctcgattcgaattcggcacgagagtggctggataaaaggatgtgtgggaaagaactgagttgaaattaggagttagaattttattctttggtactaaggaatcattgaagattttaaaattagggctgacataatcagatttgagtttgggaacctatagtttgggactggaggaagacaggtgccagacaccagttaaaaagctgttattttctaagcagtagacaaaggtttacactgacaatagctgtggagatagagaaaagctgcgagatttcagagttttccaaggtgtaaacaactaaattttgtgatcaaaatgataagggccatctaataagctggggaatgtgggatctgtcttggttgagttggtggattaactgagattaacagagctggaggaaatgtaaaaagaaaggcaggattgttcattttgtcttttgtttgttttggggaacagggtcaaaattttcattctgcataaggtaggtttagtctttttcaaaacattctagtaggcaagtctgtagctgaatcttggaagaaaggcaaccatagtaatatttttgagttcctactgtttattttttcaataaaaactcaggttctcaggttagcagatcatggtcttaggaaggtagctgtagaacccaaaatataaattcctaan

SEQ ID NO: 5815 - DNA, 710 bp, Homo sapiens; identical to SEQ ID NO: 5814
  misc_feature 4, 12, 710: n = A,T,C or G

SEQ ID NO: 5816 - DNA, 710 bp, Homo sapiens; identical to SEQ ID NO: 5814
  misc_feature 4, 12, 710: n = A,T,C or G

SEQ ID NO: 5817 - DNA, 755 bp, Homo sapiens
  misc_feature 8, 13, 14, 15, 20, 31, 312, 332, 381, 402, 404, 412, 413,416, 437, 445, 472, 479, 497, 510, 528, 530, 533, 536, 538,544, 565, 578, 588, 603, 605, 606, 631, 664, 670, 694, 698,706, 727, 736, 741, 755: n = A,T,C or G
tcttttcnaatcnnntggcncttgttctttntgcaggatccctcgattcgaattcggcacgagagtggctggataaaaggatgtgtgggaaagaactgagttgaaattaggagttagaattttattctttggtactaaggaatcattgaagattttaaaattagggctgacataatcagatttgagtttgggaacctatagtttgggactggaggaagacaggtgccagacaccagttaaaaagctgttattttctaagcagtagacaaaggtttacactgacaatagctgtggagatagagaaaagctgcnagatttcagagttttccaangtgtaaacaactaaattttgtgatccaaatgataagggccatctaatangctggggaatgtgggatctgncntggctganntgntggattaactgagattaacanagctggangaaatgtaaaaagaaaggcacgattgntcatttngtcttttgtttgttctgnggaaccagggtcnaaatttccattctgcatnangtncgntnagtccntttcaaaacattcttacttangcaagtcctgtcnctgaatcttngaaagaaaggcaccntnnctaatatttttgagttccctactgnttaatcttccccaattaaaacctcacgttctcnaggttncccacaacatggcccttacggaangctngcttgtcncaacccaaaactctcacattnccttaaacnttttnccccatttggggcn

SEQ ID NO: 5818 - DNA, 755 bp, Homo sapiens; identical to SEQ ID NO: 5817
  misc_feature 8, 13, 14, 15, 20, 31, 312, 332, 381, 402, 404, 412, 413,416, 437, 445, 472, 479, 497, 510, 528, 530, 533, 536, 538,544, 565, 578, 588, 603, 605, 606, 631, 664, 670, 694, 698,706, 727, 736, 741, 755: n = A,T,C or G

SEQ ID NO: 5819 - DNA, 755 bp, Homo sapiens; identical to SEQ ID NO: 5817
  misc_feature 8, 13, 14, 15, 20, 31, 312, 332, 381, 402, 404, 412, 413,416, 437, 445, 472, 479, 497, 510, 528, 530, 533, 536, 538,544, 565, 578, 588, 603, 605, 606, 631, 664, 670, 694, 698,706, 727, 736, 741, 755: n = A,T,C or G

SEQ ID NO: 5820 - DNA, 761 bp, Homo sapiens
  misc_feature 2, 12, 13, 18, 34, 44, 234, 428, 435, 453, 470, 490, 497,510, 514, 525, 539, 541, 552, 565, 567, 583, 591, 592, 600,602, 622, 634, 637, 643, 658, 659, 674, 681, 694, 695, 698,704, 707, 711, 719, 724, 726, 729, 731, 735, 746, 751: n = A,T,C or G
  misc_feature 752, 754, 759, 761: n = A,T,C or G
cntttctttttnnaaccntttgcctactcgctcnttttgcaggntcccatcgattcgctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacngagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagtttctctggcggcgctggtcctgtctctcattctgccgaggagcagccngtacatnaagtggatcgtctctgcngggcttgcccaggtcancgagttttcctttgtcctgnggagccnggcgcgaagagcnggcntcatcctctcnggaggtgtaccctncnttatacttgantgtgaccacgctnancctcttgctcgccccngtgctgtnnaaaagctncnaatcccgaagtgtgtgcccngacccgaagaanccngtccancctttgatggcttcnnagatgattggacccntggaaangggaacctcttcnnggngaactnaancgcnttaaaatngccananaancngctncctttctcggnaaccnncnccccncn

SEQ ID NO: 5821 - DNA, 761 bp, Homo sapiens; identical to SEQ ID NO: 5820
  misc_feature 2, 12, 13, 18, 34, 44, 234, 428, 435, 453, 470, 490, 497,510, 514, 525, 539, 541, 552, 565, 567, 583, 591, 592, 600,602, 622, 634, 637, 643, 658, 659, 674, 681, 694, 695, 698,704, 707, 711, 719, 724, 726, 729, 731, 735, 746, 751: n = A,T,C or G
  misc_feature 752, 754, 759, 761: n = A,T,C or G

SEQ ID NO: 5822 - DNA, 761 bp, Homo sapiens; identical to SEQ ID NO: 5820
  misc_feature 2, 12, 13, 18, 34, 44, 234, 428, 435, 453, 470, 490, 497,510, 514, 525, 539, 541, 552, 565, 567, 583, 591, 592, 600,602, 622, 634, 637, 643, 658, 659, 674, 681, 694, 695, 698,704, 707, 711, 719, 724, 726, 729, 731, 735, 746, 751: n = A,T,C or G
  misc_feature 752, 754, 759, 761: n = A,T,C or G

SEQ ID NO: 5823 - DNA, 850 bp, Homo sapiens
  misc_feature 1, 4, 18, 20, 24, 37, 443, 481, 484, 513, 532, 549, 560,561, 569, 575, 602, 610, 613, 615, 616, 620, 621, 623, 628,640, 641, 653, 662, 664, 667, 670, 677, 683, 687, 693, 696,697, 710, 712, 717, 720, 734, 736, 737, 741, 745, 746: n = A,T,C or G
  misc_feature 750, 751, 759, 761, 762, 765, 781, 786, 791, 797, 801, 802,805, 822, 836, 837, 838, 846, 848: n = A,T,C or G
ntcnttttgtttttcaancnattngcctacttgttcnttttgcaggatcccatcgattcgctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagtttctcctggcggcgctggtcctgtctctcattctgccgaggagcagccagtacatcaagnggatcgtctctgccggggcttgcccaggtcagcgagtnttncctttgccctggggagcccgggcgccaantagcgggcgtcatctctcnggaaggtgtaccctccntatacctgagnngtgacccncgcctnaagcccttcttgcctcgcccccccgtncctttcgnaananncttnncnatccnccaagggttgtnnttgccccccaanaaccccggnancanaanccgggtncccaancccnttcttnaannggcctttcgggcnanattcnaantggggcccccctcngnnaaangggnnaaannccttcttntnnggnggaaatattgaaaccnccttnaaaanatgggncccnnccnacctcgctccctttttntggggcaaaacctnnngccacccntncg

SEQ ID NO: 5824 - DNA, 1523 bp, Homo sapiens; identical to SEQ ID NO: 5796
  misc_feature 8, 10, 11, 15, 16, 18, 20, 34, 38, 39, 40, 41, 42, 43, 44,45, 49, 65, 73, 82, 83, 86, 91, 95, 97, 105, 107, 113, 114,115, 120, 121, 122, 124, 126, 131, 140, 143, 144, 150, 151,153, 155, 158, 160, 162, 165, 167, 169, 175, 176, 178: n = A,T,C or G
  misc_feature 179, 182, 185, 189, 194, 201, 202, 212, 216, 217, 219, 221,232, 234, 241, 242, 259, 263, 269, 270, 275, 285, 292, 293,304, 313, 314, 324, 334, 337, 341, 350, 353, 356, 363, 365,367, 370, 375, 376, 379, 380, 384, 385, 394, 397, 413: n = A,T,C or G
  misc_feature 415, 422, 427, 433, 443, 446, 451, 452, 459, 460, 464, 467,470, 481, 484, 488, 495, 498, 505, 513, 517, 520, 525, 527,528, 534, 541, 542, 549, 554, 557, 561, 562, 565, 576, 584,585, 588, 591, 602, 604, 608, 615, 620, 625, 627, 633: n = A,T,C or G
  misc_feature 634, 635, 639, 646, 650, 651, 656, 662, 672, 675, 677, 689,694, 700, 708, 710, 712, 718, 722, 727, 729, 735, 738, 740,750, 752, 753, 755, 765, 782, 786, 788, 789, 799, 802, 805,807, 808, 810, 811, 812, 820, 822, 824, 825, 831, 832: n = A,T,C or G
  misc_feature 844, 847, 851, 852, 853, 857, 860, 866, 868, 869, 870, 874,883, 888, 897, 900, 902, 903, 913, 919, 924, 926, 927, 932,933, 934, 935, 938, 939, 949, 961, 970, 972, 974, 976, 982,983, 990, 996, 1000, 1004, 1006, 1009, 1015, 1017: n = A,T,C or G
  misc_feature 1019, 1020, 1028, 1039, 1040, 1046, 1048, 1053, 1057, 1058,1063, 1067, 1069, 1071, 1072, 1073, 1074, 1081, 1095, 1099,1106, 1113, 1116, 1126, 1127, 1133, 1145, 1152, 1153, 1155,1162, 1167, 1168, 1173, 1176, 1178, 1179, 1183, 1184: n = A,T,C or G

SEQ ID NO: 5825 - DNA, 757 bp, Homo sapiens
  misc_feature 2, 8, 9, 13, 30, 570, 623, 637, 640, 644, 666, 670, 677,681, 707, 710, 714, 716, 720, 723, 756: n = A,T,C or G
tnttctcnnctgnaaccctttttctaaagncccttttgcaggatcccatcgattcgggagaactgctcactccttttccctccccatacaaactcaaagtcctttgggccccaattcagagttatgttttttttggcacatactagaaaggcagtgcctcagcccttccctgaatccatggaggtgttctgtttggggctttttagactgctgctgctcagctggttgcttgaactgacagtaggccagcctgttctctgccattccctagtcatcctgtgcctcaccacagcttgcttagagcaagccttttctcagaccttaggcacagcctctcctctttacctgatcaatgttaaatgtaagcacccctgatcccaggacataaggaaagatgcccaattgtacttttgttctatagcctgtgaaatggctagttgatcatttttccacaaagaattaggtgttaagagttttccttcaggctttacttaggagaatggactaagctgaaggtgtacttcaccagcaagagtcaactctagaattcaggatgttccttctattggnttcttagccatctgtcaggaaatgtaaactttggttttattttttggcttatnccaaaggggtaaanccngaanatagaaaatggataattttctnattnaatagcngaancctttttcaatctccaaatatataanggngccncntctnttnaaaagctctaagcctaaagtcaagagctaggant

SEQ ID NO: 5826 - DNA, 728 bp, Homo sapiens
  misc_feature 5, 6, 15, 125, 270, 452, 455, 467, 534, 658, 681, 693, 698,727: n = A,T,C or G
gaggnnttgaagccnttttatagatacaggctacttgttctttttgcaggatcccatcgattcgctctcccgggcttagaaggcccggctactgacgcgcagtgccagaccttacccctcacggnccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcanggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaaagcacanacnacaagaaaccangggaaagaaaaattaagaggcatgctaaaaataattgaggttttcatgattcagcacctgcttttgnttctgtgagatgagctaaatttgctttcataccccagataagagcttaaaacccacctaatgctcttatggcacaactggggtatagaatttaagttctctttatacttcaattctagcccaanttgggttttgattaatataagtngtttaaaccttntcttnataacttgctctgaaatggggaacaaaant

SEQ ID NO: 5827 - DNA, 747 bp, Homo sapiens
  misc_feature 3, 4, 5, 6, 7, 8, 9, 10, 568, 623, 663, 747: n = A,T,C or G
ggnnnnnnnnacgctatgctggctcttgttctttttgcaggatccctcgattcgaattcggcacgagctaggatgacatctggtgtattgactgtggccagtcttaaagctagtttttgctatgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacggtgggtttctcgctgggtgcgacgtgaatttgtgaagctcangatgcccatggattagactcatgtagtagcttaaagagtcattaggcgatagganggagaaaccaagaagttagcagaatctggatataattcantgtccgtaaatcccatgaagagaagctcatcagaattaaggcaatggaatttgtgcccaaaaaaaaaaaaaaaaaaaactcggn

SEQ ID NO: 5828 - DNA, 1195 bp, Homo sapiens
  misc_feature 4, 5, 6, 7, 8, 9, 10, 11, 12, 13, 14, 16, 17, 19, 20, 21,23, 24, 25, 26, 27, 29, 30, 31, 33, 34, 35, 36, 38, 39,40, 41, 42, 43, 44, 45, 47, 48, 49, 50, 52, 54, 55, 57,59, 60, 61, 62, 64, 66, 67, 68, 69, 73, 74, 81, 83, 86,87, 88: n = A,T,C or G
  misc_feature 89, 90, 92, 94, 95, 99, 101, 107, 113, 114, 125, 142, 144,149, 153, 154, 159, 160, 182, 189, 192, 193, 194, 195, 198,199, 201, 203, 204, 205, 208, 209, 210, 211, 212, 213, 215,216, 218, 219, 221, 222, 226, 230, 232, 238, 245, 246: n = A,T,C or G
  misc_feature 250, 255, 258, 261, 263, 264, 267, 270, 273, 274, 276, 278,279, 281, 286, 289, 300, 302, 311, 313, 315, 316, 317, 321,322, 323, 326, 327, 329, 331, 332, 334, 336, 338, 341, 342,343, 345, 355, 356, 359, 361, 362, 363, 365, 366, 367: n = A,T,C or G
  misc_feature 371, 372, 377, 381, 383, 384, 386, 387, 388, 389, 391, 392,398, 403, 404, 405, 407, 409, 410, 412, 413, 415, 416, 417,419, 420, 421, 423, 424, 428, 432, 434, 436, 437, 438, 439,443, 444, 450, 451, 455, 459, 465, 467, 468, 469, 472: n = A,T,C or G
  misc_feature 474, 476, 478, 482, 485, 486, 490, 491, 492, 494, 503, 504,507, 517, 519, 520, 521, 523, 526, 529, 530, 531, 532, 533,534, 536, 537, 539, 540, 541, 544, 545, 546, 547, 551, 552,553, 554, 555, 557, 558, 559, 560, 561, 566, 567, 568: n = A,T,C or G
  misc_feature 569, 571, 573, 575, 576, 577, 580, 581, 585, 590, 591, 598,600, 602, 604, 608, 609, 613, 615, 616, 623, 625, 626, 629,630, 631, 634, 635, 639, 642, 643, 644, 647, 649, 656, 660,663, 665, 666, 673, 675, 676, 678, 683, 687, 688, 691: n = A,T,C or G
gggnnnnnnnnnnnannannnannnnngnnngnnnnannnnnnnncnnnnanannancnnnncnannnnaggnngaggagnangannnnnancnntttnancccccntttttnnctaaaaaaagnacccttggggttaaaancnccccnttgnnccccnnaacacgagaaaaaaggggggcnggggggnggnnnnagnngnannnccnnnnnncnncnngnncacnaggncnggagcnaagaagnnaacnttttntancangnnaanccnatnncncnnanagcanccncggggggaaancnggaagaccncncnnngggnnnaannanannancnancannngngagcaaacannganannnannnggcnnaagcnaacncnnannnnanncccagncacgnnncncnngnncnnnannnannaccnacancncnnnngacnnaagaannacgncaanaaacgnannnacncnancncagnacnnagcnnnanaacacccanncanaaccaaaaanannncnatngcnnnnnngnnannnccnnnncaannnnncnnnnnccgcnnnnanancnnncanncagncacanncgcacancnancnccannagananngcccaancnnaannncannaggncannnacntnaaggcanacanacngnncagcacncnnanacgangccnnagnganccacacanncgnannncnnnnnnnacgnaaanancangacgngcnnncangcgnacanaagananaacnnacganccnannnaaacancagcnancannannannnanngcnnncnnnngannncnngnncgacanacananannanngnngancccnnagacnanngacnaaancannacgangacangcgngcancnactcaannannagnacncccnanaacnacncnnaccnncgcngacacnaccaaanaannaacancacnannaacnganaanacnaccnccgcnnngnccganccnagcncncnncagncnnaaccnnannaccannnncannncncccncgagccgnccngacanacacncagaaccnnnnnacaacaanacncncatcanannngncnnccacnanntncncacgacnancgcanacnncgacnnancnnngnantnncagcgacagcgnanacncntacnngnnaacnncnnnncgnccg

SEQ ID NO: 5829 - DNA, 735 bp, Homo sapiens
  misc_feature 13, 118, 638, 655, 673, 684, 691, 703, 707, 713, 735: n = A,T,C or G
gcaatgtgctctngtctttttgcaggatccctcgattcgaattcggcacgaggccttttgtggggtctcatacataactcagtttccacaaagctgtgccccagctcagccctatggntagaagcatggtctggggttcctttgctgaccagggtgtgtgctttgtccaagttactgaccttcccaaacctcatcaatgcacataaaaagagcacttgcaaacaatgaatctagacatggaccttcacaaagaaataactcaaaatggatcccaggcctaaatgaaaaatgaaaaactataaaactcctagaagataacataaaagaagatctagatgacctagggtttggcaatgactttttagatccagcaccaaaggcaggatccaggaaagaaataattgataagctggacttcattaaaacgaaaacttctgctctgtgaaagatgctgccaaaaaatgaaaagacaagccacagactgggagaaaatatttttgatggaaatatctgagaagagaggcttgttatccaaaatatacaaagaatttctaaaactcaataatttgaaaataaacaacccaatttaaaaagtgggccaaagatcttaaatgacgccttaccaaaggaagatcccnggatggcaaaataagcntatgaaaagatgcttccnggctgggcacngtggctnacgcccgtaatnccancctttnggatgccaaggcaggcagatcn

SEQ ID NO: 5830 - DNA, 1497 bp, Homo sapiens
  misc_feature 2, 6, 7, 8, 12, 28, 36, 37, 39, 45, 52, 56, 57, 60, 63, 66,68, 69, 71, 79, 85, 87, 90, 92, 95, 97, 100, 107, 109, 112,116, 117, 124, 133, 140, 145, 148, 149, 151, 153, 154, 156,161, 162, 166, 169, 170, 172, 173, 175, 179, 181, 182: n = A,T,C or G
  misc_feature 183, 184, 185, 193, 194, 198, 199, 202, 203, 204, 206, 212,219, 221, 224, 230, 232, 233, 238, 239, 241, 243, 245, 251,254, 261, 265, 274, 277, 278, 284, 287, 296, 297, 301, 303,304, 309, 310, 315, 316, 324, 325, 326, 340, 347, 348: n = A,T,C or G
  misc_feature 349, 351, 355, 357, 358, 360, 362, 364, 368, 370, 371, 377,378, 380, 383, 384, 385, 398, 401, 402, 403, 404, 405, 408,411, 417, 418, 419, 420, 427, 431, 432, 433, 434, 437, 439,440, 442, 445, 447, 448, 453, 457, 458, 459, 462, 464: n = A,T,C or G
  misc_feature 465, 467, 477, 500, 502, 507, 521, 524, 529, 530, 533, 535,536, 538, 542, 549, 551, 560, 562, 564, 569, 570, 580, 588,593, 602, 611, 613, 614, 619, 620, 623, 627, 634, 638, 639,641, 646, 651, 659, 664, 665, 667, 669, 673, 682, 698: n = A,T,C or G
  misc_feature 705, 724, 726, 738, 739, 749, 756, 757, 770, 773, 776, 777,781, 791, 803, 806, 807, 816, 817, 819, 820, 821, 828, 833,835, 837, 843, 844, 851, 861, 870, 871, 872, 875, 880, 889,901, 904, 906, 908, 929, 930, 932, 940, 945, 949, 958: n = A,T,C or G
  misc_feature 966, 970, 972, 977, 988, 991, 993, 995, 997, 1001, 1008,1020, 1024, 1036, 1038, 1039, 1042, 1044, 1046, 1051, 1056,1057, 1059, 1062, 1063, 1064, 1065, 1074, 1085, 1090, 1093,1097, 1099, 1114, 1115, 1120, 1121, 1126, 1134, 1136: n = A,T,C or G
cnttcnnnttcntgaacctttttttccnattccccnntnatctcncgtaatncccnncanganttncnncngcatcccnacttantntcntntgngngcncagaagntncgngacnnttttttngccccccanactgcgngtttntannangnnancgccnngtcngtnntnncnttgncnnnnnatatccanncctnnctnnntnccctancgcacantntcncaatantnnaacgnncnantnaccctnccnatccacntcanagtaaaatnctnncaattncancattagtgnnttcnannacctnnccgtnnatatctgnnntccatccacaaagnccaatcnnngnatcncnntntnantatncnntagagnncnccnnntcccatctatcgnctnnnnnatnctnggaccnnnntcccatnccannnngtnanncngantnntgtgncacnnntgngnncngcatctcaancatcatctcgtctcttgacgatntncttantcggcgcattaggntcnatcgnntantnngntcancacctantntaatctcantntnatcanntctacctatntcatatcngccanacagtctcnctctaaatncnncgcanngcncatntatcaantcannanactcntatanctcacatntctcnngngncatntactctccnagctctgtcatttttntcatctntctctctgatacagccacntnggaaaactagcnnctcactcacnatagccnnatctatacgctcnctntcnncagngactcgatanatgcgtgcgtgntcnntctatagcnncnnnctcattngcatnananatctcnntcgcgcnactgttgtcntcatcttgnnncantacantgagaagtnttatatatagcnacnananatatagactcatctcactacnnangacgcgangctanactntacttatanacctcacnattngncactntacttatactntcncntntntganacggctncagtatatcgcngggntctcacttactntnngcncntncactntcctnngngcnnnnaacagtatntacactctatnaatcncanacgncnactgctccattctgnnccaanntctcntctcgcancnnnntnnnnntcgnatnngcncgatcattgncnnnnatngngtcnctctncannactnctctctngncngccanccacnnngnagcntctcnnctatnncgatcntnngncactnantaaacctcatcacatcntcntctctccncncntnnnanatctaccctnntnttnaatgcntnatgtnactccacgantatntcncactttatcnntntccnctntatcgnnnctctnttancagtctcnacttattngctctnnngnccnacnnttnagcctcnccgnttnatactccntcncnatgtccgntccncgnagcnncatangngnntnnnntatcntatacgntncanantcgacnt

SEQ ID NO: 5831 - DNA, 769 bp, Homo sapiens
  misc_feature 17, 21, 31, 34, 587, 674, 723, 727, 742, 753, 765: n = A,T,C or G
tttctaaatggcttggntctngttctttctncangatcccatgcgattcgaattcggcacgagcccagagaagagcttttcagagaaaggtacagacaagaagctagaaagagtggaaggagcagcagtcttgcaaggaagcagggcagagacacagcccatggcccctcactgccctgctggaagggctgatggagctccccgcacatggttcctgcctgggtgacagaggctcctgtggccactttagaagtgcggtttactcctcatgccgagatggaccttgggcagctcagttcacaagatgttggtcaggcgtcatttaaatattttcagtcagcagaggaagcaaagcgtgccattgaggcttgtgctgtcagcggatcctcggtctgtgtaccgccggaagctttgccaggaccgccttttctactttactgtagacatagcgcatgtcacttgctggtttggtgatggctttgcagaggtgctgaggatcaagccggcttctgagcctgttcatatgactggccctgtggggtccttggtgtctctggggtcttaaggagcctcctcatgtctttaangtagcatcattgatctttggatgtggcttttggattttctgaacaagctaatgttgtgtcaaagaaccaccactttgtgatctcatnggctttgattgatttgggcttgttcaaaatggttatttgaaaaaacgtntacntttaataaaacttancaaagagattntaaaatcccganaaaa

SEQ ID NO: 5832 - DNA, 795 bp, Homo sapiens; identical to SEQ ID NO: 504
  misc_feature 7, 15, 16, 23, 25, 45, 478, 491, 518, 524, 567, 578, 597,611, 639, 645, 670, 679, 686, 690, 705, 723, 733, 755, 756,771, 773, 777, 793, 795: n = A,T,C or G

SEQ ID NO: 5833 - DNA, 737 bp, Homo sapiens
  misc_feature 6, 11, 13, 14, 15, 16, 27, 28, 35, 39, 40, 41, 42, 43, 91,124, 135, 146, 156, 160, 167, 192, 193, 285, 295, 334, 343,350, 368, 369, 372, 383, 397, 461, 464, 493, 497, 500, 501,502, 524, 535, 537, 552, 556, 563, 577, 581, 600, 611: n = A,T,C or G
  misc_feature 629, 640, 653, 666, 668, 673, 675, 679, 680, 691, 695, 702,703, 704, 708, 724: n = A,T,C or G
ggaatngcttncnnnngctcttgtgcnngatcccntatnnnnngcgccaccgtgcctggctggacatgtcaatttgaagtgaatggttaancatccagctagctgaaagcatggcagaccctancagaaaagctncagtgtgtttntgcagctatnaagngaatggnttcctggggaaaattgtgactttgnntaactgttgttgaaaccagaataaattatatttcacttgcatatgcataaattattaaaattttcagaagtcagtgatacagaagtactatnttgcaatgtnaatctgcttgagtctttggagaaagtggtttcattgtangtacatagngcactgntaatattttaaacaagtnnttnactcttccatntaagggatagcatntccttgtataaaatgactggatgtgtataaaggaattatgttgtcatgtgcctttaaccagctntantcattactataatctgatatttatgatanttcnggnnngtgacaggaccatatgaaaatntcttatgtcancncatcactttagattntatnattatgnacattactggggtnttancctttgctaatgtgaagcnttcttccctantaagtctacattaccttntgctcatttanatcatatatcacnataactttataantnatctnanaccnngcccttgcctnttanactttcnnncgcncattaccgtagatccngacatgataagaa

SEQ ID NO: 5834 - DNA, 772 bp, Homo sapiens
  misc_feature 5, 9, 12, 13, 15, 19, 32, 35, 36, 38, 41, 43, 48, 50, 153,573, 609, 669, 670, 688, 699, 734, 740, 746, 748, 758, 771: n = A,T,C or G
tttcntaantgnntnggtnctcgttctttctncannangcncntgcgntncgaattcggcacgagcccagccctagatactggcactactgaggaggatcgtttaaaaattgatgtaattgactggttggtatttgacccacgcagagggcanaagcactgaaacaaggcaatgcaattatgagaaaattcttggcatcaaaaaagcacgaagctgcaaaagaagtatttgtgaaaattcctcaggattctatagcagaaatctataatcagtgcgaggaacaaggaatggaaagtccacttcctgctgaagatgataatgctatccgagaacatttgtgcatcagagcttatttggaagcccatgaaacctttaatgagtggtttaagcatatgaattcagttccacaaaaacctgctttgatacctcaaccaacttttactgagaaagtggctcatgaacacaaagaaaagaaatatgaaatggattttggtatttggaaagggcatttggatgccctaactgctgatgtgaaggagaaaatgtataacgtcttgttgtttgttgatgganggtggatggtggatgttagagaggatgccaaagaangaccattgaaaagaacacatcaaatggtcttacctgagaaagctttgtctgcccatggtnngttttctggttcataccnatattgccaantactggtcaatttcaggaatgcctacagttaccantatggnatcctntnagcgccacanactggacctggtnt

SEQ ID NO: 5835 - DNA, 828 bp, Homo sapiens
  misc_feature 11, 20, 27, 29, 72, 73, 84, 85, 90, 92, 97, 99, 120, 128,132, 207, 213, 290, 299, 415, 418, 440, 471, 489, 497, 508,520, 531, 532, 543, 544, 549, 558, 571, 581, 587, 590, 592,620, 630, 637, 647, 659, 683, 687, 689, 692, 694, 696: n = A,T,C or G
  misc_feature 699, 701, 702, 709, 712, 715, 722, 727, 729, 735, 736, 738,741, 746, 755, 760, 761, 768, 770, 784, 785, 803, 804, 813,827: n = A,T,C or G
tctatcccttnctcaatccnttatccngntctttgcaggacccatcgattcgaattcggcacgagaaagcannaaaaaaggaanncacangnttttntncccaaagttgttttctagatntgtggctntaanaaaaacaaaacacaacaaacacattgtttttctcagaaccaggattctctgagaggtcagagcatctcgctgttnatttgntgttgttttaaaatattatgatttggctacagaccaggcagggaaagagacccggtaattggagggtgagcctcggnggggggcangacgccccggtttcggcacagcccggtcactcacggcctcgctctcgccttaccccggctcctgggctttgatggtctggtgccagtgcctgtgcccactctgtgcctgctgggangangcccaagctctctggtggccgnccctgtgcacctggccaggggaaagccccgnggtctggggcctcctccnactgcgcncactttgcaanaataaactctcncctggggtttnnctatctttggnnctctnaccctggtnaagaaacgccaangtggttcccnaaacgnctntncttgcaagaacaaaagtacccccttgcnacccttcctnatgggcntcaacgaatntaagggaagggnccccccaaggccccctttcctggngttngnccngntnaantnntttgggnccngcnttttccnaaacntntttatnngngtnccaanccccttaangccanngttcccngnggggaacaaccaannggcccctcaagccccaanngcccctttncggggggccccccnt

SEQ ID NO: 5836 - DNA, 1499 bp, Homo sapiens
  misc_feature 3, 5, 8, 14, 22, 25, 27, 52, 60, 62, 75, 86, 93, 95, 100,102, 103, 107, 119, 123, 126, 129, 130, 131, 134, 137, 142,144, 155, 165, 170, 175, 179, 204, 206, 216, 233, 234, 236,240, 243, 245, 246, 247, 248, 254, 255, 256, 261, 264: n = A,T,C or G
  misc_feature 269, 270, 280, 284, 296, 297, 300, 317, 319, 324, 344, 345,346, 354, 357, 360, 362, 365, 367, 372, 384, 395, 403, 409,415, 418, 420, 432, 433, 434, 437, 441, 442, 445, 462, 465,466, 467, 473, 476, 479, 484, 488, 492, 493, 498, 505: n = A,T,C or G
  misc_feature 511, 516, 517, 519, 539, 541, 546, 554, 567, 568, 569, 573,575, 577, 579, 584, 590, 601, 604, 607, 608, 615, 633, 638,640, 653, 662, 663, 665, 668, 669, 672, 679, 687, 692, 698,703, 717, 719, 722, 737, 749, 758, 768, 771, 773, 775: n = A,T,C or G
  misc_feature 780, 781, 782, 788, 805, 809, 815, 819, 820, 831, 832, 838,841, 844, 845, 847, 849, 857, 859, 869, 873, 876, 879, 883,885, 896, 903, 925, 927, 931, 932, 934, 943, 945, 956, 957,959, 966, 967, 970, 973, 974, 977, 980, 982, 983, 988: n = A,T,C or G
  misc_feature 990, 992, 995, 1006, 1018, 1026, 1038, 1044, 1057, 1062,1063, 1075, 1083, 1096, 1097, 1117, 1131, 1132, 1133, 1138,1143, 1146, 1151, 1162, 1164, 1167, 1168, 1176, 1193, 1204,1209, 1212, 1214, 1225, 1226, 1230, 1245, 1248, 1256: n = A,T,C or G
  misc_feature 1262, 1265, 1275, 1285, 1287, 1290, 1297, 1301, 1305, 1307,1312, 1322, 1324, 1328, 1334, 1335, 1354, 1358, 1359, 1364,1373, 1390, 1415, 1428, 1436, 1444, 1448, 1462, 1464, 1470,1471, 1489, 1492, 1495, 1497, 1499: n = A,T,C or G
cancncancaccanacacacantcncnctttttcactttttttttccccaanaaaccgancncgtttcccccacngtctcaacccnctacacncngcgcnanncgcnacacacccccgncaancanccnnnctntcnacacncncaactacactncatacactcnctacnctacncacncacatacaacaacaccacacatccncntaacacacanacaccaccaccaaatcnnancccnccnannnncaacannnccatncanacacnnacaccacacnccancacccacctctnncanccacacccctatctccncnacacnaccacaccaccccgcaaacnnncgccccantcncantnccncncacanacacacacacancctcaccaccnacacccanacacancccccnacncncaccacccaccnnnccncccnnccnccaacactacaccaacnccnnnatcaanccnacnaccanccanaccnncaccncccctcnaccccncaccnnancacctcacacccccacccancnccacnaccccaanccaccccccacannncttntnananaacanccaatncccccaccccncancanncaccacnacaccccccccccctaanccacncncacccccaccccncacccctanncnacnnccnccccacnaacaaccncaccnacaccncaccntcccccccatctcntnacncccccgcctcacccnaacccacatctnctcccacanctccaacacnccncnanacacnnncacacncacaacaccctctctcncacnctacantcanncacatacacanncatcantcnctnntncncccaactncncactaacctngcanccnacnctcncnctcctcaccantcgcacncccacacccctacccatactcncntccnntntacaccatnancacaccacacnntncaccacnnccnacnncanccncnntacancncncancaccacacctnacgcacaccctnatccacancacgaccacacncccctnccacaaaccacangaccnncccctacacatntaccacgncctaacaccaacnnactctctaccacgacaatcncctctcaaaacacnnnatctntatancancccancacgtcacacncnctnnaacaaccncacatccagtcaacatnaaccacacatncccancantncatctcacccnntacnactcactccactacnccncctctccnaccacnccncctccctatncaacactcancntcnaacactnctcncccncntcccnccccaccacncntccngcatcnncaacacccacctacaccancacnncaccnccccccccnacccacacatcccccantaccatcaacaaacacataagcatnccactcccaccanaccacccnatatactntacncctctccccacacncncccccnnaccatctcacccccctcnccnccncncn

SEQ ID NO: 5837 - DNA, 1576 bp, Homo sapiens
  misc_feature 2, 11, 16, 18, 30, 39, 44, 53, 63, 67, 68, 70, 71, 74, 83,86, 87, 101, 117, 122, 127, 130, 140, 144, 146, 151, 157,159, 160, 164, 166, 174, 175, 181, 186, 193, 194, 195, 200,205, 213, 229, 236, 243, 246, 255, 258, 261, 262, 263: n = A,T,C or G
  misc_feature 264, 274, 286, 289, 290, 294, 298, 309, 314, 321, 324, 325,328, 332, 333, 335, 343, 345, 348, 360, 361, 362, 369, 370,377, 378, 380, 382, 384, 391, 394, 402, 405, 411, 418, 419,425, 429, 431, 437, 442, 447, 450, 465, 466, 474, 480: n = A,T,C or G
  misc_feature 481, 483, 486, 492, 504, 507, 513, 514, 517, 519, 522, 531,534, 535, 536, 541, 560, 564, 565, 569, 580, 581, 583, 586,590, 592, 599, 637, 640, 642, 644, 645, 650, 656, 657, 665,668, 669, 674, 682, 691, 693, 695, 714, 715, 725, 731: n = A,T,C or G
  misc_feature 741, 745, 761, 766, 787, 793, 796, 800, 812, 832, 835, 839,843, 854, 856, 858, 865, 866, 867, 870, 881, 882, 896, 899,900, 903, 909, 913, 923, 929, 930, 942, 950, 952, 953, 954,959, 965, 973, 982, 985, 1005, 1006, 1010, 1012, 1015: n = A,T,C or G
  misc_feature 1020, 1023, 1030, 1038, 1040, 1042, 1050, 1054, 1057, 1061,1065, 1070, 1080, 1086, 1087, 1090, 1091, 1097, 1108, 1121,1123, 1127, 1128, 1140, 1148, 1157, 1161, 1164, 1165, 1166,1168, 1177, 1178, 1179, 1188, 1195, 1197, 1205, 1207: n = A,T,C or G
  misc_feature 1216, 1219, 1227, 1228, 1229, 1233, 1237, 1238, 1247, 1256,1259, 1261, 1266, 1269, 1274, 1275, 1280, 1297, 1302, 1316,1318, 1319, 1320, 1332, 1336, 1337, 1342, 1343, 1356, 1364,1367, 1374, 1384, 1386, 1387, 1388, 1393, 1395, 1402: n = A,T,C or G
gncctccctcntcttncntttttgtttttngtttttccnaatcncctttttcngccacatttnttgnncnnggnatccccatncgnntttcggaatttcgngccaccgtagtagtangggtnggggngtnctgggcccancatnanggtantcctcntnntcgngntttcttgnnctctanagggngtgtacnnncactngtctnatgggccntacgcaattctaatcngttcacnatgtcancancatcatgcnacnctnnnntacttctgcnaacctacctctnccnnttcncaangccactggacnctcantcacctnctnnacnacanngntttcccancncgnccttcttcattnnnctccatnncactttnncncncnctcacantcntcccatcnttntcccanccactcnnccacancctncntctaantcttnatcanatntcactctcattcatnnttcacccnactgtnnancantcccgnctctacatgtcntanccgatnntcntnctncaactcatncannnccttngcgccttatcaaatactcntacnnactnttaccctactnntnctntcancntctactntccctctcctccttctatctcaccatacacctctatcngancntnncatcnctatcnnctatccanacnnctgtnactcgctntcactctcntntnttctctcgcactaacatanntcaatcccanctctcntacctgtcantccncagctctgatctctcncgtanaactcctactctactacactntctacnctntctntacgacacacgncagctcactctccactactnctncctncacncctctccgagncntnctctccnnntcnactactatctnnaacgtcgcttactnacnntcnctccanattnagttctccanctgtanncatctcgctttnacactcancnnnccctnactcgnactctcanactctctcngcnctatctcacacaattccgtnnctcnancanacacnacnatacgtngcttcatncncntcaagtanattncancatnatcnctatntcttctatanctattnnganncatacnctcatcggcanctcacactctatnanctcnntacacacccagngtcatacntcttctgcnagtntcnnncntcgacgcannnccatctcancactcananttctcacngnacgtacacnccnatctctcnnngccnccanntgactcatnacctatctntcnanctctncgntctcnnctccntctctatcctctctacnctctntctcttacgctccncnnntcatctaactcntacnntcacnnctctacatcttcntcatctcntcntctatanttcttatcgntnnntactncnaccagcntctgctatccttgcttgnactccncnncatcgaccncnctctcatngntccacatcntcntctntntactcgtcatcactctccnacnccnatatatctnttatcctnanancncnncaccgcagngcaccactcanntcnnatncntntannacnntcccacntctgaccnct

SEQ ID NO: 5838 - DNA, 796 bp, Homo sapiens
  misc_feature 2, 3, 5, 6, 7, 8, 9, 13, 14, 19, 22, 47, 48, 49, 51, 53,56, 59, 63, 65, 122, 741, 760, 764, 779, 790, 795: n = A,T,C or G
gnntnnnnntttnncctanacngaatggttgggttaacgccctttcnnnangnagnccngcgntncgaattcggcacgaggccaaatgccggaattcaaaacctggcttttaaaaagaatgnttttgaacaaggcgaattatatttgagagaaaagtttgaaaattcaattgaatccctaagattatttaaaaatgatcctttgttcttcaaacctggtagtcagtttttgtattcaacttttggctataccctactggcagccatagtagagagagcttcaggatgtaaatatttggactatatgcagaaaatattccatgacttggatatgctgacgactgtgcaggaagaaaacgagccagtgatttacaatagagcaagattttatgtttacaataaaaagaaacgtcttgtcaacacaccttacgtggataactcctataaatgggctggtggtggatttctgtctacagtgggtgaccttctgaaatttgggaatgtaatgctttatggttaccaagttgggctgtttaagaactcaaatgaaaatcttttacctggatacctcaaaccagaacaatggttatgatgtggaccccagtccctaacacagagatgtcttgggataaagagggtaaatatgcaatggcctggggtgtttgtgggaaaaagaaccaaaccgtatgggttcgtgtagaaagcaaccggcattatgccttcacatactgggaagggccantgggtgccagtagtgtccngctnggcccttccttgaanaactggattcnaaagnt

SEQ ID NO: 5839 - DNA, 815 bp, Homo sapiens
  misc_feature 2, 3, 4, 6, 26, 31, 40, 50, 61, 66, 68, 508, 522, 673, 708,716, 744: n = A,T,C or G
tnnncntttcctaatgctttcctaantggcntgggttctngttctttctncaagtatcccntgcgntncgtataatctgggggtacagagcaaggaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattctccgagcttcgcaatgccgctaaggacnacaagaagaagaangacgctggaaagtcggccaagaaagacaaaagacccagtgaacaaatcccggggcaaggccaaaaagaagaagtggtccaaaggcaaagttcgggacaagctcaatacttaatctttgtttgacaaagctccctatgataaactctgtaanggaagttcccaacttttaaaccttataacccccancttgtggncctcttgagaagacttggaaagattccnagggttcccttgggccaggggccagcccctttaaggagcttcctttaattaaaggaccttattcaaaaccg

SEQ ID NO: 5840 - DNA, 753 bp, Homo sapiens
  misc_feature 2, 3, 4, 5, 7, 20, 25, 29, 38, 103, 110, 357, 374, 387, 391,416, 511, 528, 554, 597, 598, 638, 680, 682, 684, 685, 688,706, 720, 728: n = A,T,C or G
tnnnncnttgacggatcttngcagnactnaacggcaanttccctctttttgcaggatcccatcgattcgaattcggcacgaggagtaagggcaggggcctaanaaacagnttttgttgggtcttgaggcaaaaaaagaagaaaatcttgctgattggtattctcaggtcatcacaaagtcagaaatgattgaataccatgacataagtggctgttatattcttcgtccctgggcctatgccatttgggaagccatcaaggacttttttgatgctgagatcaagaaacttggtgttgaaaactgctacttccccatgtttgtgtctcaaagtgcattagagaaagagaagactcatgntgctgactttgccccanaggttgcttgggntacnagatctggcaaaaccgagctggcanaaccaattgccattcgtcctactagtgaaacagtaatgtatcctgcatatgcaaaatgggtacagtcacacagagacctgcccatcaagctcaancagtggtgcaatgtggngccgttgggaatcaagcatcctcagnctttcctacgtactcgggaatttctttggcaggaagggcacanngcttttgctaccatggaaaagcaacggaaaaggcttgcanatcttgacttaaatgctcaggatatgaagaactccggcaatncngnngtnaaggaagaagacggaaangaaaaattcaggangagacttncactccatagaagctttattctgcc

SEQ ID NO: 5841 - DNA, 711 bp, Homo sapiens
  misc_feature 8, 12, 13, 42, 549, 550, 619, 676, 696, 707: n = A,T,C or G
tggtttanatcnngctcttgttctttttgcaggatccctcgnttcgaaaaattttatggacttctatggatatttcttgatgcttagagatttgtttttttaattgcaaatgtgaattgtctatttacaaatgctattacatatggagcgggcctgtggtgtatggcactattccttggactaatggtacccaggttccattctctgctcagctcggtggctctagacaaagcccctaaaatgctgtctgcttcagtctccttaatggtgaagtggaaatgaatacctactgtcacttaactcatggagatgctggactgataattagatcatgtaagagcactttgagctgtattgaaaaatatgttgtctcaaattaagtagagtctatggttttgtaaatataaatatattgccagaaaatacatcactgggggagcaaaacatgtagaccaaatataacagggattagtaacatcagtaaacatagttgggaaaagatggcactaaagaaagccaagaagaaagtgttgctcttgtaaaccaaannaaaaaaaaaaaaactcgagcctctagactatagtgagtcgtattacgtagatccagacatgataagatncattgatgagtttggacaaaccacacctagaaatgcatgaaaaaaaatgctttattngggaaatttgggatgctatngctttatttgnaccc

SEQ ID NO: 5842 - DNA, 786 bp, Homo sapiens
  misc_feature 1, 3, 8, 9, 14, 15, 17, 28, 37, 41, 44, 67, 101, 111, 204,248, 376, 399, 469, 491, 527, 537, 549, 563, 575, 581, 597,605, 626, 646, 649, 656, 658, 661, 671, 674, 677, 682, 689,725, 726, 731, 734, 745, 747, 754, 755, 762, 769, 778: n = A,T,C or G
  misc_feature 784: n = A,T,C or G
ngntttanntattnncnttgcgctttgngaacttccngcanganttcgcgattcgctgaaatgtcanacacggccacctaggcagcatttacaagcaaganttttctgctnttttgatgtatatcttaagcgcccccagtgaatgaacagcatataactccacataaaaatcattaaatgtaattgacttccagagcaggcagntctgttgtatgcctctggagaaggctggctgaattggaattggnctgtaccttctgcctatcatgtacatgaggcttttgggcaaagagaactttccacaaaataagtccaaaaattatagatcatcagacaaccaataacatattgatgagatatctccaagatctagaancgtcctgggtgtcaaggaagtcntttggggtttttacaaatattgataatgcactttctataaaatgcactttttataaaaatgcatgctcanttgagacaacttgaaaaacacnaagaaaaggcccgggccgtagtggctcacgcctggnatcccagcantctgggaggccnaaacggggtggatnaccgaaggtcangagaantgagaccatcctggcnaacatggngaaaacccccagactctactnaaaaaatacataaaaattancanggtgtangntgncggggcgccnatnagncccantctactnaaggaggcctgaagcaggaagaatggggtggacccnnggaanacngaaccttgcantnaaccggnnatcccgncactggnacctatagnctgggngg

SEQ ID NO: 5843 - DNA, 1251 bp, Homo sapiens
  misc_feature 12, 25, 27, 43, 59, 64, 82, 88, 90, 94, 104, 111, 112, 113,117, 118, 119, 121, 122, 127, 128, 129, 134, 135, 136, 137,138, 141, 143, 144, 145, 146, 153, 155, 157, 160, 161, 162,164, 168, 170, 178, 180, 182, 183, 185, 187, 189, 192: n = A,T,C or G
  misc_feature 197, 203, 204, 206, 207, 212, 213, 219, 222, 226, 231, 232,233, 238, 246, 252, 263, 265, 270, 271, 272, 275, 277, 284,290, 293, 295, 297, 310, 311, 313, 316, 317, 320, 322, 339,342, 348, 349, 355, 356, 357, 360, 361, 362, 367, 374: n = A,T,C or G
  misc_feature 375, 382, 385, 389, 390, 392, 393, 399, 409, 412, 414, 416,421, 423, 424, 425, 429, 431, 433, 434, 436, 437, 441, 445,447, 453, 456, 468, 469, 471, 473, 475, 483, 486, 498, 500,504, 508, 510, 517, 518, 519, 525, 529, 532, 533, 534: n = A,T,C or G
  misc_feature 538, 539, 541, 542, 543, 547, 549, 551, 553, 557, 558, 563,571, 572, 576, 578, 581, 583, 586, 587, 589, 595, 598, 601,602, 607, 608, 609, 613, 619, 621, 622, 625, 628, 633, 635,644, 661, 663, 666, 668, 689, 691, 695, 698, 705, 710: n = A,T,C or G
  misc_feature 712, 714, 723, 727, 732, 738, 753, 754, 759, 760, 770, 776,785, 788, 792, 800, 802, 803, 804, 809, 816, 817, 820, 827,832, 837, 842, 843, 846, 852, 853, 854, 855, 859, 861, 865,869, 874, 875, 876, 889, 890, 900, 903, 904, 910, 919: n = A,T,C or G
  misc_feature 921, 922, 929, 934, 949, 950, 954, 958, 961, 964, 968, 971,973, 974, 976, 982, 985, 987, 996, 1013, 1017, 1019, 1023,1027, 1030, 1035, 1049, 1050, 1052, 1055, 1059, 1064, 1067,1070, 1075, 1085, 1086, 1097, 1105, 1111, 1118, 1122: n = A,T,C or G
acgagggggctnccccttttttttngnaaaaaaaaaccccccntttttttggggggggnaaagnttgggggggctttttccnaaaaancncccnttttgggcanaaaaaannncccnnncnnacccnnnaccannnnncanannnngggggcncncncgnnncnacancncggccacnancnnanancnggngtggntcacannannacggnngggggntcnccanccacnnngggtnctctatcncggggngcggggggccncnggggnnncgngnatcaccntggggnggncncncacccgggggggnncnccnngcngngccacccataggggggncanaatggnngccccnnncgnnncacanccaaggnngcacacntancccnnannacaccncccacacctnctncnanaaccnannnacanancnncnnaccnaacncnacccancanccacccccaccnncncncncacccacnacncaacccctccancnaccncccnanaacaaannncccccnacantcnnncccnncnnnaacncncnancccnnacaanccccattnnaccnanacncncanncnactaanacnctnnccacnnnacanaaactntnnacncanccacncnacccccccncaaccccacccccaacnanacncncctcccccataccacaacacntnccanctnacccctnaaacnanancaaacatanaaanccacnccaccncaacccaccaacacnnctaannccaccaacanaaaccnccaccacanacnaccncataccancnnnacacnatcaccnnacnacaccanacccntactncaccnntcnatctcnnnncatncnctancacnacacnnnaacctcacacacnncataccccancannacacantctatacancnnctcaacnacccncacatcctattactnnacancacnccnatnctcnaancnncncacaanacncnaccaacacncaaccatctcacatctncacncnaacnacancantctcncccaacacaaatcnncnccnaacnctccncanacntacancatacacacnnactacaacgcnccaccccnctctcncaacacncacnntcatnnacncacntccnanacnctnncacaactaacatncccacnanacacacnananacacacccannncaccannacaccnaaccntcacaccacnactactnncaanctnnncncacatnncncc

SEQ ID NO: 5844 - DNA, 787 bp, Homo sapiens
  misc_feature 2, 13, 16, 17, 29, 558, 565, 575, 621, 630, 689, 714, 727,740, 751, 754, 761, 762, 764, 765, 774, 784: n = A,T,C or G
gnttttcctaggnatnnctttggcacttnctctttttgcaggatcccatcgattcgaattcggcacgagtcgagttttttttttttttttttcactttttaatacacttcaatggtttttaatatattcacagttgtacaactatcactagacaaaatatttttatctgtatgaagtgctgtgtgtatcatggggccaagtcaggggaagacaggagtttaccaggggaagaaatgcattccagggaaagagaacaaatgtgcaaaaagacggaattctgaaatgacctagcatttgcataatatgaaactgcagggggaggtaggctagagtttatagtgaggaaacaattgggctagtttacaaatgaggaatctgaagctcaaatagatgaagtaactggcataaggcaattatcttatgctaactcaagaaaaggtgtctaaggcaggggtccccaaccttggtgccatggactgggtactgtggcctgttaggaacccggctacacagcaggaggtgaggagcaggcaagcattactgcctgagctccacctnctgtcanatcaaccggnggcatcaaattctcatcggaacttgaacccttatttttgaactgcncattgttanggataggttgcattgctcccttatgagaaatctaacctaatggcccggatgaatttganggggaaaaaaaatttcaatccttgnaaccacccccccnaaccttgtttggngggaaaaaaanagnctttccnntnnaaacccggncccctggggncct

SEQ ID NO: 5845 - DNA, 900 bp, Homo sapiens
  misc_feature 1, 4, 12, 39, 40, 73, 76, 80, 102, 103, 104, 107, 111, 112,119, 125, 133, 140, 141, 148, 151, 153, 157, 158, 159, 160,162, 166, 167, 169, 173, 174, 202, 215, 222, 223, 237, 240,251, 254, 279, 280, 281, 287, 293, 295, 296, 298, 302: n = A,T,C or G
  misc_feature 304, 310, 311, 318, 322, 323, 324, 327, 332, 333, 335, 344,346, 349, 353, 354, 357, 358, 363, 366, 367, 373, 375, 379,385, 393, 395, 396, 400, 403, 405, 408, 411, 414, 416, 425,427, 430, 432, 438, 439, 441, 459, 460, 470, 478, 481: n = A,T,C or G
  misc_feature 494, 504, 507, 510, 516, 521, 531, 534, 538, 548, 551, 561,564, 565, 570, 573, 576, 581, 585, 600, 603, 604, 619, 623,624, 637, 639, 657, 663, 670, 674, 676, 692, 697, 698, 707,710, 713, 719, 732, 734, 745, 746, 748, 749, 754, 758: n = A,T,C or G
  misc_feature 763, 764, 772, 774, 777, 779, 780, 797, 798, 800, 802, 804,805, 808, 811, 813, 816, 818, 819, 821, 824, 825, 832, 833,835, 836, 841, 847, 848, 850, 852, 854, 857, 864, 865, 874,880, 881, 889, 890, 894, 896, 897, 898: n = A,T,C or G
nggntcttttgnaatttctaacacctgctctttctaatnnttggaatccctcgattcgaattcggcacgaggnaanaacngctctggagaaggccacgacannncanaganntcaagtnagaaanccaccagnctaactnnaggattnagnancctnnnnancgcnntnaggnncaatgaggctgaccttgaggctcttggnagggaacacttgncggcacnnagctcttgtgcgtnctnggtcactttgntcntatccattctctgacaccccagttnnnattaancacccnanntnagantntctgcnnggtgccnggcnnnttnttacnnangcccttctncnttnttcnncannatccnccnntttccntnatcntttggntcggatananntttnctngnaanccnttngnttttctttnancantnattctnnancccaaaatttgctttttnngtcttcttgnatttttcnctnaattgccctttcnatctcctttnatnttnatcccnttttntttttccctngcntttnccttcatacngtnttcccttttnttnntgccnatnttncaatnggcncctacttttatcccnttnngggcttttttgtccncttnntttttttcttccnanttcctcccttatttctcnaccctntataacntacntnatctttctctaaattnccccnntttcttctnttnttntccctntttttttgtccancntacatacttcnntnnttttnggantctcnncctatttntntcngnntcaatctatctatcccnntntncnnttnctncnttncnntntcnnttctatnntnnttctnttattnncntntnctnttagttnntcttttacntactannctttttcnntttntnnncg

SEQ ID NO: 5846 - DNA, 734 bp, Homo sapiens
  misc_feature 3, 4, 14, 27, 41, 45, 46, 50, 71, 72, 79, 94, 103, 104, 105,106, 111, 112, 115, 116, 126, 128, 133, 140, 141, 145, 156,171, 197, 198, 211, 217, 219, 220, 226, 230, 231, 232, 233,234, 239, 247, 249, 252, 258, 262, 274, 275, 281: n = A,T,C or G
  misc_feature 286, 288, 292, 295, 301, 302, 317, 321, 324, 326, 332, 346,350, 353, 356, 368, 383, 385, 390, 392, 393, 394, 396, 397,399, 403, 405, 407, 411, 414, 418, 420, 421, 428, 429, 434,437, 441, 443, 445, 452, 456, 468, 469, 471, 479, 481: n = A,T,C or G
  misc_feature 482, 487, 488, 493, 496, 500, 508, 511, 514, 521, 522, 536,544, 563, 564, 565, 568, 569, 570, 571, 576, 578, 581, 587,589, 602, 618, 620, 622, 627, 636, 647, 652, 664, 665, 666,670, 673, 675, 682, 684, 687, 703, 704, 705, 707, 709: n = A,T,C or G
  misc_feature 711, 713, 726: n = A,T,C or G
gtnnctaaatggcnggcctgctcgttnctttctcgcaggancccnncgantcgaattcggcacgaggcggnncggtccngtacatggctctgtntgtcacaannnnacgcnntgnntgcccgttcncnatacnatagtgnngctntgtccaaatcntggactctgccctcnatgaacttgtgctatccagatgaccnngctacatcactgnttgctncnngtactngcannnnncacgnaatgtggnantgnatgganacgntgaaccttttcnnactatngcccntncttntgnaatcannataaccctgtttggnactnttntngggctnctattcctggctgnggtntgnctnacactgaccaangggcctgtgctgtananatgcnannntnntncagngntncctngtnactntnntaaggcnnatttnatntganantnatgcacnattngcccagtgagcnncnagttcagngnncgcannatggngancgcngtgcttanccnagntctgtgnnaggctatgcccatntcaaggcntgcatggaactatgatggnnncannnnattcnangcngtgtgncngaatgagatcctngcacaaggatatcatncntncagtnatggctgtncaactctggantctangcatgttccgannntganggnancagattnantgngaccctgactggtgcnnngnancngnacattgaaaaccngccgctgc

SEQ ID NO: 5847 - DNA, 934 bp, Homo sapiens
  misc_feature 1, 4, 5, 6, 7, 11, 21, 28, 43, 44, 345, 372, 397, 408, 412,428, 435, 442, 446, 448, 501, 525, 547, 551, 579, 614, 637,653, 668, 670, 692, 709, 715, 722, 729, 732, 736, 741, 748,753, 772, 788, 796, 808, 852, 859, 877, 896, 903, 905: n = A,T,C or G
  misc_feature 907, 916, 919, 923, 926, 934: n = A,T,C or G
nggnnnntttnaaaattcttnatatacngctacttttcaaatnnttggatcccatcgattcgctggcggtaaggctggaaagggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaanaattgggttctcttattaaagggttcnattgctggtggtgggggtcatttcncacatttcccnaatnttttgaattggggaanaaaaggnccccccnaaananttgtcttaaaaggattccctgggatttccttgggtatcttcaaggacttcttnaaatacctctttaacaagcttgtnccaaatggtttgggtggaattnccanttgggaccttggtattcttcttggtggnaaaaaaccaccaaatttttggccctttttttgggnaaattccttaattttggaagccnaaatttggggaaaagnttttaaaatttaagncntttttcccaaacccaaaacccnaaaattttcttggccantttccnaagttcntttaaanccntttnttttnaaaaatnggttnaccttgggggggcttttcnaaaaggaaaagccttntttggaanttcttggaaaanttaattggggggttttttggaatttggaaattttggacctgggnttttttnaaaaaaaacctgggtttngggaatttttaaaattggnggaattncncnaaaagtttnttnggtnaanccaaaccn

SEQ ID NO: 5848 - DNA, 757 bp, Homo sapiens
  misc_feature 3, 4, 5, 6, 7, 8, 10, 18, 19, 61, 63, 64, 70, 71, 72, 79,82, 84, 85, 89, 90, 104, 107, 120, 125, 129, 131, 132, 135,137, 139, 141, 143, 147, 150, 158, 165, 170, 172, 179, 183,185, 194, 195, 199, 201, 203, 205, 210, 213, 216, 225: n = A,T,C or G
  misc_feature 229, 231, 233, 236, 238, 243, 244, 250, 258, 259, 260, 265,268, 269, 272, 277, 279, 280, 282, 284, 286, 287, 291, 292,294, 299, 301, 302, 303, 313, 315, 317, 321, 328, 331, 332,335, 340, 343, 348, 358, 362, 367, 373, 391, 395, 402: n = A,T,C or G
  misc_feature 406, 414, 415, 420, 422, 429, 432, 435, 440, 444, 445, 450,456, 458, 460, 462, 465, 466, 474, 480, 481, 484, 487, 488,494, 500, 506, 508, 510, 513, 516, 517, 519, 523, 529, 530,533, 543, 544, 546, 547, 549, 552, 569, 579, 584, 587: n = A,T,C or G
  misc_feature 590, 594, 596, 598, 601, 602, 604, 607, 611, 612, 617, 621,640, 642, 643, 652, 656, 662, 674, 675, 677, 686, 690, 693,698, 701, 702, 705, 707, 710, 719, 727, 728, 751, 755: n = A,T,C or G
ttnnnnnncncagcttcnngttctttttgcaggatcccatcgattcgaattcggcacgagncnngatggnnntgaatgncangnntatnncagatgagacaagnganacaattgtgtccntgtantctntnnggngncntngntgcnggngaaacatnaactatnggcangntaactgnacancntagacccanngatncnangncaggncantantgggaaccnccantnanggntnttttnnctatgntcacagcnnncacangtnnagnctgangnntnananngacnnangaganannncattttaatngntnatgngaaaganggnnaanattgnccnagagnttagctcttnacantactntagtcntgcaaggagtagccgtgngccngatcagngaangactgagnnctcananctacccngcnctnactgnatgnngactngcatgntnancnaanntaacctgngagccnncgngcnnagcctntttgtnagaagncnantcngtnntncacntgcccnnagntagcgctttnngnntnacngacaacaccaactgggntggtggcctntgtcnganttngaananangcnntnacntgcnngctcnttantgaaggattggatactgananntacactccngacntttgcnaaaatggaaaannantggtctctngganggnaactnttnnacngnganctgttctantaaaatannacgtggatgaaaagcttactggncacngt

SEQ ID NO: 5849 - DNA, 757 bp, Homo sapiens; identical to SEQ ID NO: 5848
  misc_feature 3, 4, 5, 6, 7, 8, 10, 18, 19, 61, 63, 64, 70, 71, 72, 79,82, 84, 85, 89, 90, 104, 107, 120, 125, 129, 131, 132, 135,137, 139, 141, 143, 147, 150, 158, 165, 170, 172, 179, 183,185, 194, 195, 199, 201, 203, 205, 210, 213, 216, 225: n = A,T,C or G
  misc_feature 229, 231, 233, 236, 238, 243, 244, 250, 258, 259, 260, 265,268, 269, 272, 277, 279, 280, 282, 284, 286, 287, 291, 292,294, 299, 301, 302, 303, 313, 315, 317, 321, 328, 331, 332,335, 340, 343, 348, 358, 362, 367, 373, 391, 395, 402: n = A,T,C or G
  misc_feature 406, 414, 415, 420, 422, 429, 432, 435, 440, 444, 445, 450,456, 458, 460, 462, 465, 466, 474, 480, 481, 484, 487, 488,494, 500, 506, 508, 510, 513, 516, 517, 519, 523, 529, 530,533, 543, 544, 546, 547, 549, 552, 569, 579, 584, 587: n = A,T,C or G
  misc_feature 590, 594, 596, 598, 601, 602, 604, 607, 611, 612, 617, 621,640, 642, 643, 652, 656, 662, 674, 675, 677, 686, 690, 693,698, 701, 702, 705, 707, 710, 719, 727, 728, 751, 755: n = A,T,C or G

SEQ ID NO: 5850 - DNA, 779 bp, Homo sapiens
  misc_feature 1, 4, 19, 21, 32, 41, 60, 80, 100, 106, 108, 537, 543, 574,612, 614, 616, 626, 631, 634, 636, 640, 644, 651, 660, 703,710, 713, 718, 722, 724, 732, 735, 761, 768, 772: n = A,T,C or G
nttngaaattccatatagnantgaacgggaantcccctttntgcaggcagcccatcgatncgaattcggcacgagaagangtttgattctttagataacncttttnangtgctataaagggcctagtttaaaaggaacttcttttgaaaagcaattaacagttgataaagggttaaataaaaattatctagtaaggaatttcttattggaatgtaaacgtggttctaattttaaatagacagtgatataaagaataaaaagtaaacagtgaaattgagttctccagggaaaaggcagacctgtttagtaaaaaaaggatgcttttttcagtgatgtctttttttgagtgcatatgtgtgtgactcttgaagaaatccatgttcagatttatcagatgattgaagtgggtgttctgaataaagaaagctgtgaggcctgaggcagtgaccgtatcaggaaacatattttattggagatttggaagctatagtaaaacataatggcaataagccaacttcccagtggtaaacccacagnggtggnttagttctaacctcttgatgaccgaggaggntaataattggatattgcagagcagcaaatatgtaaccngngngtaatctcanggccncangntaancagnttccagncagaagccntagaagaaacccctgaccaaaatttagcttaccccggacctangctgccngcntatgngggncnggggttcntcngggtttaaaagaaacctaataactgnccacaanaccnttgaccg

SEQ ID NO: 5851 - DNA, 820 bp, Homo sapiens
  misc_feature 4, 5, 6, 8, 9, 19, 47, 55, 57, 64, 67, 68, 74, 90, 111, 116,126, 139, 141, 178, 183, 200, 240, 269, 271, 275, 315, 320,323, 344, 361, 369, 377, 386, 402, 422, 423, 429, 468, 481,489, 493, 505, 506, 528, 536, 549, 552, 560, 574: n = A,T,C or G
  misc_feature 576, 619, 630, 631, 633, 637, 647, 649, 654, 657, 661, 670,679, 706, 711, 715, 718, 724, 736, 738, 740, 743, 750, 792,797, 799, 801, 802, 803, 807, 814, 815, 816: n = A,T,C or G
ctgnnncnngccgatccangtagaactcatgggaactcccgcaggancccagggngncgaacgnggnncgaggnaccgcgagagaagggngggtttaactacacacttttnaaccntgcttaacanaagtattatatangnacagtttcatacaggaattacctcaaaagggagtctnatgangagcaactacagatagntgcaagggatcatacagaagatatcgatgataggtgaaanatgcttagaaggggtgtgaatgtctagcngngacnaccatgtgtatgtatccttgacaagcagtataaaataccngtgangtnttctttacattacgggataangcataaggaatcaatcnccatatanactatcanccctaatgnagcaaggggaagtatntaattgcccatgatatgtannttactnatactatgccagagaggaaactataaagtaattacacangtaaacttgggtntttcacanacgnaggtattcattnngagtacggtgaagaagaaaaangaatatcnaaatgaactgaanccngatggganagtatcaacaagtntntaaaagcccaggattctaaaaaacaataaaggggcacgggcantttttggagtnngnacanccttatgccnantggcnaanaatnccaaaaatnaaaagcggnaaccattggggaaccccgggtggaccntaaanggcnacntaaatnggggaaccagcnantngangaatganggaaccaaaggggggttaggcaaataagccaaaacccccaanaaaanantnnngggnccaaaannncccg

SEQ ID NO: 5852 - DNA, 752 bp, Homo sapiens
  misc_feature 5, 6, 7, 8, 9, 10, 14, 23, 24, 31, 44, 347, 357, 363, 364,419, 505, 574, 583, 666, 677, 695, 704, 729: n = A,T,C or G
agagnnnnnntttnattctttgnnctctaanagcttggctactngttctttttgcaggatcccatgcgattcgaattcggcacgaggccaccttctaagcaagtgatggcctggctggttcagtaccctttgcaccctgctttttaaatcttattctgcacactttttcatatctattcatatgattagacatcatcattttaatggcttcatggcattccattttatgggtatattataaagagactaatacagaattatgttccttacaatacatgatttttaaagttttaaaagctaactggggttacatgccctcaggacaagacacataaacacattttgtngacaaaaaanaaaaannaaaaaaaactcgagcctctagaactatagtgagtcgtattacgtagatccagacntgataagatacattgatgagtttggacaaaccacaactagaatgcagtgaaaaaaatgctttatttgtgaaatttgtgatgctatngctttatttgtaaccattataagctgcaataaacaagttaacaacaacaattgcattcattttatgttncaggttcanggggaggtgtgggaggttttttaattcgcggccgcggcgccaatgcattgggccccggtcccacttttggtccctttagtganggttaattgcncccttggcgtaacatggncatagctgnttcctgtggggaaaatggtatccgntcacaaattccacaacatacgag

SEQ ID NO: 5853 - DNA, 809 bp, Homo sapiens
  misc_feature 4, 5, 8, 9, 10, 11, 18, 19, 22, 25, 28, 30, 33, 52, 53, 60,61, 62, 63, 64, 127, 232, 295, 403, 412, 452, 466, 467,476, 516, 528, 536, 560, 574, 575, 600, 612, 638, 639, 640,641, 659, 660, 665, 671, 676, 699, 703, 705, 707, 709: n = A,T,C or G
  misc_feature 718, 719, 723, 725, 726, 736, 739, 740, 744, 749, 751, 755,766, 767, 775, 776, 779, 780, 782, 785, 797, 805: n = A,T,C or G
tttnnaannnncagcgtnnccnccnttncnctncgtgaaaccctttggcaannccccccnnnnngcaggatcccatcgattcgaattcggcacgagattctctcaataatggccagccgaaatttcncgctgccaggcatctgcctccgcggggtcattaaactcccacagtggtcaccccactgctgatgtacagactttccaggcaaagcgccatattcatcaacaccgncagtcttactgtaattataacactggaggtcagttagagggcaatgcagccacttcctatcanaagcagactgacaaacccagccactgtagccagtttgtgacacctccgcggatgaggagacagttctcagcacccaatctcaaagctggtcgagaaaccacagtgtanaatcaagtnactggacaaacttgaaatcatggtggaagaaacagacagngttagctcatgatnngatttggtnctacctttggccttgagttcttattatttacattataaanattaactggttntatattgntaagacaaaacactggtaaaagtngcaacacctccctnntgcttgtataccataaatgggcagnctctggaaattnatggataaagcatcaaagaaactgcnnnngtgctgaaaacgtttctnnctttntttagngcctnaatttaagatactttactttacncccncntngnaatctgggnngcangnntctcttttanggnntggnaaaanancggncttcgcccctnntaaacttnnagnngngtngggattaccgcnaaaccccngacc

SEQ ID NO: 5854 - DNA, 707 bp, Homo sapiens
  misc_feature 2, 12, 16, 594, 595, 596, 597, 598, 603, 605, 610, 611, 612,614, 615, 616, 617, 619, 623, 624, 626, 648, 653, 656, 664,676, 691, 695: n = A,T,C or G
cnaatgctggtngctngttctttttgcaggatcccatcgattcggggctagcctgcacgcacgccaagatggagctccaggctagcccacagaacagcccagccgcagccgtcctaccagaccagcaccttgtaaccacagtctaacccagcgggcaccaggcggtgagacctcctgccgctgccagcccaggatagcccccttgcctcttgcccaaggctcaggctaccccttgaggcgtctggaggacactaggcttgacctggggagtggcatgatggggggcagggtccgaggcaacggagaaggcagaagtgacttagattgtgagtgccacggggctgaggcctgcgccgacctggtctgctggtgctaccaggcttgaacagtcttcaaatccactgctattaggcaaattacctggctcccgctgaactccagcacctagaactatgtcacactcgtagtaggccgctgcattggttgaacaaatgattttgaaagaatgaatgtcttcctctgtgcctgcatttcctcagaaggctgtaacaaagattaaataggaaaattcgtggaaagttcaaaaaaaaaaannnnnctaanantcatnnnannnnangagnntnaaaaaaaaaaaactcgagcctntaaanctntagggagncgtattacgtanatccagacatgatangatncattgatgagtt

SEQ ID NO: 5855 - DNA, 666 bp, Homo sapiens
  misc_feature 6, 25, 347, 429, 486, 513, 563, 569, 634, 644, 653: n = A,T,C or G
atgtgntaacacacataggctcaangtaaaggggtggcgaaagatctgttatgcagatggaaaaaaagatcaggggtcactattcttgtatcagataaaacagactttttaaatcaacaacagtagaaaaaggactagggcattacataatgaagaagggttcaattcaacaagatttatcctatacacacccaagattggagcactcagatttctaaaactattatttctagacctaggaaaagaattaaacggccacataataatagtgggggacttcaacacctcactgacagtgttagatagatcatcaaggcagaaaactaacaaattctgaacttaaattnaacagttgactaattgaacctaatagacatctacagaatactccacccaccaacaacagaacatacttttttctcatgtgcncatagaaaatactctaagattgccacatgctttgtcccaaagcaaatctcagttaantcaaaaaaagattgaaatcatacccangcttttcagactcctccatagtaaaaaattggaaattcaacaccaagagnaaactntcaaaaacatgggaaacttaaacaacttgctcctggatgaccttttggggtaattgttaaaatanggcatacatnaaccccttnttgaaacaaatgg

SEQ ID NO: 5856 - DNA, 802 bp, Homo sapiens
  misc_feature 6, 7, 12, 22, 24, 38, 40, 44, 50, 63, 67, 73, 87, 91, 94,104, 108, 110, 118, 119, 126, 129, 131, 151, 156, 163, 169,171, 176, 177, 180, 185, 186, 188, 192, 200, 201, 203, 211,214, 216, 221, 232, 239, 249, 259, 272, 275, 282, 289: n = A,T,C or G
  misc_feature 292, 294, 295, 298, 302, 306, 309, 312, 314, 318, 319, 333,340, 349, 353, 365, 390, 401, 407, 408, 411, 415, 421, 422,423, 424, 427, 431, 437, 441, 442, 445, 446, 452, 453, 459,464, 467, 474, 476, 480, 482, 485, 488, 502, 506, 508: n = A,T,C or G
  misc_feature 512, 525, 537, 538, 540, 548, 554, 557, 558, 563, 567, 568,569, 574, 575, 578, 581, 582, 608, 614, 616, 617, 623, 629,674, 680, 683, 685, 688, 689, 690, 691, 694, 696, 699, 703,712, 722, 727, 735, 770, 771: n = A,T,C or G
ttcgtnnttccngtagaacttncngcaaaatcccgtancngcangagccnatacgatccgggnccgntgaacnaactagactacgcngcgngcnggcctgtttnaaanantggccagnncttcttnagncngtagctcaaaacctgtgagnatcanacatcanaaatgngngaaanntanagccnntngaanacaacatnngngacaaccnacnanacaanactatggggancagcttntccatgtgangcatagccangatccataacganaangaaaccngaacccnggncnntcncaanatgnaanacncntgcnntgctgcaatgcccngcaaagncgatgaaanaacngggctacatacngcgaggaaggactatgcaactgctnggcaggactantgactnnaanctgngatctnnnnggnactnagaacngaannctnnaaaggnngacagnccaanttnaaaacgngnaaangnacngcnttcgacaacaaggntatncngatntcatctgaacacnggaagggaaacnnanaaccctanacgagnatnnggatngaannnggacnntantannaacgcaccctttaagaacagcttganctcacncnngaaccngccatntttaaccccagccttgggcaccaccaggcaacgacaccagtctancaaagnctnangcnnnnaananatnagcncccagcccngaaacgctgnggccnggaatatncaaggaaaccagaactcttaaaacggtttcccagnnggggaattttaaaaaaggggccaacccctcc

SEQ ID NO: 5857 - DNA, 874 bp, Homo sapiens
  misc_feature 7, 22, 23, 27, 29, 32, 33, 39, 47, 58, 73, 75, 76, 87, 93,98, 99, 103, 110, 111, 117, 130, 131, 132, 141, 145, 146,151, 163, 169, 171, 182, 185, 191, 195, 200, 204, 207, 209,213, 218, 220, 245, 250, 264, 270, 272, 277, 282, 285: n = A,T,C or G
  misc_feature 301, 305, 309, 314, 316, 317, 319, 328, 334, 341, 343, 345,347, 353, 354, 356, 358, 365, 372, 373, 374, 379, 380, 385,386, 392, 399, 401, 407, 408, 411, 413, 415, 426, 427, 430,432, 435, 440, 443, 444, 447, 448, 453, 454, 459, 464: n = A,T,C or G
  misc_feature 466, 468, 478, 482, 485, 488, 490, 493, 495, 503, 509, 510,512, 515, 516, 523, 527, 538, 539, 540, 541, 542, 552, 560,561, 566, 569, 573, 575, 576, 581, 594, 596, 601, 602, 608,616, 619, 626, 628, 629, 636, 637, 640, 644, 648, 650: n = A,T,C or G
  misc_feature 651, 655, 658, 665, 667, 668, 669, 674, 676, 684, 686, 687,695, 697, 701, 702, 715, 721, 723, 729, 752, 754, 756, 760,761, 767, 774, 781, 783, 786, 788, 790, 796, 799, 802, 803,807, 809, 821, 824, 825, 829, 832, 836, 841, 843, 846: n = A,T,C or G
  misc_feature 856, 857, 859, 866, 867: n = A,T,C or G
agcgggnttttaaacccttatnntatncnctnngaaacnaaatcgcnctaaaaggggngggggcgcgagcccntnnccaccccattnccaaangaggnntcantggggtnnggccgngcaccattatccnnncccattcgnaccnntaaancgctctatcaantacaanancatgacctccnctncatctntctnctacncttnctnanacantattnantccacttgattttttttttcttaanactanttatattactgctnctcggngnctgcntaccnttnccatgctaaggctggnacancagncctgngnncnataccgtgnaatccnccagganancnancccctnngnancggaggncccgcannnccccnnatgcnnatagantagttcnanggactnnagntncnatcaacaactnnctngnggngcagnccnnctnnccttnncgacngcccntnanctacgggganctgnatnatncnctntntcatatgnaatccnntnttnnctcggtntggngcacaaacgannnnntactaggaantcttcctnnatagnccntaanannacaangaatgggattaanancttanncccttnggctccanggnagaacancnncataccnnttngggntttngnntaanaantgtcctnannnggggnantaactaangnnacccctantncctnntcgatccccctanaagaantnttcctntatctttctctccaagtacagancncntagnnaaaggntcccatntctatgngnccntncntttganacnctnnctgngngacccactttgnctnngaanggncatnccatntnaancttaaccatnngnttattgnnctcgccc

SEQ ID NO: 5858 - DNA, 782 bp, Homo sapiens
  misc_feature 14, 18, 451, 563, 640, 692, 719, 723, 733, 735, 737, 742,761, 778, 781: n = A,T,C or G
agttcatcctttcnaatngcttggctacttgttctttttgcaggatcccatcgattcgaattcggcacgaggttttttttttttttttttttatagggatcacttttatttcaaacaattaaatacaaaccaatattttaccccttcatagatgaaatcacatcttttcaggatatgagtataaagtaacaagcctagggcagagcttgtactgacaaagtcctgaaactacaatgagaggaaacacattgctctacttcgggataagtcatgaccgagactcaatttcagagacgctctatgaacagaggtgcttgaagccacagtggcagaagggaaagatggggaagtgtgccgaagagcctccaggcatgacagacagtcccctgaccaagcacaagtaacaggccctttgggtctctgcttctcactggaaaatgatgaagcctanatctgatgactcctagtgccaacatttaacaaagttcgaaagttatgcaggacttcacacatgtacggaatggctgtatcacagaatattatgccgttagaaagttcacggncactattacctagcttctaaaatttttcagaagaaacagcagacttattaagtggaatcttaaattaaagggattancattttaatggaaataaatggaaaccagagcaggggaacccaaagagcccanttaggggaaagaatcctgaaaaaagtntggntttacaccangnancagcntttgaaagaaaaacccctnttggatttttttcccanaana

SEQ ID NO: 5859 - DNA, 785 bp, Homo sapiens; identical to SEQ ID NO: 536
  misc_feature 8, 9, 10, 11, 12, 13, 14, 15, 16, 17, 26, 27, 30, 33, 34,35, 36, 37, 38, 39, 40, 41, 42, 44, 45, 46, 47, 53, 54,55, 56, 57, 60, 64, 65, 66, 67, 138, 144, 169, 171, 177,182, 190, 192, 196, 198, 204, 207, 215, 216, 221, 244, 249: n = A,T,C or G
  misc_feature 255, 276, 283, 284, 303, 304, 309, 315, 318, 321, 325, 327,330, 332, 335, 336, 338, 345, 346, 348, 363, 401, 410, 423,424, 435, 439, 445, 448, 453, 462, 467, 486, 497, 506, 514,517, 520, 525, 526, 527, 529, 535, 539, 542, 544, 549: n = A,T,C or G
  misc_feature 555, 560, 579, 583, 586, 597, 599, 622, 655, 656, 662, 674,691, 693, 713, 729, 752, 756, 757, 764, 777, 784: n = A,T,C or G

SEQ ID NO: 5860 - DNA, 785 bp, Homo sapiens; identical to SEQ ID NO: 536
  misc_feature 8, 9, 10, 11, 12, 13, 14, 15, 16, 17, 26, 27, 30, 33, 34,35, 36, 37, 38, 39, 40, 41, 42, 44, 45, 46, 47, 53, 54,55, 56, 57, 60, 64, 65, 66, 67, 138, 144, 169, 171, 177,182, 190, 192, 196, 198, 204, 207, 215, 216, 221, 244, 249: n = A,T,C or G
  misc_feature 255, 276, 283, 284, 303, 304, 309, 315, 318, 321, 325, 327,330, 332, 335, 336, 338, 345, 346, 348, 363, 401, 410, 423,424, 435, 439, 445, 448, 453, 462, 467, 486, 497, 506, 514,517, 520, 525, 526, 527, 529, 535, 539, 542, 544, 549: n = A,T,C or G
  misc_feature 555, 560, 579, 583, 586, 597, 599, 622, 655, 656, 662, 674,691, 693, 713, 729, 752, 756, 757, 764, 777, 784: n = A,T,C or G

SEQ ID NO: 5861 - DNA, 1425 bp, Homo sapiens
  misc_feature 2, 4, 26, 42, 48, 58, 69, 71, 72, 76, 81, 87, 106, 116, 117,123, 124, 125, 127, 129, 130, 131, 132, 133, 136, 137, 138,140, 143, 146, 147, 149, 150, 151, 152, 153, 154, 155, 157,158, 161, 162, 163, 164, 165, 166, 167, 168, 169: n = A,T,C or G
  misc_feature 170, 173, 175, 181, 183, 185, 188, 193, 195, 198, 203, 207,208, 210, 212, 213, 215, 216, 221, 222, 223, 224, 225, 226,227, 228, 229, 231, 232, 235, 237, 238, 241, 243, 244, 245,248, 249, 253, 255, 256, 257, 258, 259, 261, 263, 264: n = A,T,C or G
  misc_feature 265, 266, 268, 269, 273, 274, 277, 280, 283, 286, 288, 289,290, 291, 294, 295, 296, 298, 302, 304, 306, 309, 310, 312,313, 316, 318, 319, 320, 321, 322, 323, 326, 331, 332, 333,334, 335, 336, 338, 341, 342, 357, 359, 362, 364, 368: n = A,T,C or G
  misc_feature 372, 373, 381, 386, 388, 389, 391, 392, 394, 396, 398, 401,403, 405, 406, 408, 411, 413, 414, 419, 420, 421, 425, 426,427, 428, 430, 443, 445, 446, 448, 456, 457, 459, 465, 469,470, 474, 475, 477, 481, 486, 492, 493, 495, 496, 497: n = A,T,C or G
  misc_feature 501, 504, 506, 507, 508, 513, 514, 517, 524, 525, 528, 534,540, 545, 549, 556, 557, 561, 563, 566, 568, 572, 574, 577,580, 583, 584, 585, 586, 587, 589, 593, 597, 598, 599, 601,604, 609, 616, 617, 619, 620, 622, 623, 627, 629, 632: n = A,T,C or G
  misc_feature 635, 636, 637, 639, 640, 641, 642, 643, 644, 649, 651, 653,654, 655, 658, 661, 663, 664, 665, 674, 675, 676, 678, 680,682, 684, 685, 687, 689, 690, 694, 695, 696, 697, 699, 708,709, 713, 717, 719, 720, 724, 738, 743, 745, 748, 749: n = A,T,C or G
cntnttaaaaaaatattgaaggcctntgttgggaaccccttngggggnacccttggancatttttgggngnncccnccttnaaaacnatcaagaaaaataatgggngggtcttttnngggggnnncncnnnnncannnanccnatnnannnnnnnanntcnnnnnnnnnnatntnacatanancnccnccaananccncaccncttnncntnncnncctcnnnnnnnnntnnacncnnacntnnnaanncacnannnnnantnnnncnnaccnnatnccnatnccncnnnncannnanccancnanccnntnntanannnnnnatnccccnnnnnntntannctctcctactccatncnacntncccnaccnntccatctnaaacnanncnnantnanctncnanncntcncnncaaannnaatnnnncncctccacacacantnnancctctacnnantccacnccanncccnncntcanccccncacaanncnnntccnacncnnnctcannacnttaacannacnaacccncccatnaccanaccncccccanncctncnccntnactncncancancannnnncncccnactnnncnccnactcnaacccannanntnntatncntcnccnnnannnnnncaaancnannnacnccncnnnctcatccannntncncncnnananntctnnnncncctcaccanncacncccncnnacanactatctctatacncaccncnctnnnnnannnnnnnnnccancncanacanncnnnactccntnnntannnaaccccnncnacnnnnntcncntnnaccanacncncncnnnnacantantaccnancnnnccnacnanancncncnnnntcacnnnnnnntntatcnantnctctnnctnnatnncnncttctnannnannnccnaacnnnncacccnncanctnatacnantnnnnactnannnncatnancananannnncatatannacacacnntanactacnctacnatncannnactntcncnannanctnncancananatcnnncncnnnnntcanncnnnnanatcnctcancannancncntnanntncanannntacnnncnntnnnnanatntcactcncnannnatcactcncnnnnncntnnnncccannnnnncnnncncanactcnntacnntatactnctncctctantnnnantcntancnnnnctntcnnctntctnctcantcnncncccactctataccnnctnatntnncanntnnnannnncctcctctnccctcnacctncntccacancncncacntcnnnataccncnncnantccatcnacacnatcactctncacncacnctntcnactactantnctcctnaactacanacccancncnntnncacancct

SEQ ID NO: 5862 - DNA, 794 bp, Homo sapiens
  misc_feature 8, 9, 10, 11, 27, 28, 29, 40, 44, 45, 59, 77, 85, 90, 110,116, 126, 135, 153, 205, 228, 238, 242, 246, 247, 248, 249,251, 252, 253, 255, 257, 259, 261, 263, 265, 266, 267, 268,269, 270, 271, 272, 308, 340, 359, 396, 532, 542, 544: n = A,T,C or G
  misc_feature 579, 615, 654, 661, 713, 751, 753, 755, 789, 794: n = A,T,C or G
ggcccccnnnntttttttttttaaaannnccccctttaanaacnnggaaaaaaaacccncctttttttggggccctnaacctttnggccnttcctttttttttgggcccngggggnaatccccccnattcccggnattttcccggaaaatttnccgggggccaaccggaaggcccaggggggaacctgggaatgggaagggggtnccttttaaaccaaaaaaaaactnttgttgggtngggnccannnnannnanananananannnnnnnnaaaaatcccttaaaaaaaaccaaaaaccaaaaccanaaaaaaaaaaaccaaatttctttcatttccanaaaaaaaattattctttanggggacctggaatattgggtaaattatgggtcaaatntaaataatattttggggcattccttacattgcttgcaagataaaatgctgtgccaaaatttgattttatttggagacttcttatcaaaagtatgtgcaaaggaagctaggatagagtgtccatccttgttgagtgnttctaaaatntnttctgatgcatattttacttggtggggagagatgnccagctcctctgtcttgaataacttattgcttgttncctaactttgtagaatggctttcggaaaatagaaatctntatagtnagataatgataatgttcttattatattgactgcaatgcaataaaatctttgntaaaaaaaaaaaaactcgccctaacttagtgagcgtcnanancgctgaagacattgtgagtggcacccactgatgnggaan

SEQ ID NO: 5863 - DNA, 957 bp, Homo sapiens
  misc_feature 3, 10, 12, 13, 15, 17, 25, 26, 30, 70, 80, 82, 84, 85, 89,96, 98, 101, 127, 128, 129, 141, 148, 151, 153, 154, 162,166, 167, 168, 173, 174, 183, 184, 187, 188, 193, 194, 195,203, 211, 213, 216, 228, 230, 238, 241, 254, 255, 259: n = A,T,C or G
  misc_feature 264, 265, 266, 270, 271, 277, 283, 285, 286, 288, 289, 300,313, 316, 320, 321, 325, 332, 335, 340, 347, 350, 351, 352,355, 359, 361, 362, 365, 371, 376, 377, 382, 386, 387, 392,395, 397, 400, 404, 405, 406, 416, 418, 423, 424, 431: n = A,T,C or G
  misc_feature 432, 433, 435, 438, 442, 454, 457, 460, 464, 468, 469, 470,475, 478, 484, 485, 494, 497, 498, 500, 501, 504, 505, 506,507, 509, 518, 519, 525, 527, 528, 530, 539, 547, 550, 551,554, 555, 557, 558, 559, 561, 562, 569, 571, 578, 580: n = A,T,C or G
  misc_feature 585, 591, 593, 594, 600, 603, 606, 610, 619, 621, 629, 633,634, 637, 641, 642, 650, 653, 657, 665, 666, 669, 671, 677,678, 683, 688, 690, 694, 695, 697, 701, 703, 710, 714, 717,727, 728, 733, 742, 755, 758, 771, 774, 784, 788, 807: n = A,T,C or G
  misc_feature 808, 813, 814, 816, 837, 841, 847, 848, 853, 859, 862, 866,867, 876, 878, 889, 892, 894, 899, 902, 903, 907, 909, 912,919, 922, 924, 937, 941, 944, 945, 949, 954, 955: n = A,T,C or G
gtnattctantnnancnctttcacnnaccnggtaccccacccgggtggaaaatcgatgggcccgcggccnctctagaagncntnngtgngtcacangnttntccccctatggcctcacaaagtgctnnnattatacgcgtnaatccantgngnntggcctanagtnnnagtanncatgatttnngcnntgttnnngtcctggnttccaaangnagnggacctagctgntnatcaattnttntgagctaaactgnntagntccannncctnntgatantctccntnnannatcgaggtatnactagattaactnggnaacnnacanggatcanatncactnataatanacnnnatnaatnanntcnacactnatccnnctttngctnnatatntgnanaancaannnactgaaaacntntattnnttaaagnnntncgncttnatgactcagttnccnaangctntatnnntattntgntgtgtnnatatccaanctnncnnccnnnncnttgtttgtnntgctcntnncngtttcaaanagaataanaannctnntnnntnnctaagananacattcntnagctnactatncnntactcnatnatnattntatgccaanantgtagccntccnnatntatnnctaaaaanttnacgnctatatannacngnaccttnncatanccggntntaanncnggtntngatctcncatnatntcctataaanngtgtntatacgttnactcccaatcttnccntacgtgaaaaccnttntttctcattnaatnaaaaacggtgtctaaaaanncgaanntnacccttgctgctcttcatcgnaatntatacnntatcntatcgnatnttanncatagaatncntctcttaaagngcngncaatnacnnaccntncgncttatgntgntngattccccctctntcanaanncccnaaaanncc

SEQ ID NO: 5864 - DNA, 808 bp, Homo sapiens
  misc_feature 3, 16, 20, 57, 68, 77, 78, 80, 89, 105, 107, 108, 115, 117,120, 123, 129, 133, 138, 140, 143, 147, 148, 156, 159, 163,166, 172, 173, 174, 180, 186, 192, 197, 198, 201, 207, 209,214, 216, 217, 218, 219, 226, 228, 236, 237, 238, 243: n = A,T,C or G
  misc_feature 244, 245, 246, 254, 283, 308, 311, 317, 325, 330, 332, 339,357, 358, 375, 385, 398, 401, 415, 422, 424, 426, 430, 434,442, 448, 449, 451, 470, 471, 475, 476, 477, 479, 480, 491,497, 507, 510, 527, 559, 574, 576, 584, 591, 609, 636: n = A,T,C or G
  misc_feature 639, 641, 643, 650, 660, 672, 673, 681, 684, 722, 743, 754,762, 783, 784, 795, 801: n = A,T,C or G
gtnttcctttcaaatngctnggctacttgttctttttgcaggatcccatcgattcgngtagccgaccngctgctgtnncnggtgcttgntacgaacgttgccacnannctgagantngtnacnctaganctgnaaacntnatngttnnctgcctgnatnaccnagnaggctnnnatactnaagatngcaatnctgannaancctgcntnatgtncnnnngtctctnantaccagannnttgannnnttactggnttattagatggctattatctctaaattcnggatgcctacctggcttataacctnaangaattnactggagnactcntntatgatnttctgcccacctgtgatnntacccatgaacacgctntggatactgngaaatatcggatntantgccatcctgcttnatggacntntnactnagantaagcgcntaaganncnttaataagtttaaggccanngccnnntnnattcttctagnaactgncattgccaangcnaggtcaggacatacctnatgtagatgatggatggtcaactaatgacatncctgacccattccangngatcaccntccattngaattgggtcctagccangatttgaagcttgggcgcttacggganaangncncttactntttggttaanacaagttttgannggttgggnaantttttaacaaacgccatttggaacacttttaattgggngaataaaacttcccccgggtnttgggaaaacncggattgntgaaagggtaatgaatgggtnncctggaacggnggtaantttggaa

SEQ ID NO: 5865 - DNA, 788 bp, Homo sapiens
  misc_feature 6, 7, 11, 13, 78, 95, 96, 97, 113, 131, 142, 292, 435, 518,521, 576, 579, 588, 605, 626, 635, 664, 680, 681, 687, 690,694, 714, 723, 726, 727, 732, 733, 736, 776, 785: n = A,T,C or G
cttaannaatncnttatcgcttggctactcgttctttctgcaggatcccatgcgattcgaattcggcacgaggtactntgagtgtttgggggttnnncacacacatgcaattntgcttaacaaaagtattntataatacagnttcatacagaattaccttaaaagggagtcttatgttttcaactacagatagttgtaagggatcatacagaagatattgatgatagttgaaatattcttagaaggggtgtgtatgtctagctgtgtctaccatgtgtatgtattcttgacnagcagtataaaatacctgtgatttttctttacattagggataatgcataaggaattaatcttcatatatattatcatccctaatgtagcatggggaagtatttaattgcccatgatatgtattttacttatactatgccatanaggaaactataaagtgattacacatgtaatcttgggtttttcacatatgtaggtattcattttgagcaaggttgaaagaacanaanaaatatttaaatgaattgaattcctgatgggatagtatcaataagtatttaaaanccnagtattctnaaaatattcaggggtangggtcatttttgagtttgggntttcttttncgaatgggtaaatatttcaaaatttaaangggttacaattgggtnncctgtnggncctnaaaggccttttatttggggnaaccagccnttnngaatnnatngaaccaaggggggtttagccaattgccaaactcctataanttgattttngcc

SEQ ID NO: 5866 - DNA, 704 bp, Homo sapiens
  misc_feature 2, 3, 9, 11, 12, 25, 29, 31, 33, 38, 41, 43, 704: n = A,T,C or G
gnnctaatngnnggctatcgaactnccgnananaacgngcntncgaattcggcacgagaggttgctcacctgaaggagcacaggagggttttccaggccatgtggctcagcttcctcaagcacaagctgcccctcagcctctacaagaaggtgctgctgattgtgcatgacgccatcctgccgcagctggcgcagcccacgctcatgatcgacttcctcacccgcgcctgcgacctcgggggggccctcagcctcttggccttgaacgggctgttcatcttgattcacaaacacaacctggagtaccctgacttctaccggaagctctacggcctcttggacccctctgtctttcacgtcaagtaccgcgcccgcttcttccacctggctgacctcttcctgtcctcctcccacctccccgcctacctggtggccgccttcgccaagcggctggcccgcctggccctgacggctccccctgaggccctgctcatggtcctgcctttcatctgtaacctgctgcgccggcaccctgcctgccgggtcctcgtgcaccgtccacacggccctgagttggacgccgacccctacgaccctggagaggaggacccagcccagagccgggccttggaaaagctcccttgtgggagcttcaggcccttcagcgccactaccaccctgaggtgtccaaaagcccgcagcgn

SEQ ID NO: 5867 - DNA, 729 bp, Homo sapiens
  misc_feature 2, 3, 4, 5, 6, 7, 8, 9, 10, 11, 12, 19, 25, 28, 39, 40, 46,51, 52, 56, 57, 58, 61, 729: n = A,T,C or G
gnnnnnnnnnnntttgttnctaatngcngggtggctcgnnctttcncgcannagcnnngcngtgtcgaattcggcacgagatttcaattcatagcaaactggtgttttaaactattgcagtagctggaactttttagtgtaaccagcatttattggagaagtgaatcacaaggaaataaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatggtgatctctatcctcctgtggaggagccagttgctagcactgatcctaaagcaagcaagaaaaaggataaggacaaagagaaaaagtttatctggaaccacggaattactctgcctctaaagaatgtcaggaagagaaggttccggaagacagcaaagaagaaatatattgaatctccagatgttgaaaaagaagtgaaacgattgctgagtacagatgctgaagctgttagtactcggtgggaaan

SEQ ID NO: 5868 - DNA, 706 bp, Homo sapiens
  misc_feature 3, 4, 10, 12, 19, 37, 41, 46: n = A,T,C or G
gtnnctaatngngggctantcgttctttccgcaggancccntcgantcgaattcggcacgagctctatcttgtttattgttgatgccatcttagaggaaaaaatgtaaaggtaagtaattaagcatatgacagcaacaaataagatacttataacctaatgggactttattttgtagttttatgtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccaa

SEQ ID NO: 5869 - DNA, 706 bp, Homo sapiens; identical to SEQ ID NO: 5868
  misc_feature 3, 4, 10, 12, 19, 37, 41, 46: n = A,T,C or G

SEQ ID NO: 5870 - DNA, 968 bp, Homo sapiens
  misc_feature 20, 98, 106, 116, 117, 124, 130, 137, 140, 143, 151, 154,155, 157, 158, 159, 163, 168, 169, 172, 173, 186, 191, 192,197, 207, 215, 223, 235, 246, 247, 249, 253, 258, 259, 261,264, 268, 274, 276, 279, 282, 289, 295, 298, 299, 306: n = A,T,C or G
  misc_feature 310, 318, 322, 324, 326, 328, 330, 331, 337, 348, 357, 360,362, 367, 368, 375, 382, 384, 390, 392, 395, 400, 404, 406,410, 412, 414, 416, 421, 424, 426, 427, 430, 433, 446, 449,450, 452, 454, 459, 460, 461, 464, 468, 470, 471, 472: n = A,T,C or G
  misc_feature 475, 484, 485, 486, 487, 488, 490, 493, 495, 496, 497, 508,509, 518, 521, 522, 525, 526, 536, 540, 554, 559, 561, 569,570, 571, 574, 583, 585, 590, 591, 592, 594, 600, 618, 625,626, 636, 639, 643, 649, 653, 661, 663, 668, 673, 682: n = A,T,C or G
  misc_feature 689, 691, 697, 699, 713, 720, 744, 751, 764, 767, 783, 785,787, 791, 797, 798, 800, 804, 808, 816, 822, 828, 837, 839,851, 852, 854, 857, 859, 860, 861, 862, 865, 875, 876, 877,878, 879, 886, 890, 892, 893, 898, 899, 906, 908, 911: n = A,T,C or G
  misc_feature 927, 933, 934, 947, 949, 955, 956, 965, 967: n = A,T,C or G
gtaccaatgctttgctactngttcttttcgcaggatcccatcgattcgaattcggcacgaggcggacaccaagtctggaccacctcccgctgcgtttnctactcanagaaacatcnngggcggngttaanacacggnatnacnggaagcanganncnnngcancagcnnagnntggggtcctggcnctgcnngctangccaggatgnccatcccnccctttanactgtcccttgnggcctgtgctnntnaaantggtnncngtnagcnctgccngnttnccntattatncccacnctnngcttctnaatnctttatgntccntntnanannaccttnctatactgtancccatcttnctntnaattnnttttcanggatctntnatattntnttncaaantccncnatantnantnattangtntnnganttncattcatattaanttnnantncattnnnctngttnannnttnttctttctnnnnngnttncnnnttcttataatnngtaatttanttnnctnntatctacttnttanttctttcaatcttnaattntntttacatnnnctnctcatccgntnttacnnntntcattnttaactctacctttctcnttctgtnntaacttactnatnatcncttccngttntttatatntnattcnctctnctcataaanctatctntnctctcncnattcttgactttcnctctccntctcttatatctctcgtctcctcncaatatntctctatcctctntcntttcacattcttattntncnatcnttcggnntntctncttnttctctcntacacnttctanacttctatnantcttcactcatnncnctntnnnntcnacatcttacnnnnngtgcttnttananntttanntacatancntantcctctaatctatatntcatannactctattgcttntnttctcnnaatcacacnanc

SEQ ID NO: 5871 - DNA, 782 bp, Homo sapiens
  misc_feature 2, 3, 4, 5, 8, 9, 10, 11, 12, 26, 39, 284, 359, 411, 415,434, 441, 478, 480, 484, 514, 523, 527, 540, 557, 570, 573,581, 586, 604, 613, 668, 679, 685, 691, 696, 711, 718, 748,768, 769, 770, 771, 772, 773, 774, 775, 776, 780, 781: n = A,T,C or G
gnnnnttnnnnnttttttgggtcttncgcttgttctttntgcaggatcccatcgattcgaattcggcacgagggatcacttgagcccaggagtttaagtctgtattactggaaaggggtcccaatccagatcccaaacaagggttcttagatctcacacaagaaataattcagggagcgtctataaagtgaaagtaagtttactaagaaagtagaagaataaaaaatggctactccacaggcagagcagctccttggggctgctgggttgcccatttttatggntatttcttgattatgtgctgaagaaggggtgggttattcataccttccctttttaaaatcatatagggtaccttnctggcattgccatggcatttgtaaactgtcaccggtgcttggtgaaaagtcnacanttgagggccaacccaaggncactctnattggccatctttgggttttggtgggattcttacccngntttntttactgcaagctggttttatcatcaaggnctttatganctgnatcttgggctganctccgatctcaatctgncatcttaaaacgnctnactgtctnggatngtaaccccaataggtctnaaaccttantttaccccaacttctatttcaagatggaatttgctcttgggttcaaaatgccctnttgacaagcanccagtnaacctnttcancatacccacttggantttcaancctggggtggacaaaaaccaattacccctntttttaaaaaaaaaaaaaannnnnnnnnaaanna

SEQ ID NO: 5872 - DNA, 806 bp, Homo sapiens
  misc_feature 2, 3, 4, 7, 8, 9, 10, 18, 33, 90, 282, 353, 356, 383, 385,389, 396, 410, 423, 433, 442, 466, 575, 583, 597, 612, 627,646, 668, 673, 685, 725, 768, 776, 780, 785, 792, 805, 806: n = A,T,C or G
gnnnttnnnntttttaanggctttggcttgtcntcttaggatcccatcgattcgaattcggcacgagtgaacttgttcattttgttttgnttgggaggaaaataaacaattttacttttttcctttaggagcattatgagcattatgtcagaatagaatagaattggggttcgatcttaacaggccagaaatgcctgggtttttttggtttgtttttgtttttgtttttttatcaaatcctgcctgactgtctgcttgttttgcctaccatcgtgacatctncatggctgtccaccttgtcgggtagcttatcagactgatgttgactggtgaatctcatgggacaccaatcnaanggctgctgacattttgggatctttcantntgancattcanatccaaggtctcanttaaacattcccngcatcattgnttataatcngaaactctgggccttctgtctggnggccttaaaagcttttgggccataatgcaacaattattgaaggaggattttattggagaaatgggggataggccttcatggaccccccaattaattaaaggaaaaactnaactgcantgggggggttttgnaaaaagggtatttantaccttctttaaacnaattccttttttttttcangggacctttttctaagcctggnattgnaccgggtaaccnttggaaccctttctttttggaaaaaaaccatttttccccnaaaaaagggccccctaattttttaaaaaatgggaatttaaccntttttaancccnaaccnttaaaanttttttttttttnn

SEQ ID NO: 5873 - DNA, 716 bp, Homo sapiens
  misc_feature 3, 5, 18, 19, 20, 713: n = A,T,C or G
tgntnttctaatgctggnnnctcttgttctttttgcaggatcccatcgattcgaattcggcacgagggactcagagcctgggaaggaggccgctatgcagggtagcactgggaacaggagacccacctgaggctcagccctagccctcagcccacctggggagtttactacctggggaccccccttgcccatgcctccagctacaaaacaattcaattgcttttttttttggtccaaaataaaacctcagctagctctgccaatgtcaaaaaaaaaaaaaaaaaaaaactcgaggcctctagaactatagtgagtcgtattacgtagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaattcgcggccgcggcgccaatgcattgggcccggtacccagcttttgttccctttagtgagggttaattgcgcgcttggcgtaatcatggtcatagctgtttcctgtgtgaaattggtatccgtcacaattccacacaacatacgagccgggagcataaagtgtaaagcctggggtgcctaatgagtgancta

SEQ ID NO: 5874 - DNA, 1206 bp, Homo sapiens
  misc_feature 1, 6, 16, 24, 30, 33, 42, 54, 57, 59, 63, 69, 70, 77, 87,94, 96, 99, 101, 102, 107, 108, 110, 111, 112, 114, 118,124, 127, 132, 135, 136, 138, 140, 143, 147, 148, 153, 156,158, 166, 168, 171, 172, 174, 180, 185, 189, 191, 193, 199: n = A,T,C or G
  misc_feature 204, 207, 209, 214, 215, 219, 239, 240, 241, 245, 257, 261,262, 264, 267, 271, 292, 295, 303, 305, 306, 307, 311, 314,317, 319, 320, 327, 330, 337, 342, 348, 350, 351, 356, 358,360, 363, 373, 379, 380, 384, 386, 392, 396, 411, 412: n = A,T,C or G
  misc_feature 420, 426, 427, 428, 437, 441, 443, 444, 445, 450, 456, 462,468, 474, 475, 476, 478, 479, 482, 485, 491, 494, 495, 503,504, 509, 511, 513, 515, 518, 521, 543, 545, 547, 549, 552,558, 560, 570, 572, 581, 586, 588, 590, 594, 595, 598: n = A,T,C or G
  misc_feature 600, 601, 603, 605, 606, 607, 608, 609, 616, 617, 621, 623,627, 630, 631, 636, 644, 646, 648, 649, 651, 654, 657, 659,662, 666, 670, 672, 675, 681, 685, 688, 692, 694, 703, 711,723, 724, 735, 738, 749, 753, 754, 755, 758, 766, 768: n = A,T,C or G
  misc_feature 771, 772, 773, 776, 779, 780, 782, 785, 786, 791, 793, 801,803, 805, 815, 818, 825, 826, 831, 832, 838, 839, 842, 843,847, 848, 849, 850, 854, 858, 862, 867, 871, 874, 877, 878,885, 893, 894, 898, 904, 918, 919, 922, 924, 934, 938: n = A,T,C or G
  misc_feature 940, 946, 957, 960, 963, 973, 979, 982, 986, 988, 990, 992,999, 1001, 1004, 1006, 1012, 1018, 1021, 1028, 1035, 1039,1041, 1043, 1044, 1046, 1051, 1052, 1054, 1055, 1057, 1058,1059, 1062, 1063, 1066, 1068, 1069, 1089, 1093, 1096: n = A,T,C or G
nggggncgatttttcnaaaaaatntccccnggngaacggggncaccttgggggncancnccangaaccnnttttgcnaaaaaccccntttggcncnaanannacccnngnnnancgcnctaccnacncgaanccnncncnacnccannggganccnanacaccgcncntcnntntaccanactanatcncncntaaacnacacnaancngcacnnacancacccaccgtatggtaaccnnnccangcacgagcacancacnncnaanagcncgccactaacggggcgggacnacncgatacanannnaccnagnaancnnacaacanacnctacacncgacnaacaancnnccagntncnaanccgccagacnccccanntcangnacaacncccnccacaccacccagannagaccacntccccnnncaccacccnaacnannnaaacnaccctncatcangaaccncccaannncnnccnacncacccnacnnccccccannccacngncnanccnaanagacacccacccccacaccctncncncnaanaacacntnacaccaccanancacaacaanaaccntncnccannacncnnanannnnnccacacnncccnancccnctnnccaanccacaccncncnncnccnacncnaancacncccnanctncactcnacancancacnanccccaatancacaccanccaccaccaaannccactcacacncanactatacagcngacnnnaancacctcananccnnnccnccnncnacnncctcncnccacccanancnacagactcanctnccagcanncaccnncgcccnnctnnctcnnnnacancacncatnagcancccncancgnncacaccncaccaccnnacanccaatncccacccacatccnnccncncctcctatancaancncccaanccgaccgactncanctngctcacgcanacatcncgncgcncntncnacactancnacncncacctnactctnacnatcgcanccatcgntccncncnnancacanncnnannngannatncnnccctccacataccactacancatnacngcnnccnnnatcnnnacatcnacgccaancnccacacgaaccncacgcntaaccatcacgacnaccccaccacgacnngctaancgacnacnctatccaagcnctncgcc

SEQ ID NO: 5875 - DNA, 750 bp, Homo sapiens
  misc_feature 4, 5, 8, 9, 10, 13, 14, 16, 17, 20, 21, 22, 23, 24, 25, 26,29, 30, 31, 32, 35, 36, 41, 722: n = A,T,C or G
gagnnggnnnttnngnnagnnnnnnnggnnnnttnnaaagncagctcttgttctttttgcaggatcccatcgattcgcgagttttttttttttttttttttatatatactgcaattttatttcaatcgcacaaacgaagttagcatgtaggaaacttaaatgaaacaaatttaaacgaaatagttacggtaaaaatagcagaaaactgaaaattctaaaaaggaagtacacctaaaagcatgagaattcaacattcattagtgtttcatcttcagttttgattgacacttgatgcttgcaaatttttaaacaaacttttaaatcatgatgactattctgaagagatttcagcaccagcactaagatttgtacattcagtttgtttgcaattgacttgtgagccatttacatagtggatagtacagacttgtcacaggtcagatcacagtgttgaggaaagcagtgccttcctgtcattagaaaggatcccctaaactgtctcagcttaagacatccaacgtacaagagcacaaaaccatcataataatgtggttccaaggaacgtggttttgataaggtaaataacttaggcttctgtttcccattttaattctgaaatctctaataatgacacaactgtcatgtatgatagcaaatgtatataataattcattcagacttcttggaaagaacatttagccaatctgggatgatgggaaatntagcatgattcaacactgggtttttttt

SEQ ID NO: 5876 - DNA, 820 bp, Homo sapiens
  misc_feature 3, 7, 381, 431, 518, 524, 577, 615, 646, 661, 670, 696, 703,708, 711, 725, 756, 791, 800, 812, 816: n = A,T,C or G
gtntttnaatttccaactcttgtctttgcggaccctcgattcgaattcggcacgagggtgggtcctggcttccctaaagataattggaagacttcattggattgatagagagaaactgcgtaatttcattttagcatgtcaagatgaagaaacggggggatttgcagacaggccaggagataaggtatgaaaaggatccaccatatcttatttggaattgctggattgcacttttgggagaagaacagattaaacctgttaatcctgcttttgcatgcctgaagaagtgcttcagagagtgaatgttcagcctgagctagtgagctagattcattgaattgaaagttgcatagtatagttttgccattttaacatttctgnatttgaaagtgcttatccgaatctaaaagtgactactggtaatattttgnatattgggttaaattaattttaataaattatataattatacatattggaaagcctcttagaactatagtgagtccgtattaccgtanaatccnggacatggattaggataccattggatgaagttttggaccaaacccccaacctnggaatgccaatggaaaaaaaaatggcttttaattttgnggaaaattttggggaaggcctattgcctttnaatttggtaaacccnttttttaancctggccaatttaaacccaaggtttnaaccaanccaanccnaatttggccatttncaatttttaaagggttttccaagggttccanggggggaaaggttttttgggaaagggttttttttnaaaatttcnccggggcccccngggngccc

SEQ ID NO: 5877 - DNA, 826 bp, Homo sapiens
  misc_feature 1, 2, 5, 7, 8, 23, 25, 26, 28, 31, 41, 47, 49, 62, 63, 67,71, 72, 76, 77, 79, 80, 86, 88, 97, 98, 103, 104, 105, 108,110, 112, 118, 122, 137, 143, 145, 149, 151, 153, 156, 160,171, 175, 178, 182, 186, 190, 195, 197, 199, 201, 204: n = A,T,C or G
  misc_feature 205, 208, 210, 216, 217, 225, 229, 230, 231, 232, 235, 242,243, 245, 246, 248, 251, 255, 258, 274, 278, 279, 283, 290,291, 293, 301, 302, 303, 304, 313, 315, 319, 320, 324, 328,333, 336, 363, 365, 367, 384, 391, 399, 409, 415, 418: n = A,T,C or G
  misc_feature 430, 440, 464, 466, 481, 484, 486, 499, 501, 505, 507, 520,524, 531, 536, 537, 540, 544, 548, 554, 559, 572, 575, 577,583, 590, 600, 608, 610, 615, 616, 620, 625, 626, 629, 656,662, 663, 670, 674, 677, 682, 685, 686, 688, 691, 700: n = A,T,C or G
  misc_feature 705, 706, 707, 713, 714, 725, 730, 733, 738, 741, 744, 751,752, 754, 755, 759, 761, 769, 775, 778, 780, 783, 795, 797,801, 802, 809, 819, 825: n = A,T,C or G
nnctngnngttctaatgcttggngnncntgntcgctggatnggatcntntcgttgccttgtnnactnggcnngacnngnntctgcncngccgttganncacgnnntantncnccaaangtanatgatgtggtatctnatgtcncnatcnangnttngaanaaccaaaatgncctnacntcgnaganaccntgtcncnantnggnnatncncaattnntccaggcntgannnnccntgcctgnncnncnagntacncantaggcctaagcagganactnntttntacccannangtgtaggnnnnggtgacccnanatcnngctnctgnactcnggnctgcgtgacatagctagactctgtctnanantcaagccctcaaagctngaacgtnttatacanaccctgtgtnaattcngangtgaaacgctgntgcctactgnaaatggggatttgggttagcgatnanataggctaaatcacnttntnatacgtgatcctngngtananttctgcccgaatnggtngtacgcntatannaanatanttcnttgttngatancatcttcctaccntanantttctngaaaaanaaagtttggnttttgacnancactnncacnatggnnttnggttgggtgcctgcttgcttggtttgnaatttnnagccccntaanaanacttnttnngngtnctggaatanccgtnnnattccnngacatcatttntagcntcnttgtnttnaantgggggnnannaccnanttgttttnaattcngantnaangaaaaatgcccntntttnncgaaatntttttgtggncctttnc

SEQ ID NO: 5878 - DNA, 826 bp, Homo sapiens; identical to SEQ ID NO: 5877
  misc_feature 1, 2, 5, 7, 8, 23, 25, 26, 28, 31, 41, 47, 49, 62, 63, 67,71, 72, 76, 77, 79, 80, 86, 88, 97, 98, 103, 104, 105, 108,110, 112, 118, 122, 137, 143, 145, 149, 151, 153, 156, 160,171, 175, 178, 182, 186, 190, 195, 197, 199, 201, 204: n = A,T,C or G
  misc_feature 205, 208, 210, 216, 217, 225, 229, 230, 231, 232, 235, 242,243, 245, 246, 248, 251, 255, 258, 274, 278, 279, 283, 290,291, 293, 301, 302, 303, 304, 313, 315, 319, 320, 324, 328,333, 336, 363, 365, 367, 384, 391, 399, 409, 415, 418: n = A,T,C or G
  misc_feature 430, 440, 464, 466, 481, 484, 486, 499, 501, 505, 507, 520,524, 531, 536, 537, 540, 544, 548, 554, 559, 572, 575, 577,583, 590, 600, 608, 610, 615, 616, 620, 625, 626, 629, 656,662, 663, 670, 674, 677, 682, 685, 686, 688, 691, 700: n = A,T,C or G
  misc_feature 705, 706, 707, 713, 714, 725, 730, 733, 738, 741, 744, 751,752, 754, 755, 759, 761, 769, 775, 778, 780, 783, 795, 797,801, 802, 809, 819, 825: n = A,T,C or G

SEQ ID NO: 5879 - DNA, 848 bp, Homo sapiens
  misc_feature 2, 3, 4, 5, 6, 7, 8, 10, 46, 81, 82, 85, 89, 93, 101, 115,127, 128, 139, 149, 152, 156, 157, 161, 164, 169, 174, 196,197, 198, 211, 233, 242, 263, 269, 276, 281, 287, 289, 300,308, 311, 315, 317, 322, 327, 331, 333, 335, 336, 355: n = A,T,C or G
  misc_feature 364, 367, 371, 372, 373, 374, 376, 380, 387, 390, 398, 399,400, 403, 418, 420, 422, 429, 430, 432, 433, 439, 444, 446,448, 457, 459, 483, 495, 516, 521, 523, 529, 533, 553, 555,556, 558, 559, 563, 568, 571, 580, 581, 582, 589, 601: n = A,T,C or G
  misc_feature 609, 614, 626, 663, 696, 702, 707, 727, 734, 737, 740, 741,747, 762, 763, 764, 773, 778, 784, 788, 797, 832, 833: n = A,T,C or G
gnnnnnnnanatcagctccttgttctttttgcaggcaggatatccnacgctaattctgcacgcacgaggctaaggttacannagnatgngttnccttgatnacaggtcactctcncaagatgcgctnnctgcagtcagntgcataactngtnaaannaccnganatagnaccanctttatatggtatgacagtgtnnncagtgggagcaanggtggtccatagcctgcctatnatatcaccnatatctgtgaacacactcatngcagantcagggncagcnatctgntnaatggacttgnattatgtntgnaccntngcttnctgtngacncngnntgagcgcaactttccttanggaccttanggnaccnnnntnaacntactttncanatgatggnnnttntgtcaatcccggatngntncacggtnncnnatggcnaaagncncnacctttatntnacacgttgacattactttacgacnctagtcacactnttggactccattgtccacatncctgntntatganaacnttaaggttttactttacaananntnnaccntggcnttncaaatgatnnnccctgcngacctttcattngcaagggncctanactttttgcatngaaaaattttaggtaaagttgcttttccgcttttagngccctttcctaggggtattaatttgggtggggntccttnccttntactttccccttggccccgntttttcnccnttnnggaaanccccccccttaattnnncccccgtgnttttncccccncccncaaaacccnggcaaaattaaaggggggggaaaattgcccccttnntttaaagcccgaagg

SEQ ID NO: 5880 - DNA, 715 bp, Homo sapiens
  misc_feature 1, 3, 4, 5, 6, 9, 13, 664, 681, 714: n = A,T,C or G
ngnnnnttnaaanatacagctgttctttttgcaggatcccatcgattcgaattcggcacgagggctattaaaaatgtaatcagtgtgaaaattcatgccatctgaatcgtacgagtatgtaagggatttgagttccttacagaattttctgtaatttagtacttcaagtgacttataaatgtatatacttctctctcacaaaagtgttaggagaaggaaaatcttaaatactagcttgatttcttaatttaataacaaaaaacaattctcataacatgtatcacctaacatgtcactttcactttaaaagtctaaagagttgaggtttatttcttttcttttaaagttgatgtttatgttggtgatttcgaaaagatcagatcccccgttatgaaggatcttaaccttgtcttttagatctccatgagaaatgcagtacatgtagcattagccatatttcttttttagaggcctatgtaggatatttataacctgtaaaagtttgatgacttcatgctcaggagaaagcaagtaattacctagccaagccaggtgggtgttcaggttagtggtaaacagaaaggagatgttgaaagatttcatatctaaagggtaaaaacacaagagaagtatatagagataaacatgtaaagtataagactgntacatagtaagctcctncgaagtggcagccattggtattatttttctgcng

SEQ ID NO: 5881 - DNA, 758 bp, Homo sapiens
  misc_feature 12, 15, 16, 484, 550, 587, 602, 603, 632, 648, 650, 660,669, 700, 702, 710, 724, 731, 742, 749, 750, 751: n = A,T,C or G
tgtttttgatcnagnnctcttgttctttttgcaggatcccatcgattcgcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtaatggaaagttttgnatcatagtaatcctgtttccactttggtatctctacccagattgactgtattagatgaaatgtgangatcttggtcaatcggaaaccccgtacctcctctttnctttctctttctttnntttttacttaacattttatgatgatttanatggaagtggtctttngnacttaatgtnggttccagncctttaactggtcaaaatttactttttacantnacattctnaaccttttttaaanaaggggntggggggtggnaaatgcnnnttaaccc

SEQ ID NO: 5882 - DNA, 1278 bp, Homo sapiens
  misc_feature 2, 9, 16, 37, 43, 51, 61, 66, 68, 74, 75, 77, 80, 84, 86,92, 94, 105, 110, 111, 119, 123, 127, 136, 144, 155, 156,157, 160, 169, 171, 176, 177, 180, 185, 190, 206, 208, 209,212, 220, 221, 231, 240, 241, 243, 246, 262, 265, 266: n = A,T,C or G
  misc_feature 269, 270, 274, 276, 283, 284, 292, 297, 299, 300, 310, 314,321, 324, 330, 332, 336, 340, 350, 358, 359, 366, 372, 374,375, 381, 384, 385, 389, 390, 392, 393, 408, 410, 411, 418,422, 424, 425, 434, 438, 442, 447, 450, 452, 454, 457: n = A,T,C or G
  misc_feature 458, 460, 464, 465, 466, 469, 475, 479, 484, 489, 492, 494,497, 499, 500, 501, 504, 505, 506, 507, 509, 511, 513, 515,516, 518, 519, 520, 524, 528, 529, 530, 531, 533, 534, 535,536, 537, 538, 539, 543, 544, 548, 549, 550, 551, 553: n = A,T,C or G
  misc_feature 554, 555, 557, 558, 562, 568, 575, 577, 580, 582, 585, 586,587, 588, 589, 592, 595, 606, 607, 620, 622, 625, 627, 633,636, 638, 639, 652, 653, 655, 657, 658, 669, 674, 675, 684,696, 699, 700, 701, 702, 704, 711, 715, 720, 728, 735: n = A,T,C or G
  misc_feature 746, 747, 748, 751, 756, 758, 759, 767, 775, 778, 781, 782,788, 791, 794, 795, 796, 799, 800, 808, 810, 815, 817, 827,828, 829, 830, 833, 835, 837, 847, 848, 850, 853, 857, 871,881, 887, 889, 893, 896, 916, 920, 936, 942, 944, 945: n = A,T,C or G
  misc_feature 948, 954, 959, 962, 969, 972, 973, 978, 982, 1002, 1005,1007, 1016, 1019, 1022, 1024, 1025, 1032, 1035, 1042, 1044,1047, 1058, 1060, 1061, 1063, 1070, 1072, 1075, 1077, 1082,1085, 1086, 1096, 1107, 1109, 1115, 1116, 1118, 1126: n = A,T,C or G
tnttggaangtgtagncttttttttgggaaaaaaaancccccntttttttngggggggaanaggtntncggggnntnttnatancnaatacncnattttttgaanaaaannaccccttntcangggnacaaatatnctaaattnacatctacatnnnaancaaattatntncatcnnatnggacncatantcgacacaccattttntnntancacacgtnnaacatacatntccaccacnntnaanatacctctctctccanttnncanncacncnccttctnntaatacantacancnngaaccccctntcgngggcccnatntatatnanaaancacnctacccatanatcacacnntataatnatcatncnncatacncannctcnnannccaaatgatgcaatnannaccacanactncnntcaatcccnccanaatnttacnccnananccnngnttannncancatacncaanccacnaccanatncntcncnnnacnnnncncncnannannnccancacnnnnannnnnnnaaannacannnnannnanncatncttctnaatatancnacnanaannnnncanacnacaaccactcnngactcttaaactncntananacactncantnnccccaagacacanntncnntaagatggacnacctnntaaacatcnacacctagatcnatnnnngnccccaanctanaactntcaatccntccagcnaacttcaactnnnacnacctnannaaaatctncgcacacnccnatnncacctnacntannnaanntacacccntnctatnanatactcacannnntcncntnttatatcaanntnttntcantaaaaaccacgttnaatatcaccnaactcncntatntcnaataagtacgctcacactanacanacatatatatctacanttttcncnnacncaacanctatngcnacaggantcnncaccngtanaacacctcactatcaaaatngcnancgtatcacnacngcnannagccatnccntacgacntntgncaaatcgaacncnntntaacaananatnanatctnctnnacatcacaantctatatctananactacnngngagggcanaaacacattcccacnnnctanntgtcnccacnataaccgnaatcnccnnaaacacatggnaanatccccactantcgnatcccacncttcaacacnaagancntaccacnntacgtanacnaangancttggggtnnaaanatacttncccc

SEQ ID NO: 5883 - DNA, 796 bp, Homo sapiens
  misc_feature 1, 3, 4, 5, 6, 11, 12, 15, 21, 22, 225, 339, 341, 350, 365,373, 405, 432, 446, 471, 516, 542, 568, 571, 584, 617, 623,629, 634, 663, 686, 691, 702, 731, 734, 746, 760, 788, 795: n = A,T,C or G
ngnnnnttttnnaanaccctnnctacttgttcttttgcaggatccatcgattcgtttttttttttttttttgactcttgagtggattttatttttgcactccaggatgcagtgaagacggtggaaggttcatcttcacaccgagggccctcagtgtcgaggtgactcccggcctgaggagggctgaggcatcctgaattttgagagttcgaggttgaggtctaanaaggtgtacgtgctgtaagtcatgatgctgcaggttcttgtaggtagtgttgtcaaacggctcaacaggcactggggctggctcctgtgtgccgcctcggtcgtcccctgcgcngntgcatcttncatgggctcgccctnggcctaanctttaacgctgctggcttttcatggaaacccngggtatttttcaaaagaactggcttcnaattgcttggtggnatctgatctttcacgaatggctgtncaccttcaagtgggcttctattcctgcgtcctgaggtttcctttntgggcaagggaaggggcccccttgcncttgggcttttggcaccgggtttttncanatgccccttttgncggccccaagaagaacttggctttgcaacttgncccttntggttnttggncctttttttggccaacacaaacaaggccnccttgggctttgccctttcgggngggcnccaaaacaaanccctgaatttttgtggtgggacaagggtnaangggtcccctttnaacctttcaaaaangggctttttgggcttttccttttaaccnaatttcna

SEQ ID NO: 5884 - DNA, 1308 bp, Homo sapiens
  misc_feature 6, 19, 29, 38, 40, 43, 45, 48, 50, 55, 59, 65, 67, 68, 74,77, 86, 89, 91, 92, 96, 97, 98, 100, 102, 103, 104, 106,107, 108, 114, 117, 118, 119, 121, 123, 125, 128, 132, 134,137, 139, 144, 150, 154, 158, 162, 163, 164, 165, 166: n = A,T,C or G
  misc_feature 170, 173, 189, 195, 196, 201, 202, 204, 215, 216, 219, 231,232, 234, 240, 247, 253, 254, 255, 258, 267, 271, 272, 274,275, 276, 278, 279, 280, 282, 289, 299, 300, 304, 308, 309,318, 319, 325, 326, 332, 343, 356, 358, 360, 361, 362: n = A,T,C or G
  misc_feature 368, 375, 379, 380, 386, 387, 390, 391, 394, 395, 397, 406,409, 415, 418, 427, 428, 430, 434, 435, 437, 438, 440, 442,445, 452, 454, 458, 459, 460, 461, 466, 467, 469, 471, 475,476, 480, 492, 495, 499, 500, 504, 505, 517, 518, 522: n = A,T,C or G
  misc_feature 524, 525, 534, 538, 543, 545, 552, 557, 559, 564, 567, 569,570, 572, 573, 578, 581, 582, 584, 587, 595, 605, 608, 615,619, 620, 623, 624, 626, 628, 632, 643, 648, 656, 660, 663,666, 667, 669, 679, 683, 686, 688, 695, 701, 703, 705: n = A,T,C or G
  misc_feature 714, 720, 723, 727, 732, 743, 745, 746, 748, 750, 755, 756,758, 760, 771, 774, 775, 780, 782, 787, 791, 796, 799, 805,808, 811, 814, 815, 824, 826, 828, 833, 835, 836, 838, 841,844, 848, 850, 851, 852, 860, 868, 875, 877, 878, 886: n = A,T,C or G
  misc_feature 888, 907, 912, 919, 924, 925, 928, 930, 932, 934, 944, 950,951, 953, 963, 965, 966, 967, 973, 978, 980, 987, 988, 993,995, 996, 998, 1001, 1004, 1006, 1007, 1009, 1010, 1011,1015, 1023, 1024, 1026, 1035, 1044, 1049, 1053, 1055: n = A,T,C or G
ggcttnaaacctttgaacncgcttattcngcggtccancnttngncgngntacgngtanggctgngnntaggcnttncattgcgangcngnncccnnngngnnncnnngttganccnnngngncngtntggntnagngnctacnaacttngaancgancagnnnnnggcnttntgggccgccactgccncgaggnntccanncnctagtcacccnnggngtacccttagcnncncttggntcctctngcaccnnntcntagaaaatncccnncnnnannngncttcttnagtgggtaanntccngttnnttccccccnntggggnncttttngtgcgcacatngcatcattacctntngnnnagtccntacactnatanntctggnnccnnaannancgtatcgtnctntagttnctnttgtgtcgnncntagnnanngntntanacgcatncnttgnnnnatganncntnctcnngttnatctctcatgtngcnctcnnagcnnacgctctctatnngtananncatctcganatcncgcantntaatatnacggnanatcgntcntnnanntattntanntncangcacttcntatgtatatnagntgcgtancgtnngannantnacantgcgactatancatcnggatagtncttnacntcnnanatcctctgcnatangtncnatactcngtatangncnctctatatntaacanagngtangtctntgcgtacctcncnngnantctanncntngggtattcatnatnncaccntntagtnaacnttacncgntgattnatntanccnnattcgtgtnanangacananncnctnatncaangnnntacgtatngcacatanctatgantnncctagatngntcgctcaactatcggcaanctctncataagntgtannttnanantnatgtagtctncctgtnntngaccgctatntnnntcgtanctacncnatccacnnaagananntnttngtngnntnnntatngctcaaanntnggtgttctnaatcccccntctcntttntntgnanagtntgcnanagttantcggnngngtagcgnntntacccctatnggagaggnttctnanttatgcgacatcnccannngannngnnaannacggcngggngnttcctctctggatntatnctcntanctctngcacgnncnnggctttntcanatnaaataccntgacntntnggtganncattngnnacnaangcgctgtgagatagnncccnntagataagtctatctgtatgctnncnccanccc

SEQ ID NO: 5885 - DNA, 776 bp, Homo sapiens
  misc_feature 2, 3, 4, 7, 8, 11, 12, 15, 16, 26, 32, 45, 50, 54, 55, 63,155, 157, 176, 208, 216, 237, 247, 254, 263, 284, 285, 286,299, 324, 333, 343, 365, 393, 395, 404, 405, 413, 462, 476,477, 479, 484, 494, 504, 507, 509, 513, 518, 524, 559: n = A,T,C or G
  misc_feature 562, 577, 589, 591, 597, 621, 622, 625, 626, 631, 642, 644,653, 656, 659, 660, 661, 666, 667, 669, 673, 722, 734, 736,742, 743, 752, 771, 776: n = A,T,C or G
gnnnttnnaannccnnggttttaganagggcngcaggttccccanacaanctcnntgcaagancggtagcattcattacctgtttattctctgctgcatcttacagaagagtaaactggtgagagtttatatgggtatatatatatatatatatnanatgtatatatatatatatngacttgctacatgaagatgtaaaaatcggttnttaaaggngatgtaaatagagatttcctnaatgaaaaanacatatngagaattgntctaatgcaacagaaaagccnnngaatctctaaggntcctgtatattccatgtataagtgnaaatataancagacagggntaaaagtggtgcatgtatgtanacagttgcaagtctggacaaatgtatanantaaaccttnnatttaagntgggataacctgctgcatgaaaagtgcatgggggaccctgtgcatctgngcataatggcaaanngncttanaagggccgancggaagatcnatncngacntgacngttganatgtcaggagctgacgacgaggggatacagcgggnganagaatgggcatcganaccaaggggctnanagaagnttccaatgggcgccacctttaaanntgnngattnacacaactccntncagggaatnggngtnnncccanncngacnttattcccagagtgtcccagtattagcaatactgggaatataggcacantaccaatcatantnagaaanntggggggtnaccccaacccaaatttgangcgan

SEQ ID NO: 5886 - DNA, 1105 bp, Homo sapiens
  misc_feature 6, 10, 11, 14, 17, 18, 20, 22, 30, 34, 37, 46, 53, 56, 60,70, 73, 75, 77, 78, 85, 95, 102, 104, 110, 118, 122, 131,136, 137, 139, 140, 144, 152, 155, 156, 157, 161, 172, 181,191, 196, 197, 198, 199, 201, 207, 210, 212, 216, 220: n = A,T,C or G
  misc_feature 224, 225, 232, 241, 246, 249, 250, 251, 252, 253, 257, 259,260, 261, 268, 269, 275, 276, 284, 286, 298, 304, 306, 307,309, 310, 312, 315, 316, 317, 318, 325, 333, 342, 344, 349,355, 356, 363, 370, 375, 377, 378, 379, 381, 382, 387: n = A,T,C or G
  misc_feature 388, 390, 395, 396, 400, 407, 409, 410, 414, 418, 419, 422,427, 428, 430, 433, 435, 436, 438, 442, 446, 451, 471, 472,473, 475, 479, 488, 491, 492, 495, 499, 500, 502, 503, 505,506, 509, 510, 513, 515, 518, 520, 521, 523, 525, 529: n = A,T,C or G
  misc_feature 530, 538, 539, 546, 548, 549, 552, 561, 565, 575, 576, 580,581, 594, 599, 603, 616, 631, 633, 634, 637, 654, 658, 661,664, 667, 672, 674, 675, 677, 679, 694, 695, 704, 705, 707,708, 712, 714, 718, 735, 742, 744, 745, 748, 750, 754: n = A,T,C or G
  misc_feature 761, 762, 764, 767, 772, 776, 778, 779, 794, 795, 799, 803,804, 805, 809, 814, 816, 817, 827, 830, 834, 837, 841, 844,845, 846, 851, 852, 853, 855, 859, 862, 866, 876, 883, 887,896, 898, 901, 904, 905, 907, 909, 911, 913, 918, 922: n = A,T,C or G
  misc_feature 924, 927, 935, 946, 948, 951, 968, 970, 975, 980, 981, 994,1001, 1002, 1008, 1011, 1023, 1024, 1025, 1029, 1031, 1035,1037, 1049, 1051, 1056, 1058, 1060, 1064, 1065, 1069, 1077,1079, 1080, 1082, 1084, 1085, 1092, 1093, 1099, 1102: n = A,T,C or G
gggggncggnnatnaanngntnggaaactnatcncangatagcgcnggattcngantggnttcgaaaacnctncntnncgatttnaaataaaatntttttcntntttccnctgaggancatnttgaagggnccagnngnnaaanaaataagnatnnngggntcaaatcctancaggctcanaaatgcctgnggttnnnntnggttcnttntngctntccnctcnnatatcanatcctgccntgacntgnnnnnctcntnnntcgcctnnccatcnntgacatcncncatggcatgtancaaccntnncnngntannnnttaaacnacacttgnattgtctgnantgttngaaatnnaacaatngcaaccncccantnnnanngggcnngnccagnncaanacttggnanncttntcannatnatccnntnccntnntncccncatngttantcacttgtataacatttcannncncganctttatatntgnnttnttgnnanngnntanntancntcncnngnanccanntagagatnntggtgcngnnctnccataaaanggtnctatttgctnncacnntacatcagcctanctctnaatntttagtacaggcnacgggaatatttccncnnggnggacaaaatattcgcgngganatnagnttnttttngnncngngtaccccatcccgannattatactnntnnatangngatntaaactctataaagtcnatgtcananntantnaggngagtctnncntgnaaaanaaangnngctcatgatctctcnntatntatnnnatcnctccnannctacaatctntanccanttnacgngcnnnattannngngggncanattncacgtgtccntctaagncccntgtgtctananacnganncntngnantcaancgcnanagngcgacacnccgatactaantntgnacttccataccaattantnatgtntcatnncccgacattaatnagggtcnnaatttntanaatcaatgtctnnncacnanatcngncgtattccaagntnatatntntnaagnnaccnctctagcncnnananncactttnngtcgtntangcc

SEQ ID NO: 5887 - DNA, 759 bp, Homo sapiens
  misc_feature 7, 9, 11, 20, 52, 277, 303, 405, 462, 575, 672, 714, 715,719, 720, 748, 755, 756: n = A,T,C or G
gtctaangnancagctactngttctttttgcaggatcccatcgattcgaatncggcacgagcttccttgtataatactgatcattctattttagcggtaagaacccaagaaggagtatggatacctgtaaagctttctggtccttgggaagcctctccttctgtgcatattattactgaaattcttcaaaagattctgagatgctctcagtgtttcattgctactttaattttaatcattatgggattgattgctgtcacagctactgccgcggcanctggagttgctttgcatttcacagtncaaacagcagactatgtaaataattggcagaaaaattctactttgctgtggaattcccaaactaatatggaccagaaactagctaatcaaatcaattatctncaacaaactgtaatgtggctaggagattgagtagttagtctagaatatagaatgcanttacaatgtgattggaatacttctgatttttgcattactcctcatctgtataatgaaagacagcatgagtgggaaagagttaagaaacatttgaaaggtcatactggaaattnactttagatattatgcaactgaaggaacaaatatttcaatcttctctggcacatctgacactaatgccaggaactgaagtgcttgaaggcgcttcanatggataacagctattacccattaaaatggatcaggaccaannaaannaaaaaaactccgagcctttaaactttgnggagtcnnttc

SEQ ID NO: 5888 - DNA, 1444 bp, Homo sapiens; identical to SEQ ID NO: 517
  misc_feature 6, 8, 9, 11, 12, 13, 14, 16, 17, 18, 24, 25, 27, 28, 30,31, 32, 33, 34, 35, 37, 38, 40, 41, 42, 43, 47, 48, 49,50, 52, 53, 54, 59, 60, 61, 62, 63, 65, 66, 69, 70, 71,72, 73, 74, 75, 77, 79, 80, 82, 86, 93, 95, 97, 104, 106,111: n = A,T,C or G
  misc_feature 113, 120, 123, 129, 132, 134, 135, 137, 138, 141, 142, 145,148, 149, 150, 152, 154, 157, 158, 159, 164, 168, 169, 173,176, 182, 183, 185, 190, 193, 194, 196, 197, 205, 208, 212,227, 230, 231, 244, 257, 260, 262, 265, 269, 273, 274: n = A,T,C or G
  misc_feature 277, 281, 285, 288, 290, 298, 305, 309, 310, 314, 320, 324,326, 328, 338, 341, 342, 343, 348, 349, 353, 367, 376, 378,384, 385, 388, 403, 408, 412, 417, 423, 429, 435, 436, 438,439, 440, 442, 449, 450, 454, 455, 456, 458, 461, 462: n = A,T,C or G
  misc_feature 464, 469, 470, 473, 480, 484, 485, 486, 499, 500, 502, 504,505, 509, 511, 518, 519, 521, 523, 525, 533, 534, 537, 539,540, 541, 544, 545, 546, 547, 548, 549, 552, 553, 556, 557,560, 563, 564, 570, 574, 578, 579, 581, 582, 583, 585: n = A,T,C or G
  misc_feature 594, 596, 597, 602, 603, 605, 606, 610, 611, 612, 613, 617,622, 623, 626, 627, 632, 633, 634, 636, 639, 648, 651, 654,655, 662, 666, 669, 670, 676, 678, 685, 689, 694, 701, 703,705, 707, 709, 712, 717, 726, 731, 736, 741, 751, 752: n = A,T,C or G
  misc_feature 754, 775, 779, 781, 789, 790, 800, 801, 802, 804, 810, 813,820, 821, 822, 834, 836, 843, 844, 846, 875, 877, 891, 893,895, 899, 901, 904, 905, 910, 912, 919, 924, 927, 936, 938,944, 945, 948, 970, 978, 979, 980, 981, 982, 983, 996: n = A,T,C or G

SEQ ID NO: 5889 - DNA, 1027 bp, Homo sapiens
  misc_feature 3, 5, 25, 32, 33, 42, 43, 47, 49, 73, 74, 82, 96, 98, 102,110, 117, 159, 165, 169, 172, 181, 183, 188, 190, 202, 203,204, 206, 209, 215, 216, 224, 232, 235, 242, 250, 256, 257,259, 267, 268, 270, 272, 274, 275, 285, 286, 287, 294: n = A,T,C or G
  misc_feature 302, 306, 310, 316, 318, 322, 326, 328, 345, 348, 352, 353,362, 364, 370, 371, 374, 381, 388, 395, 401, 402, 413, 417,418, 419, 420, 421, 423, 427, 428, 429, 430, 431, 433, 436,438, 440, 441, 442, 445, 448, 451, 452, 454, 464, 466: n = A,T,C or G
  misc_feature 469, 472, 474, 475, 478, 479, 483, 486, 488, 492, 493, 497,499, 503, 506, 509, 512, 515, 517, 518, 521, 522, 523, 524,525, 529, 532, 534, 535, 536, 537, 540, 542, 545, 546, 550,553, 554, 556, 557, 560, 562, 563, 565, 566, 570, 572: n = A,T,C or G
  misc_feature 576, 578, 579, 580, 584, 585, 587, 588, 589, 591, 592, 593,594, 595, 597, 602, 604, 605, 613, 616, 618, 621, 623, 625,626, 629, 631, 632, 633, 634, 637, 638, 640, 641, 645, 651,654, 655, 656, 658, 659, 660, 661, 662, 665, 667, 668: n = A,T,C or G
  misc_feature 669, 672, 674, 675, 679, 685, 690, 696, 700, 701, 702, 704,705, 709, 711, 712, 714, 715, 716, 717, 718, 720, 721, 726,727, 735, 737, 738, 741, 746, 747, 748, 750, 751, 752, 758,761, 763, 764, 767, 768, 773, 775, 776, 783, 784, 789: n = A,T,C or G
  misc_feature 791, 793, 795, 796, 797, 808, 810, 811, 814, 817, 819, 821,822, 823, 827, 828, 833, 843, 844, 848, 852, 853, 859, 864,866, 867, 882, 884, 885, 886, 889, 893, 894, 896, 897, 901,903, 906, 911, 912, 914, 919, 923, 928, 932, 934, 936: n = A,T,C or G
agngnttccttcccccctttatttngaaaaannggcgccctnnttcnanaattggccactttttcctggtccnnggggaatnccccaatacgcatntncggnaaatgtgncgggtcnaccgatagtcccaaaacctctggggccattgcaaaaaggggnccccangggncgntcttacaangnatttntnttttataccctnnntnggnggacannctgccagntctaatcnaancgggtgngattattngggggnngncacccttnngncncnnataatatatnnnggctccncatgtganggcncccnccatangnagtntatncncctcactataattatcntantcanncgcaacaantntatacnngtngtatacnttgaatnaagaatnccactnntatgctacgantatnnnnntngtcnnnnngntgntntnnnctnaantcnntnactacttctncntgnacnanntanntcgnacntncacnncctncnctanatntgntanttnanntcnnnnnctcnctngnnnntcntnacnngacntanntnnatngnnanntaananactnannntaannannncnnnnntntttcntnnttctacgnctncntancncnnacncnnnntcnntnnctanactctnttnnnannnnntantnnntcncnnaccnctgatntattncctcantatnnntnnttcntnntnnnnntnncgctnnaccatacnannacnacatnnnannnctgatntcncnntanntcctncnnccattcnncatgncntntnnntatcctctcanannaanatntntnnntganntacgntgtatgtctnnctcncgannataccncatcntnnctactagataccacnannnctntacnntnncacntntcnatatnnantatantctnctacntcancnanctctngntntatctgangacacatatntcnngatnacactgntccaantnaactcnagnnnnaccanggtcatcgacnctatncncncccc

SEQ ID NO: 5890 - DNA, 748 bp, Homo sapiens
  misc_feature 1, 3, 5, 15, 21, 34, 729, 744: n = A,T,C or G
ncntntttcctctcnaatcgnttggtgttctttntgcaggatcccatcgattcgggtctacagtatgtagaagcagcaagttagtattaatgatgatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgttgaaatccctcctaataaagctgttgtgttgcggggccatgaatctgaagtttttatctgtgcctggaaccctgttagtgatctcctagcatcagggtctggagactcaacagcaagaatatggaatcttagtgagaacagcaccagtggctctacacagttagtacttagacattgtatacgagaaggagggcaagatgttccaagcaacaaggatgtcacatctctagattggaatagtgaaggtacacttctacaactggttcctatgatgggtttgccagaatatggactaaagatggtaccttgctagcaccttagggcagcataaaggccctatattgcattaaaatggaatacgaaaggaaattcatnctaaatgctggattnacaa

SEQ ID NO: 5891 - DNA, 825 bp, Homo sapiens
  misc_feature 2, 3, 4, 5, 6, 7, 8, 9, 10, 15, 20, 37, 193, 270, 329, 357,403, 411, 454, 469, 476, 515, 611, 629, 666, 671, 674, 686,694, 697, 700, 708, 723, 744, 745, 746, 747, 748, 759, 761,764, 778, 781, 782, 791, 792, 801, 802, 803, 807, 815: n = A,T,C or G
  misc_feature 821: n = A,T,C or G
gnnnnnnnnnttttnaaagnccagctcttgttctttntgcaggatccctcgattcgaattcggcacgagcagaaaagttactgcagcttaaacaggaaaacccttcttgttcaggactgtcatagccacagtttgcaaaaagtgcagctattgattaatgcaatgtagtgtcaattagatgtacattcctggnggtcttttatctggtggtagctttgtctttttctttttcttttcattacatcagggtatattgccctggaaaattgngggtagtggtacccaggaaataaaaaaattaagggaatttttaacttttcaatatttgngtagttcaagttttctacattttaagtnccagaaacttttacaaaaatgccagtttcgaaaggtgtttccttgnggaagttnaccaagttaaaggaagatcattgggtaaattactatttttggnatggaaattttgctnaaagttnactggtaaaggaaacacctgctgactttgcaagtttaanggggaatctattcttcccattttccaaacccatggatatggaatggggcccctgaccatgtgggaagaggaattggataatttggggtggtttgcnatggggtggttttagatnaattgggattggggtattttaaaattaaccatttggnggaanttnaataggcctttnaagaatanccnttnaaaatggnaaaaaaaaatcttcnaaaaatttccaaaaaaaaaannnnnaaaaaacctcnanggnccttttaaaacttnttnnggaagtccnnatttacctnnnaatncccgaccntggatnaaga

SEQ ID NO: 5892 - DNA, 707 bp, Homo sapiens; identical to SEQ ID NO: 5854
  misc_feature 2, 12, 16, 594, 595, 596, 597, 598, 603, 605, 610, 611, 612,614, 615, 616, 617, 619, 623, 624, 626, 648, 653, 656, 664,676, 691, 695: n = A,T,C or G

SEQ ID NO: 5893 - DNA, 762 bp, Homo sapiens
  misc_feature 1, 3, 19, 344, 499, 664, 671, 735, 751: n = A,T,C or G
ngnttttaaatcagctctngtcttttgcaggatccctcgattcgaattcggcacgagagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccancaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccganagcatgcccttctggcttacacactgggtgtgaaacaactaattgtcggtgttaacaaaatggattccactgagccaccctacagccagaagagatatgaaggaaattgttaaaggaagtcagcacttacattaagaaaattgggcttcaaccccgacacagtancatttgngccaatttctgggtggaatggtgacacatgctggagccaagtgctaacattgccttggttcaanggatggaaagtccccntaaggatggca

SEQ ID NO: 5894 - DNA, 761 bp, Homo sapiens
  misc_feature 32, 38, 39, 43, 46, 54, 68, 124, 125, 153, 179, 181, 204,209, 211, 212, 218, 220, 228, 232, 233, 236, 239, 241, 249,250, 255, 257, 259, 264, 266, 269, 273, 280, 282, 284, 287,288, 293, 297, 300, 314, 318, 323, 328, 330, 333, 340: n = A,T,C or G
  misc_feature 343, 354, 357, 358, 359, 367, 374, 390, 398, 405, 418, 462,465, 466, 468, 475, 484, 486, 489, 497, 500, 512, 521, 524,531, 533, 534, 538, 546, 558, 559, 562, 572, 576, 579, 589,590, 596, 598, 607, 623, 625, 628, 629, 638, 649, 654: n = A,T,C or G
  misc_feature 666, 676, 681, 686, 690, 691, 696, 698, 699, 705, 712, 713,715, 716, 753: n = A,T,C or G
tgcttgctcttgttctttatgcaggatcctanctcccnntccnggnaggagganacagttactgactntcccgcagacgtggtgctctttgaagggatcctggggcagaatgaggtggactatnnccagaagcaggtggtcatcctgagccangatagcttctaccgtgtccttacctncnagcataaggcctaagccctgaanggccngnncaactntnaccacccngatnnctntgncnatgaactnnttctnantncactnanagnaatnactgatngnanagnngtgcngatnccngtgtatgactatgnctcncattnccagnangtnccgatanctntccctgatganacnnnttgagganacagatncggacacccgggtctnacgcaaantattaanggacatcagcganagatgcagggatcgttgaacactataacatcgtcacttcattanatnncntcaagcntgcctttananganttctcctntgncaacaacagatncctggcttntanaggatcntnncatngaggttcncaatagatactnngtnggacaaacancctnatntgtgcaattnnattccntngaccatccntttaatgggaaagggncnttnnaaacggggnaaacccaattngttgncctaaaaggggnataaaacccnttttnaaacnaggnntgtangnncttcanaacttgnnannaattatggcccccattttaaccctttaatggcttttngtcccccg

SEQ ID NO: 5895 - DNA, 847 bp, Homo sapiens
  misc_feature 1, 2, 23, 35, 41, 47, 48, 50, 51, 52, 53, 55, 57, 58, 60,65, 71, 74, 76, 96, 98, 117, 119, 130, 133, 166, 173, 183,192, 200, 201, 202, 203, 226, 248, 261, 271, 275, 277, 281,288, 290, 306, 312, 314, 337, 338, 373, 394, 412, 417: n = A,T,C or G
  misc_feature 422, 430, 432, 458, 478, 479, 484, 485, 487, 490, 491, 499,512, 515, 518, 525, 530, 543, 579, 580, 587, 624, 626, 644,648, 651, 679, 694, 696, 697, 714, 718, 720, 728, 745, 749,770, 772, 773, 777, 778, 780, 785, 796, 804, 814, 833: n = A,T,C or G
  misc_feature 842, 843: n = A,T,C or G
nngtctatagctggctctcgctnttgtgctgatcncatgancccatnnannnnantnngncccgntgaggnctntnatttgcaccatgttcgagtnanggtcctttcctaaacatgntntaaaaatatanatncgatggcttatttaaaatgtccctatgcatggngaaatgntaaataccangtggatgantggttctnnnntatattgtgaatggagaattatncacaatgcatctatatgtgtanactaataatgtanaatatgctcncttntnctgntctgtgnanaatgtgctctaaaatnccctgntngtgggtagcatgggctggacagnnattgattttcagaaaaatgcttggcttttgggttnttggcaatagggaagcctgcngcaaattatctcatttgncaaanaaaanttattttnancctatttgaatgtatgctatcttcantacgcttccatcttatgatnnaaggnntntcnnatttctantccaagacttcgngcntanactgtcncagtngggcatttgatgncttgtcaccagtggaaacctgaacggaaaggggctnnaggaccnaccttattccttaaggcccctggagaaaaacccgttnanttgggctccttagaactngctngcnggggaaacctggaaaacccttgcccctngtttttaaagggggngnnccttgggtttcccattngggngnctttaaanaaattttgggggccccnaccnaaaatttggccccggggattncnnctanntnggctngcccttttaantccttaanttaaaaaggncccttacaattttgggcanttggggggnnaaaa

SEQ ID NO: 5896 - DNA, 747 bp, Homo sapiens
  misc_feature 5, 6, 7, 8, 9, 10, 11, 16, 17, 40, 47, 53, 57, 59, 63, 71,72, 95, 157, 164, 177, 206, 207, 226, 238, 258, 271, 294,308, 311, 312, 335, 346, 353, 367, 377, 385, 388, 390, 399,400, 409, 418, 425, 431, 436, 454, 459, 472, 476, 480: n = A,T,C or G
  misc_feature 484, 490, 492, 493, 497, 500, 509, 520, 540, 543, 546, 550,565, 568, 569, 584, 587, 596, 604, 606, 607, 610, 613, 617,619, 637, 639, 648, 649, 654, 657, 661, 673, 678, 687, 688,689, 690, 712, 721, 731, 740, 745: n = A,T,C or G
agagnnnnnnnttttnnctaatggctggggatagtctggnctttttncaggtngccnancgantcgaattnngcacgaggcttggatctttgtcnaaaccggttatgtatgtcaaggaggagtttaaggcctttccgcaccaccttgtgtatccctngcctgcncagcgcatgtatnacgtggagttgctccttaccacaccttanntgcccctgagccctatttnctagatttcttngtgggctggaaacccccgtnctccaccagcatntccattatcccaaactttctagncctgctgatcctancannaacggggtggaaactggagggcngcgttctggcngttgtcnaagaaacttatganttctattatnagtacaangangntaaaatggnnccaatattntttactaanctcatgntatatngagangaaactcctatgatctgnttcangaaggtggttatngctnggcngttnacgggntnnttanggntaccaaatntaactctgctntcataccttaatctgactantcnagnattnttagatgtttggggnganncatcctcttaaaatnggnaccagggcntggcttcngnngangcngtgntnaccaagtgaactatatgngntctcatcanntgctntangccnactggaaacacntttgncccgcaagnnnngctgttgagtcgatgtactgcnttcccattnatggctacanttgcttatnaggtngc

SEQ ID NO: 5897 - DNA, 1014 bp, Homo sapiens
  misc_feature 2, 3, 4, 5, 6, 7, 11, 12, 13, 14, 24, 31, 37, 39, 44, 55,70, 71, 72, 75, 81, 84, 85, 87, 88, 92, 93, 95, 99, 102,106, 108, 109, 121, 122, 123, 124, 127, 132, 133, 138, 146,157, 159, 162, 168, 174, 178, 183, 188, 190, 194, 195, 196: n = A,T,C or G
  misc_feature 197, 203, 206, 208, 209, 219, 224, 235, 247, 248, 250, 251,254, 257, 258, 264, 268, 271, 285, 286, 291, 292, 296, 297,306, 313, 318, 323, 326, 330, 332, 335, 338, 339, 345, 347,349, 356, 358, 360, 362, 363, 369, 370, 382, 384, 387: n = A,T,C or G
  misc_feature 393, 394, 404, 407, 411, 413, 418, 439, 442, 445, 458, 461,478, 489, 492, 509, 510, 511, 516, 522, 552, 555, 573, 582,605, 621, 623, 624, 627, 628, 632, 642, 658, 660, 663, 692,715, 722, 726, 727, 728, 733, 738, 739, 744, 753, 757: n = A,T,C or G
  misc_feature 769, 793, 804, 807, 808, 809, 811, 822, 823, 824, 825, 826,828, 829, 830, 831, 832, 862, 896, 925, 926, 927, 928, 929,930, 931, 945, 959, 960, 967, 969, 970, 971, 972, 979, 983,985, 993, 995, 1009, 1011: n = A,T,C or G
gnnnnnnctgnnnntttaatcagnctcttgntctttngnagganccctcgattcnaattcggcacgaggnnntgntccttntgnncnncccnngntggnganatcnanntggcttgtcttnnnncgnacgcnngaagnaacgggcntctcacgcgcntntgnattgtntgacanggancatgnacctncntacnnnngccatntgntnntccaactgcntgaanggctaatcctnggcctgctctcnnannggntgnntgtggnaaanggngtttggtttaaaanncatannaatnnccttccatnattcagnctgtnttttnacngggnanttnatnntcaatncntntagctgntnancnncggcanngctcaattaatncntgnactctnnattttccctnccnttgnanttgcnatcacattaatgcggatcaanatnggnttttatgaggaanttntctcgacttattaaggnacccccaaccntgngctagtgatttttcaannncatgnttgcangaaaaaaaccctttcaaaaaccttaatggnaantttctttgaggcttaaanaataaaatncctggggggtttacttggggggnccaagcggggggggantnnaanntttngccttctttnttttgggaaccttttnanccnttgggaaatggaatgggaccctccccccnttttttaggggtaaatcccaaanggggccnttgnnngcggnccccnnaaaangtggggganatcnaaccctggcttngggggattttaaaaaaattttttnccaaaaaattnggnnntntttttttttcnnnnncnnnnnaatggggggaaattttttttttggggcccnaaaatttaaaccccggtttttttctccagggggnaaaaaaaaaaaccttttttttttttcccnnnnnnnaaaaaatgggggtnttaacccaaaaaanncccggtngnnnnccttttnaaancnccaaaaancntttttttcccccgnanggg

SEQ ID NO: 5898 - DNA, 762 bp, Homo sapiens
  misc_feature 5, 6, 7, 8, 9, 10, 11, 12, 13, 16, 19, 20, 89, 96, 104, 107,146, 161, 195, 198, 215, 243, 246, 248, 249, 269, 273, 297,300, 306, 309, 310, 313, 320, 330, 334, 336, 337, 347, 348,350, 352, 363, 399, 420, 427, 455, 469, 535, 547: n = A,T,C or G
  misc_feature 549, 555, 563, 573, 591, 622, 628, 641, 644, 660, 683, 707,736, 746: n = A,T,C or G
agagnnnnnnnnnttnttnnctacttaattgcttggctacttgttctttttgcaggatcccatcgattcgaattcggcacgaggcattncctgctnggaacctngtntactaatttccactgcttttaaggccctgcactgaaaangcaagctcaggcgcnggtggtcgttgtgacccaacctgcagtcggtccnggnccggccccccagaactncaactggcaaacaggcatgtgtgactgnttnanngactgcggagtctgtctctntggnacattttgtttcccgtgccttggntgncaagtngcnnctnatatgantgaatgctgnctgngnngaacaagcgnngnantgaggactctntacaggacccgatatggcatccctggatctatttgngatgactatatggcaactctntgctgtnctcattgtactctttgccaaatcaaganagatatcatcaganggagagccatgcgtactttctaaaaactgatggtgaaaagctcttaccgaagcaacaaaattcagntgacacctcttnanttgagntcttcacnatcttttgcnactgaaatatgatggatntgcttaagtacaactgatggcatgaaaaaantcaaantttttgatctatnatnagatggaatggttgtnccttgactttagcttaaatgggngcaactttaggtttcttcttgctntcatattatccgaaatttcctggcttatnaacttttttnaaattaccatttgcaa

SEQ ID NO: 5899 - DNA, 1024 bp, Homo sapiens
  misc_feature 1, 3, 4, 5, 6, 8, 10, 12, 14, 32, 36, 57, 62, 64, 70, 90,123, 180, 189, 223, 252, 294, 298, 307, 335, 340, 343, 351,353, 389, 413, 414, 455, 464, 483, 492, 493, 509, 527, 536,545, 547, 550, 551, 552, 556, 558, 572, 590, 610, 611: n = A,T,C or G
  misc_feature 624, 627, 628, 629, 633, 637, 638, 644, 645, 650, 660, 665,666, 675, 678, 682, 693, 725, 728, 733, 742, 745, 747, 751,763, 764, 765, 768, 789, 790, 792, 794, 795, 796, 797, 803,804, 811, 831, 833, 834, 835, 837, 839, 840, 842, 843: n = A,T,C or G
  misc_feature 846, 847, 855, 867, 886, 891, 897, 903, 904, 905, 922, 927,933, 934, 936, 939, 941, 943, 946, 947, 948, 959, 973, 984,993, 1005: n = A,T,C or G
ntnnnnangnancnctttgaaacgcctctctngtangcggatcccatcgattcggtntgcananggcacnaggctgctgggcctggaagnccttttggggccactcgctaattctcatgtgtngctccggcccctccagctgcaggtgggtgtggagtttgaggccagcacaaggatgcnggacaccancgtctccttcgggtaccagctggacctgcccaanccaacctgcttttcaaaggtaaaggtctnggtttccctacgcgggaaacaggcaggaagtgactcaacttntgantgggatgtntgggccaccacaggtgctggaggacagngagcntgncacccttntngggcctccacattacccggggaacacttgttaaaangtaatgtggggccgggtgccggtnngctcacgccctgtaatcccagcactttttgggaaggccaangcgggcccnaaggtaatgggagaattgnagacccatnnctgggtttaaacaccnggtggaaaacttccgttnttttaactnaaaaaattncnatnnnaccnanaaatttaaaccccnggatagttgggttttccngggttgccctaaattgggtnnccaaaaccttacntgnnngggntttnnaagggnncgggnaaaaaaaatngggtnnattgaaaanccnccangtaaaaggctngggaaaccttttggctcggagtaaaaaccccnaanaaaancccgtggcncanancccnggaaaattttcnnnaanccccctggggggcccgaaccnntntnnnnccaaanngaacttntccaatttttttaaaaaaangnnnanannannacnnataaaaangctcttggggtnggggacaaaaaaccccctnttttnacctantggggnnntaattggcctttggggngaaanaaaaannanaanantnttnnntataaaaaaantcgggccctaaacncctttgagggntgagatttnaaaacccccttngtttaattatcccccgcct

SEQ ID NO: 5900 - DNA, 822 bp, Homo sapiens
  misc_feature 2, 3, 4, 5, 7, 12, 13, 14, 16, 17, 18, 19, 20, 22, 23, 24,25, 33, 34, 36, 38, 40, 44, 45, 46, 49, 51, 53, 56, 58,59, 60, 61, 64, 68, 70, 75, 78, 86, 91, 92, 98, 101, 104,120, 122, 125, 132, 141, 153, 162, 164, 165, 173, 188, 207: n = A,T,C or G
  misc_feature 222, 223, 225, 230, 232, 236, 242, 247, 253, 258, 264, 271,277, 289, 304, 307, 311, 317, 330, 331, 333, 341, 346, 399,408, 409, 420, 423, 424, 425, 446, 456, 461, 463, 465, 470,471, 472, 475, 481, 489, 493, 495, 499, 501, 503, 507: n = A,T,C or G
  misc_feature 511, 514, 522, 526, 536, 541, 543, 544, 545, 546, 547, 556,578, 588, 601, 611, 639, 648, 651, 656, 657, 664, 669, 675,678, 681, 682, 687, 689, 690, 691, 700, 711, 712, 713, 715,721, 732, 742, 743, 749, 756, 757, 761, 763, 766, 767: n = A,T,C or G
  misc_feature 768, 772, 778, 780, 784, 785, 790, 792, 794, 795, 801, 803,804, 805, 807, 813, 820: n = A,T,C or G
tnnnntnaaacnnnannnnntnnnntcctgaannanancntaannncanananacnannnnatnaaangncttcnaanctggaaancttcnncgctcnagnagnaagacggggaaccagngnctnacgagcnagacaggtnccaattaggacntcatctggncnnctgtcagncatcaatgaggggcncaatgactatagcttggancacagaccacacacnncngcgangntgcncggctngaagnattatncacanctgcgnccccaanggggcnaggtgatggagnataccaccatccttnggntgcncgaggnggaatttgccagnnangggaaatntcagngtgtcatctccaatcactttggttcatcctactctgtcaaagccaagcttacngtaaatagnnggggattaaangannnctttggcattttaagattccnaggggccaanaaaangnanaaacnnntcnctcggnaatgttancccngnaggntntnatgngagntanccacctgnctcnttctttaccnacctnannnnncacagaatnaagatacttgggtatctgtatntaaacctgcnattatgggtgaanacgacaccgnactcaattgtggatgagtaacacaacanatgaaccanacntgtanntgctcanttttngacccnttntcnnttatnannnagctgaggncggcaatcttnnnantggttnccccaaaaggnttggaatgannatcccnggggttnncaantngannnttgnaatatngnagcnnaaatngnannttcaancnnntngggagnaaaaaancg

SEQ ID NO: 5901 - DNA, 1103 bp, Homo sapiens
  misc_feature 16, 25, 30, 31, 32, 37, 39, 40, 41, 42, 50, 74, 78, 101,110, 113, 123, 149, 156, 157, 160, 162, 163, 164, 167, 170,172, 173, 174, 176, 177, 179, 180, 181, 182, 183, 184, 185,186, 188, 189, 190, 191, 193, 194, 196, 197, 199, 201: n = A,T,C or G
  misc_feature 202, 203, 205, 206, 207, 209, 211, 212, 213, 214, 215, 216,217, 219, 223, 224, 225, 226, 227, 228, 230, 231, 232, 233,234, 235, 236, 237, 238, 239, 241, 242, 243, 244, 245, 246,247, 248, 249, 250, 251, 252, 253, 254, 255, 256, 257: n = A,T,C or G
  misc_feature 259, 260, 261, 262, 263, 264, 265, 266, 267, 268, 269, 270,271, 272, 273, 274, 275, 276, 277, 278, 279, 280, 281, 282,283, 285, 286, 287, 288, 289, 290, 292, 294, 295, 296, 297,298, 299, 300, 302, 303, 304, 305, 306, 307, 308, 309: n = A,T,C or G
  misc_feature 310, 311, 312, 313, 315, 316, 317, 318, 319, 320, 321, 322,323, 325, 326, 329, 330, 331, 332, 333, 334, 335, 336, 337,338, 339, 340, 341, 342, 343, 344, 345, 346, 347, 348, 349,350, 351, 352, 353, 354, 355, 356, 357, 358, 359, 360: n = A,T,C or G
  misc_feature 361, 362, 363, 364, 365, 366, 367, 368, 369, 370, 371, 372,373, 374, 376, 377, 378, 379, 380, 381, 382, 383, 384, 385,386, 387, 388, 390, 391, 392, 393, 395, 397, 401, 402, 403,404, 405, 407, 408, 410, 411, 413, 414, 415, 416, 417: n = A,T,C or G
  misc_feature 418, 421, 422, 423, 424, 426, 429, 431, 432, 433, 434, 436,437, 439, 440, 441, 442, 443, 444, 445, 447, 448, 449, 450,451, 452, 454, 455, 460, 463, 467, 468, 469, 470, 471, 473,474, 476, 477, 478, 479, 481, 482, 483, 484, 485, 487: n = A,T,C or G
cggggaaaaactcctncaaaaaaancagannnacctnannnnaggaggancccttaaaaaaatatggaggcccnttgngggggaccccccccaaaaaccanccaagaaanaantaaggggggncccttggggggggggatgaaaataanggggggnnccntnnnggnggnannnanncnnnnnnnncnnnnannannanannnannncncnnnnnnnanaaannnnnncnnnnnnnnnncnnnnnnnnnnnnnnnnncnnnnnnnnnnnnnnnnnnnnnnnnncnnnnnnancnnnnnnncnnnnnnnnnnnncnnnnnnnnnanngcnnnnnnnnnnnnnnnnnnnnnnnnnnnnnnnnnnnnnnnnnnnnnncnnnnnnnnnnnnnannnncncncaannnnnanncnncnnnnnnccnnnncnccncnnnncnncnnnnnnncnnnnnncnnaccancanacannnnncnncnnnncnnnnncnnnnnncncnncaaccnncncncnnccnnnncnnnnnncnacnncannnnnnaccncannnaccccancncnnncnncnnccnccnccccnaccnncnnncncncnnccnnnnnnnncnnnnnannancancccnncccaannncnnccnncnnncncccnncncnnccccnnnnncnccccnncncnnnnccncncncncnncncacnnccnncacccaanccncnnncnacannancccnnccccncanccnnccnncnnancccaccnccnntcnnccncncanannaacccnnannnnnncnnacnannnnnnnnccncnnncannnanccnncncncncnacnanncnccnnnncncnnnnannncaancnnnncnatnnncnncnanannncnnnccnnccnacncnncnnnnnccnncnncncannannnnannannncnccncnanannnnnnanncnnnnnancnnncancnnnncnncnnnnnnccncnnnccncancnnnacncncccnnnccnnnnnnncannncnnncnnnnnnncnnnncacnncncncnccnnncanccnccnccncncnnncnnnnnncacnnnnccnnnnancnncncct

SEQ ID NO: 5902 - DNA, 761 bp, Homo sapiens
  misc_feature 5, 6, 7, 8, 9, 10, 11, 12, 15, 17, 18, 47, 82, 89, 94, 95,96, 97, 98, 106, 113, 114, 116, 120, 126, 127, 133, 136,138, 159, 174, 176, 177, 199, 210, 213, 217, 223, 228, 244,246, 302, 310, 315, 317, 323, 334, 336, 354, 371, 391: n = A,T,C or G
  misc_feature 393, 405, 432, 436, 445, 459, 462, 489, 526, 532, 535, 560,565, 567, 571, 579, 594, 619, 625, 626, 629, 630, 633, 639,648, 668, 700, 722, 737, 752, 757: n = A,T,C or G
agagnnnnnnnnttntnnctactaatggcttggctacttgttctttntgcaggacccatcgattcgaattcggcacgagggnaaattgngcatnnnnntgtttgcngatggcnncnttanctattnnattaangcncnttatactctgctgcttaactngcttgtaattgcacntnngttacctgcacattttcatatngaatattgtgntancatngcttantgtgngtctggatggaagatncntgggcctacaggatcattaatgacatattgtttatattacagtattatatctgtgncatcagcngtaantncatttntttacaaatanangcctgttccatttgaaanatatacaagtgtgtggncaaaaggaagtatacccagnancaagcccatgangagtttcagcaagtgttcattcctgantgcnatgactacngcgcctacagtcangtncagtgtcacagctacacgggatactgntggtgcgtcacgcccaacgggaggcccatcagcggcnctgccntgncccacaagacgccccggtgcccggnttccntnaatnaaaagttnccccaacgcgaaggnacatgaaaaacagatgatgccgtancttcanngtnnganactcanccttaaggngattaagaaaattttgcatnaagtttacccttacccttttggaattgaacanggttaaaaagttcccaataacnaaaacccaataaganttcaatggcctcctntgganccaa

SEQ ID NO: 5903 - DNA, 746 bp, Homo sapiens
  misc_feature 2, 4, 5, 7, 8, 9, 10, 11, 12, 13, 14, 15, 17, 18, 19, 20,21, 22, 23, 24, 25, 26, 27, 28, 30, 31, 34, 35, 36, 37,38, 39, 40, 45, 46, 50, 51, 95, 110, 116, 122, 123, 136,167, 173, 211, 216, 253, 262, 287, 290, 310, 313, 356, 368: n = A,T,C or G
  misc_feature 371, 430, 440, 457, 461, 463, 482, 500, 520, 532, 555, 585,642, 647, 660, 663, 675, 678, 711, 722, 739: n = A,T,C or G
gngnngnnnnnnnnngnnnnnnnnnnnngnnagnnnnnnngaggnntttnngatacagctcttgttctttttgcaggacccatcgattcgatcantgtgaactcttaaancatgcngaagcnnctctaggaagtgngaatctgatacaagctgtgatgttgcctganggagangatctcaatgaatggattgctgtgaacactgtgggatntcttnaccagatcaacatgttatatggaactattcagaattntgcctgaancaagcttgtacagtcatgtctgcanggnccagatatgaatatcactgncanatggtactaatattaaaaagccaatcaaatgttctgcaccaanatacattgactnttnatgacttgggttcaagatcagcttgatgatgaaactctttttccttctaagattggtgnccatttgccnaaactttatgtctgtgngcananactattctaaagcgtctgntcagggttgatgcccatntttatcaccagcactttgantctgtgatgcanctgcaataggaggcccacctcancacctgctttaagcactttattgtctttgntcaggagtttaatctgggtgataggcgtgaactggcaccttgttcaagaattaatanagaancttggatcacaanacngattaatgtttnttntagaacacagttccccattgcttaatctattgntagactatctnattgctatctggtattngactacg

SEQ ID NO: 5904 - DNA, 808 bp, Homo sapiens
  misc_feature 5, 6, 9, 10, 11, 13, 14, 25, 30, 31, 47, 50, 57, 65, 66,67, 71, 72, 98, 102, 103, 108, 119, 131, 143, 149, 153,156, 158, 161, 169, 172, 174, 176, 183, 191, 193, 202, 214,223, 224, 234, 239, 241, 252, 254, 263, 272, 278, 282, 287: n = A,T,C or G
  misc_feature 288, 322, 327, 330, 333, 340, 354, 357, 359, 362, 366, 369,375, 377, 378, 389, 391, 392, 396, 401, 407, 408, 413, 417,425, 426, 430, 437, 438, 441, 459, 462, 466, 479, 488, 494,495, 497, 502, 510, 514, 516, 522, 526, 535, 536, 539: n = A,T,C or G
  misc_feature 545, 547, 556, 561, 563, 567, 571, 574, 589, 597, 603, 607,610, 618, 622, 627, 628, 632, 637, 639, 647, 657, 674, 686,701, 702, 719, 721, 729, 737, 760, 762, 764, 772: n = A,T,C or G
agagnnttnnncnnctgaagccctntaaannggctgggtaggtcgtnctntctccangcagccannngcgnntcgaattcggcacgcaggtagcgacntttnnagtangtggtgggcanctcaccgtgggnacagttagcctntctatncctngcntnctncaactccncgnantngctaaanggctggcnanaaagcatgnaaaggactccgnaaaggccannacataacgcngtatncnccgattcgcanancagctcggntggcagtgnccactnggantcgtnntatgatcgacacctagagatgatactggcgcacncagcnttngtncaacgcnggctcaacttggcnacnantgncacnggngcaggngnncctggagtacntnnccgnaagcngtgctnngactnggcntggactgnntcanaagactnntangtaaaccgtatctccacncgnatcntgcaactatgctncccttgganatgagnnancagantgtcatanaaangntacaantgcngatagtggnncantcacananatgcacagngcccntnttgncaanatnggacatcccaggaantgccagangatcanggangcnttgaaatnttangactnntaantgtcncncgcttgtnacagagctgnttgaaaggcagtcggantgcatccctggngaaagcccacaagtnntgacgttttggggattngnatttgaancaaaagcngaagaactttaattaggattctncnanccatcccnaattgctgggaattcgaaatctttaaccacatggcc

SEQ ID NO: 5905 - DNA, 792 bp, Homo sapiens
  misc_feature 4, 5, 20, 35, 36, 37, 94, 104, 106, 112, 113, 118, 129, 136,146, 152, 163, 167, 169, 174, 181, 183, 191, 201, 231, 249,272, 276, 278, 284, 285, 287, 296, 306, 311, 325, 326, 337,340, 343, 344, 347, 351, 356, 363, 391, 398, 415: n = A,T,C or G
  misc_feature 429, 458, 486, 494, 502, 503, 513, 522, 531, 542, 559, 577,580, 582, 594, 624, 641, 656, 662, 669, 685, 690, 693, 694,696, 705, 707, 715, 719, 732, 760, 764, 765, 776, 783, 788,792: n = A,T,C or G
taannatcagctcttgttcnttgaagcctgctatnnncagctacttgttctttttgcaggacccatcgattcgaattcggcacgagtggaaaangttttatttntncactgnngttgncggttaataanatggtgncaaacgtgcnctggtnacacactcgantatntntttangaaatgntnatgtgggnatgattaccnttagatcaatactttaaataattttacccnttttacaagggtaaccangggcatactgaaactttagaacncttncngcaatnncnatgggggangttgggtgangcttnggatccctcttttnngttttgcacgntgnaanngangttnccagntggcatnttgaatatgctgctttccaaaaacccangaagttntaaaattgcttcctggncttagaggactaanaacaagaccctcattcccactttcatttncactctagcaaaaactgggcttgcgtanttctccanctactcgnntatatcctcnttccatgtncaaaccttncattcctaagngggattggcttactttngcccatccatatggcagnatntntaatagctttgnaccggtattagatcttggccttaggcccangttcaaaacaagtgccnatctatgaccagggnccaaanaaaaaanatccaggatttcgaangaganacnntncattgggantnaagactcntacnaagtccttagccnttttcataaaagcctgggcctctaatgnctgnnaccattttaangggacanttatnaaan

SEQ ID NO: 5906 - DNA, 780 bp, Homo sapiens
  misc_feature 4, 8, 11, 17, 21, 25, 26, 32, 74, 75, 76, 77, 120, 125, 160,181, 184, 190, 217, 218, 243, 261, 278, 281, 311, 313, 320,331, 332, 336, 338, 344, 346, 372, 387, 401, 451, 485, 489,490, 497, 501, 516, 517, 519, 529, 537, 542, 567: n = A,T,C or G
  misc_feature 605, 608, 625, 630, 631, 633, 634, 639, 644, 647, 649, 658,665, 666, 670, 678, 679, 682, 683, 688, 690, 696, 699, 701,709, 713, 719, 722, 726, 729, 733, 736, 737, 739, 740, 741,744, 745, 750, 754, 757, 766, 778, 780: n = A,T,C or G
tttnaaanccntggttnaatncctnnttgaancctttttatgatacagctcttgttctttttgcaggatcccannnncaggcttgacccaccgcgcccagcctgtaatttcttatacttngtatnttgtacttgtattatgcttctgatacgctataatnatttatgtacatgtttttttnctncaatanactgggaactcttcgaatgtaggactnntaatgctagatactcaattattttntattaaattgaatgactngaaactacagatccttnatntaaacttcccaaatttatgctgtatttaancngctcttnaaatctggtcnntaangngaattntnaaggcttgggacatgcacatgatggntgtattgccaactgngaaaaggtgatggnttactggagcaggggcaaggacacctggccccgcccggagcaaaaactgntcaaccacaaacgatagcaggaaaaggcctgtgncttnngcaacantgtnttgctgcagataatnncncagagcctgnttctctgntcttnctgagattgctttggttccataaangattgttttagctaatctacaatctatagaagcaatgntanaacttggttttttggantaaanngnnggggnaaagnttngnaatgtgggntgtcaanntttngaaaaaannctnnatacnancaaaanttnanccattttnaatntttagnggnggantantttnatnnannnttnntaganactntgntgagtttgnaaaaacccaaantn

SEQ ID NO: 5907 - DNA, 762 bp, Homo sapiens
  misc_feature 3, 4, 5, 38, 39, 43, 85, 109, 143, 165, 166, 173, 177, 216,219, 248, 305, 382, 407, 491, 523, 580, 597, 598, 600, 616,647, 654, 666, 675, 676, 714, 724, 759: n = A,T,C or G
cgnnnctttttgaacccatttctcgttctgcaggatcnnatcnattcgaattcggcacgagggaacttacccatggggactaatntggaaaaggtctgtccatagtggntccctgaagactggaattacttcagcaaaacttncccatgaacagctaatgtgtanngaaagantganctagcaaatgagttttaccggggacaaaaaatcaagcanaanagtgaatgcttagaaccttctcaaagcantcacaagtacagacacttcacttagcctagggggccttccagggttcttgtggctgntgtcagagcaggagctgggggagggaagacttgttctctctttcttgaggggtggcattaggaacttacgaaaccanagacctttccctatgacttggcagnatgtgaatatcctctacacttagttattgataaacttcttaaagagatctgctattttcaggtagtgccataatctgcacttancattggcttgcttcagttgggcctcttcccanccagtatgcccaggtgaactttcgaggttgtcattaagtaagttgtgaaatttctgnaataacaaaggcagtcnngnattctttccttttccnccaaattcctaaggcaaaacttttttatggngctggtnacatggggagtnacacaaccnnctgactttttctcattgccattgtaatgactgatgganaaccccaccncctgggatccaaatgacaattgtgctgaaaaaccnatc

SEQ ID NO: 5908 - DNA, 763 bp, Homo sapiens
  misc_feature 2, 3, 4, 8, 9, 10, 62, 109, 125, 129, 136, 156, 166, 167,174, 182, 186, 214, 219, 235, 244, 249, 255, 258, 259, 292,295, 307, 331, 335, 337, 341, 346, 350, 371, 373, 375, 389,394, 407, 415, 424, 433, 443, 451, 458, 492, 499, 505: n = A,T,C or G
  misc_feature 507, 521, 526, 530, 550, 557, 585, 596, 601, 614, 625, 635,658, 666, 672, 678, 685, 723, 726, 738, 745, 749, 762, 763: n = A,T,C or G
gnnntttnnnatctgctacttgttctttttgcaggatcccatcgattcgaattcggcacganggtgactgcagttgacgaaagcatgccatggggtatggggacattgntgggccacattttggngacngaccccngctgttgactttgggacccnatcctttganntttggcntgccctcntagngcttggaattccctgttttccagcccanccccnatggtatgtatattcnttacaagtnctccnaaagancanntgtctaggatgcggggaggggaggttccttccntangggagcgtgganagaagggagcagccttggggttgnattntnggtnatgcntcanattgggcatgcatgggatggnanangggctcagccactntcctncagaatcttcctnagaccctncaactgcantatgtaatnctactctgtncttcatanaaggganggagccacatatgacattccagttctaagcccancatggangaacangnctatgtccccatangtgangtanaagtagagggcttcacctgncagtatncctgccgctacttcctcacataaggaangacgaagaagnaaccnggacctcgctttnccatggtgcantcaggaacanggttttacgcagctggccaactntgaggctntgctgncttttnctgtggncagtccaggaaatgcttacaccaccttttttcccactnttncctcttggattntgggggncccncaaaccggaattnn

SEQ ID NO: 5909 - DNA, 762 bp, Homo sapiens; identical to SEQ ID NO: 5907
  misc_feature 3, 4, 5, 38, 39, 43, 85, 109, 143, 165, 166, 173, 177, 216,219, 248, 305, 382, 407, 491, 523, 580, 597, 598, 600, 616,647, 654, 666, 675, 676, 714, 724, 759: n = A,T,C or G

SEQ ID NO: 5910 - DNA, 746 bp, Homo sapiens
  misc_feature 5, 6, 7, 8, 9, 10, 12, 27, 36, 38, 39, 42, 47, 54, 55, 62,63, 309, 412, 531, 632, 657, 661, 663, 680, 689, 721, 737,739, 745: n = A,T,C or G
agagnnnnnntnttgtctactaatagntgggttggntnnttnttctncacgcannccagcgnntcgaattcggcacgaggtccatctttgtagctgacatgacacattttaaaaatttcacattaaaatgaaggcatctaatggctccattatgtcttttagagtggtctggcccagctaattgcatattgaaatacattagatttgtcataaattactttcctttattgtcttttctgtcaatcttaggacattaaatgtatatgtttgaaattgtgtttaggtaggttatctgagcatttggttcanatagtaaagagagtgttataagttcactgtaagccccaggggctttgggactgatagggtttagaacattgcactaggggaaatgaattgtaaagtaatgttntttctctagactaatgattcagctgaattaatacttttaatgtgaagcatttttaaagaaagcaaaccagcctggtgcggtggctcacacctgtaatcccagcactttgggaggcagangcgggccggatcacgaggtcaagagattgagaccatcctggccaacatggtgaaaccctgtctctactaaaaatacaaaaattagctgggcataatggtcntgcctgtagtcccactacttgggangcanangcaggagaattgcttgnacccggganatggaagttgcatgacccaaatcgggccctgnacttttacctgcacanantgagant

SEQ ID NO: 5911 - DNA, 732 bp, Homo sapiens
  misc_feature 2, 3, 6, 7, 8, 9, 10, 11, 12, 14, 16, 17, 18, 22, 591, 594,669, 700, 708: n = A,T,C or G
gnnagnnnnnnngngnnntttnagatacaggctacttgttctttttgcaggatcccatcgattcgcaagcattcaagaaataatggtgagaatagcctgctaatagcattattccatatgcaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaagtttctccatttcttcttgcattatctggtaatagtagggaactagtattggattgaatgaataagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacaagtctgtctgaacctgccagtgctgaccctgcagcactttcagcatatgcacatcaaaagttggagaccgcgcctgaacttanganggccttcacacagactgatgtggctacccttctcagaattaacaggggatgtcaatcctttgcatttgaatgaanactttgcaaaacacaccaagtttgggaaatncaattggncatgggaagttttgacaacggact

SEQ ID NO: 5912 - DNA, 820 bp, Homo sapiens
  misc_feature 4, 42, 50, 51, 53, 55, 56, 60, 65, 73, 74, 77, 84, 85, 96,103, 104, 105, 111, 116, 124, 132, 137, 142, 146, 149, 162,163, 168, 169, 199, 203, 206, 210, 216, 217, 219, 222, 223,227, 236, 240, 253, 263, 266, 276, 280, 299, 303, 307: n = A,T,C or G
  misc_feature 314, 315, 320, 333, 341, 358, 365, 367, 376, 384, 401, 406,416, 419, 423, 429, 433, 453, 457, 461, 464, 466, 474, 477,488, 498, 512, 518, 522, 525, 539, 541, 550, 551, 554, 560,563, 567, 580, 585, 587, 598, 603, 604, 606, 628, 630: n = A,T,C or G
  misc_feature 635, 639, 643, 645, 656, 658, 668, 670, 673, 675, 677, 680,681, 687, 689, 690, 701, 702, 707, 716, 721, 726, 730, 740,742, 746, 752, 756, 757, 760, 762, 768, 770, 778, 780, 788,791, 792, 796, 800, 804, 809, 815, 819: n = A,T,C or G
gggntttatatatcagctcttgttcttttgcaggatccttcnatcggtanncngnncganctganttcgtacnnagngctgctnntacctgggctnactggannnctccanctacncaggcagnaggatggnagctnaactnccangangagcttgcagagnncctgnnatccgtgccactgcactccagcctggcctnacancanccgngactcnngnctnntaancctaaaagnctcnttatcagcatgcntcccattganagngtcctacatnctgngacattcacctatattccngggncctnttaattnncaacnactgctcttagangtcttagncttttatgttaattctnataaatncnattgaatanatattatncccaaatcttagtgttngcatnttagctattnaancctntccaangtangttaaaggccaccgttttcngatnaatnctncnttttatantcnatctggaatancgcatttctntgagaataaaaganagtttntttnaanaataggatcttttngncccttcggnncgncctttntgncccntagctgctttggngcaantntgaagttgagngatcnncnttgtagccctaggaatttccananttgcnctgntgtnantggaacttctnanccttgtgccnanagnantnatnncccctntnntttttaaaaannaattngtttcaaanttcgnccttntttnaataggcttnanatgnttatanaccnnggncnaagttntncaatcttnantccctttnagnntccnaatnaatntaaantccttnaatng

SEQ ID NO: 5913 - DNA, 833 bp, Homo sapiens
  misc_feature 1, 2, 3, 4, 5, 6, 7, 10, 13, 14, 15, 16, 17, 19, 21, 22,23, 24, 26, 28, 30, 31, 32, 34, 35, 36, 37, 39, 43, 44,45, 46, 48, 61, 70, 74, 81, 82, 84, 88, 92, 93, 99, 101,104, 113, 178, 179, 183, 201, 212, 218, 228, 237, 248, 251,253: n = A,T,C or G
  misc_feature 255, 260, 272, 273, 281, 287, 292, 298, 305, 307, 309, 348,369, 373, 375, 381, 397, 418, 426, 428, 433, 444, 447, 448,458, 460, 463, 474, 489, 501, 503, 506, 517, 532, 544, 547,573, 576, 591, 614, 615, 616, 636, 643, 662, 684, 698: n = A,T,C or G
  misc_feature 703, 732, 747, 757, 796, 801, 816, 832: n = A,T,C or G
nnnnnnnatnatnnnnntntnnnntntntnnnannnntntttnnnntnttttggtgaggtnaatcttctnttancctccanntntcgntctnnttgcantnccngtcgattcngataactagtcaataaggaacaggatcaacggccactccacccatggcaaatccacatgcagggnntctncaccaaggttccagcctncaaagtgaaanacgccntggaacagcnagggaggtnaacaataattnaanananagaanggaataacggcnnaagaaaangaaaanagaancgaaanaactaangntngaaaaccacccggaaaactcaaggaatcacaatcctaanaagcccaaaaagggacaggangctnancttgangctggtggggaggaantccctgaggccaatggctctncatggaanangagcnagaataagaancanngcaaggacancnccncttaggaatangcacgcgttggcgcngggaaaacgaancngangcactctgaantttaaacatattctnagaaacaacaanatnaagcttccagaacattctgaagggcnganaaccagaataccatnaagctcctgcaaaaagttaattnnnctggaagggaactattaaancattctnaaacaagccccaaacaatnaaataaccctcaaaaagctaangaaaaaagtttttncttantactacacaggtgaccagatttagccttnaccagatttccaaanaaggaaactnccttgggtcattcttttaacaatgaaaaatttatctacntaaancctttcctttttaantttttttaaaaagggng

SEQ ID NO: 5914 - DNA, 741 bp, Homo sapiens
  misc_feature 5, 6, 7, 8, 9, 10, 11, 12, 13, 22, 33, 686, 731: n = A,T,C or G
agagnnnnnnnnntttgtcttntggctcttaanaggcttggctacttgttctttttgcaggatcccatcgcttcgaattcggcacgaggagccctcttattgtatatactgaacgcatttttaaattgaagagatactattctgtgtatctttgcaggcgaatgagtcctaggttggccagtgtctcactagttgagattaaatttttgcttatacttgttgatttgactgccttctgaatagtattaggaacacattgtaaatttgttgttgatggctggctgaagttttccagcacatttcttgaggttgccaagttcttctacaatgactgaatctactcttcattcattctagtcagcagtctcacacttaattccaaggtttacttaagatttttttctgaaaaagcaatgcttgctttccatatttgcatattttttctctgccttaatagcagaaacaatggcttcatcttgcatttgtatcagattctttccattgatatatcttgtccttattagctagttgtttcccactgggtgcagtggcttatgcctgtaatcccagcactttgggaggtcaaagcgggaggattgcttgagcctaggaattcaagaccagtctgggcaaaatagtgagaccccatctgtcaaaatgaaaaaaaaaaaaaaaaactcgacctntaaactatagtgagtcgattacgtagatccagacatgataagatncatggtgagt

SEQ ID NO: 5915 - DNA, 760 bp, Homo sapiens
  misc_feature 1, 7, 13, 17, 21, 30, 69, 74, 79, 130, 145, 170, 177, 193,194, 201, 205, 247, 265, 267, 276, 289, 292, 297, 317, 318,323, 328, 332, 333, 344, 353, 355, 359, 361, 362, 376, 382,384, 390, 391, 405, 425, 430, 495, 496, 500, 506, 542: n = A,T,C or G
  misc_feature 559, 583, 596, 598, 613, 638, 641, 647, 651, 657, 658, 675,678, 680, 681, 694, 695, 702, 714, 721, 728, 734, 748, 758,759: n = A,T,C or G
ntttttnaaaacnacangctncttgtgcangatcccatcgattcgaattcggcacgagggtggctcggnctgtngctgnggtttcctgagttgctgctgctgcggcggcggcagcggcgtctgtgcttgnggaggtgtcggcctntgggcggatgttgacattgtgttgntgttatngctgatggtaatggcnncggcggnggcngctgacggtccagaccccatccactctgtagccggagccganacagccgacagcgaactncncggcctcgnatccggcagcagnggngactnccctcagcctgcgccgcctnncccgncggtncccnngagccaacccngggagtcangncctntnngcatgggagctcgnaagctnangatggnngatttacacaaaanctatgatgaataggaggacnaggancggccctggaggagcagctgctcaattactcaacggacccggtggtcgtcctcggatccggtcanntcancgtatnaggactgagcaacaaatttgaatctgaattgcctanttcattaactggaaaantcactcctgaagaatttaaagccngcattaacattantnacaagttggattaanaaaaaccttctgtaaatgtccgttnctncttagnggangccttnnattgctgctgccattangtncnntttgtggccagtnnttggctnaattaaagaacnctaaaangttgagnatttantagaatgggaaaanccatccgttnnt

SEQ ID NO: 5916 - DNA, 742 bp, Homo sapiens
  misc_feature 2, 9, 177, 391, 420, 437, 444, 480, 489, 611, 623, 633, 668,669, 682, 690, 700, 703, 715, 718, 723, 730: n = A,T,C or G
gntttactnatatcagctcttgttctttttgcaggatcccatcgattcgaattcggcacgaggaccgccaattctaagattgtagtggtaactgcaggagtccgtcagcaagaaggggagagtcggctcaatctggtgcagagaaatgttaatgtcttcaaattcattattcctcanatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcnactcaagtgtggctgtgtggagtggtgtnaatgtggcaggtgtttntctccangaattgaatccagaaatgggaactgacaatgatagngaaaattgnaaggaagtgcataagatggtggttgaaagtgcctatgaagtcatcaagctaaaaggatataccaactgggctattggattaagtgtggctgatcttattgaatccatgttgaaaaatctatncaaggattcatncctgtcaacnatggtaaaaggggatgtctggcattgacaatgaanntttctgagccttncatgtatnctcatgcccnggnattaacctcgtnttnacccnaacctanggatgataggtt

SEQ ID NO: 5917 - DNA, 732 bp, Homo sapiens
  misc_feature 2, 3, 4, 6, 7, 8, 9, 10, 11, 12, 13, 15, 18, 19, 588, 689: n = A,T,C or G
gnnngnnnnnnnngnggnnttttatatctactggctacttgttctttttgcaggatcccatcgattcgaattcggcacgaggcccgagagggaacctcctccgctgggggacgggaagcccaccgactttgaggatctggaggacggagaggacctgttcaccagcactgtctccaccctagagtcaagtccatcatctccagaaccagctagtcttcctgcagaagatattagtgcaaactccaatggcccaaaacccacagaagttgtattagatgatgacagagaagatctttttgcagaagccacagaagaagtttctttggacagccctgaaagggaacctatcctatcctcggaaccttctcctgcagtcacacctgtcactcctactacactcattgctcctagaattgaatcaaagagtatgtctgctcccgtgatctttgatagatccagggaagagattgaagaagaagcaaatggagacatttttgacatagaaattggtgtatcagatccagaaaaagttggtgatggcatgaatgcctatatggcatatagagtaacaacaaagacatctctttncatgttcagtaagagtgaattttcagtgaaaagaagattcacgactttcttggtttgccagcaaaattagcagccaatatttacatgttggttatattggngccaccacttccagaaaagagtttagtagggatgacccagggc

SEQ ID NO: 5918 - DNA, 772 bp, Homo sapiens; identical to SEQ ID NO: 5813
  misc_feature 2, 3, 11, 14, 15, 19, 28, 34, 35, 37, 45, 46, 53, 58, 62,64, 65, 67, 75, 78, 79, 80, 91, 97, 105, 106, 108, 110,121, 125, 128, 129, 134, 135, 150, 160, 165, 168, 171, 174,179, 180, 182, 187, 188, 191, 192, 197, 206, 209, 214, 215: n = A,T,C or G
  misc_feature 219, 222, 224, 227, 232, 240, 251, 260, 278, 284, 285, 297,299, 302, 306, 308, 310, 311, 314, 318, 329, 331, 334, 343,350, 351, 364, 439, 440, 475, 488, 586, 629, 649, 659, 673,712, 733, 736, 769: n = A,T,C or G

SEQ ID NO: 5919 - DNA, 750 bp, Homo sapiens
  misc_feature 5, 6, 7, 8, 9, 10, 12, 13, 14, 730, 749: n = A,T,C or G
agagnnnnnntnnntcttatcgcctaatgcttggctacttgttctttttgcaggatcccatcgattcgctgtgaagacctggaaacagacaaaaaagagcttgccaagctccagactgtccagctggatgaagatatgcaagacttatgaactttatttcctcctcacctctttttggcatcagcggcaaatcttttcatgaagccccaaggacacaaaacattttcccatttaaaggaaaacactctagttttgcaagtatatgcatacaagagactttagattgatctgcatgaagatcacagttaagtatacaggagtagaactgcattattgcagcctttttgttcacttataaatttctcttttaaatagatggagacaaaggacaaggtgaaatgtatcaagtcaaagtgaatcatttagttgactctataattctaaggtcaaaatggaacttgatagttttttaaattaaaaaatgtatacacctaacatagaaaattaaagatagctgcagaccattagaaataatacaattgtttttgtttacttttactccatgggcattgaaaaggttaagaaacataaatggtccatatttttaaagttaagtagcatgcatatatatatgcacacacacctctttttcagcattttttgagaaagtcttggggtctcaaacacatttgtctcaacacatttccaaatgtggattctaatagctcantgtggctgaaaaagtgccna

SEQ ID NO: 5920 - DNA, 761 bp, Homo sapiens
  misc_feature 3, 5, 6, 7, 8, 9, 10, 11, 14, 18, 19, 20, 27, 31, 36, 50,57, 58, 77, 80, 83, 101, 119, 137, 196, 320, 523, 532, 621,670, 676, 686, 693, 723, 730, 735, 745, 750, 753: n = A,T,C or G
agngnnnnnnnttntctnnnctactanctgnttggntgttgtttctgcangcaggcnntcgattctaattctgccgnacncgngagtaaagctggaaaatnacctataaataatggcanaaaaaaagctaacaatanggaagaggaactatataaaaggaacatttggagcatagaagagagttcatggaaatgtnaaaaatgatggtaccctgggtttgatatagtaagtaaaaaactaagggtaagagggtcatgaaagcatctagaagtaggagggaaagccagtcaaattcacaggatgaagtcaggaagataatngagcagtgcccgcaagatcctgagggaaagcaagttccaatctataagtctgtaaccctcacacctgatggccccttgaacatattcagggcttcaaaagattgatctgtcatgcaccgtctgccatgatactgtgtgaggatgtgttcttcttcttaaacattaaatcaagaaagaatcaacagtggacccagttaatagcngatcagccnaggataagatgccctagaagatggtgaagggaaagtctcagaactactggtcttcagcaggcagcgaagacacctgatccatattggantggtggggatgcgaacttcaggaagggatgcccccaaggaaaaattggnaagggntgatgactgncttcaanaggttccaggtcttttaaaaattttccctnccaaccntcacntttggctttngaaanccncgcctgat

SEQ ID NO: 5921 - DNA, 765 bp, Homo sapiens
  misc_feature 3, 5, 6, 7, 8, 9, 14, 84, 86, 91, 102, 107, 118, 177, 178,200, 217, 231, 268, 279, 282, 299, 303, 304, 307, 317, 350,364, 384, 393, 403, 417, 419, 423, 425, 428, 429, 436, 451,459, 474, 478, 482, 497, 498, 500, 501, 506, 507, 510: n = A,T,C or G
  misc_feature 514, 520, 530, 547, 554, 558, 575, 595, 609, 612, 623, 626,649, 667, 672, 689, 717, 723, 730, 731, 750, 751, 756, 757,760, 765: n = A,T,C or G
agngnnnnnttttntctctcgcctaatgcttggctacttgttctttttgcaggatcccatcgattcgaattcggcacgaggacnanccctngcgcctgcctntccangatgtctacanaattggtggtattggtactgttcctgttggccgagtggagactggtgttctcaaacccnntatggtggtacctttgctccantcaacgtttcaacggangtaaaatctgtacnaaatgcaccatgaactttgagtgaagctcttcctggngactatgtggnctncaatgtcaagaatgtgnctgnnaangatgtcccgnccaaggcaacgttgctggtgaccgcataaatgncccaccaatggaancatctggcttcactgttcangagattatnctgaaccatncatgccaaataagntnccgntnatnnccctgtnttggattgccacacngtttacantgcatgcaagtttgntganctgnaggaaatgattgacnncnntctgnntanaagntagccnatggccctanattcttggactctggtnatgctgncatngctgatatggttcctgncaagcccatgactgtcgaanagcttctcaagacnatncaacctttggntcnctttcgtgctacgaggatattgngcaccggacagttgccgnaggcnttttgatcaagggcccntggacaaaaaagctggtcgaacctggcnaaggtnaaccaanncttccccctaaaacttcannaaggnnaantgcan

SEQ ID NO: 5922 - DNA, 969 bp, Homo sapiens
  misc_feature 2, 3, 4, 5, 6, 7, 8, 9, 10, 11, 12, 13, 14, 16, 18, 19, 21,22, 23, 25, 26, 27, 28, 29, 31, 32, 33, 34, 35, 36, 37,38, 39, 41, 42, 44, 45, 46, 48, 49, 50, 51, 54, 55, 57,58, 59, 60, 62, 64, 65, 67, 69, 70, 75, 76, 77, 78, 82,84: n = A,T,C or G
  misc_feature 94, 99, 100, 105, 115, 119, 121, 122, 124, 131, 133, 139,149, 153, 165, 173, 178, 181, 189, 198, 205, 210, 212, 220,225, 226, 232, 236, 245, 248, 252, 272, 277, 279, 286, 291,293, 302, 309, 314, 317, 319, 334, 343, 365, 366, 369: n = A,T,C or G
  misc_feature 371, 386, 397, 403, 405, 408, 412, 415, 418, 419, 424, 435,438, 464, 467, 468, 469, 472, 475, 484, 503, 507, 545, 554,556, 558, 566, 568, 569, 583, 589, 596, 603, 608, 609, 611,614, 617, 623, 627, 632, 635, 636, 638, 640, 643, 644: n = A,T,C or G
  misc_feature 654, 662, 666, 667, 683, 684, 693, 695, 698, 702, 705, 712,714, 718, 724, 726, 734, 740, 741, 742, 744, 747, 748, 756,758, 767, 768, 774, 778, 779, 788, 790, 797, 802, 805, 809,815, 821, 823, 826, 829, 835, 836, 838, 839, 844, 846: n = A,T,C or G
  misc_feature 854, 860, 863, 873, 877, 887, 888, 892, 894, 895, 896, 908,917, 926, 928, 929, 932, 933, 939, 940, 942, 944, 966, 967: n = A,T,C or G
annnnnnnnnnnnngncnncnnncnnnnncnnnnnnnnncnncnnncnnnnccnngnnnncnanncnannggggnnnnccgntnaaaaccggtngcccnngcgcncgggcggggnggcncnnanccgaatncngcacgnacggggccgncggngggaccctgggntgggggcnagaancanccgacgcnggccagaanagggggnctggngncccaaganagaanncatgantagnacactgganacnaaanccgtgtggggacacatgaanccccnancccatgngtcgnancctgcccanaagtgantgtgnagntnactggaagttggggntccaaccgncaaaccgtgggatcccaaaacnncangncaagccaggaccttngcacagcccgnaaaggnanatncccnctnaanngtctngagacccgggntgnctgggggaaacagcaggcccgcacantgnnnggngtngggacttancggaaacatgggtaacgtngcancagcgccacgggagtccaacccctgaaaatacccaganctcgcgtgnananccaaccgngnncccaaaacaaagcnaggggntatgggnttaaaanccccnnanttnaanagcccnccgnggggnaannangnagnntttttgggancccaaaancccnnggagggggcccagganncgaaaaaangnatncccnttnaaaaggncnccangaactnanaaaggganaaccannntncgnngcccaatntnacccccaanncaaatncccnnttccgtgcngncccaatnatccnccnagtnccattntggccncnagnggngggggnncnncaaangncttcttgnaaacanatnggggaaaccntttnaccaaaaaanngcgnannnggggcccaatanccaccgggncccccccananncannggccannancntgggcctccaaaaaaaagaaanngg

SEQ ID NO: 5923 - DNA, 748 bp, Homo sapiens
  misc_feature 5, 6, 7, 8, 9, 10, 44, 71, 74, 81, 91, 92, 111, 117, 118,128, 136, 141, 145, 166, 175, 187, 192, 194, 196, 201, 205,207, 210, 212, 224, 241, 278, 300, 324, 352, 359, 370, 383,388, 391, 392, 397, 410, 411, 445, 458, 459, 464, 465: n = A,T,C or G
  misc_feature 475, 476, 478, 501, 503, 513, 518, 531, 541, 568, 580, 583,606, 613, 620, 632, 651, 666, 702, 704, 705, 706, 739, 747,748: n = A,T,C or G
agagnnnnnntttttgtctctaatggctggctacttgttctttntgcaggatcccatgcgattcgaatgcngcncgaggcnttagttgctnnttgaaaagggaactgcacntgatcnnatcatggaangatagctncactncttnccgaccttggtcacaggccgncatgagganggactgttccantgctncngnggccnctgncntgntnctcatcactggncttagctttggagtacncaactccaagtggcccgagtctagactctatcaaatnccacactgatagcaacaatgantgcatctgatgtgtgctgctggcnatcttaagcccaaaatgcttcaaagatnaaacagncatatacattnaagatacatatanaaatngtnnaattngaatgtatacaanntagattaccctaacgaacttcactacaagaaatncatcttatatccnngcacnnaaatgtgganntntacatgaaaggatataccgtttnanaaaccacatnccatntctaaatgctgantgagaaggcntggactactaaacctggattactgatnaaatttcaaaangancttgattttgctagcagaaatcnttacccngttctcnagcttctataancagttcttgaagggattanacagctggtcctctntccaaattctggattaatttcagctgtgtatttccnannnaatctttcagcctctagaactatatgagtcggnttacgtann

SEQ ID NO: 5924 - DNA, 949 bp, Homo sapiens
  misc_feature 2, 4, 11, 17, 20, 32, 45, 52, 62, 67, 75, 76, 80, 85, 90,92, 103, 104, 107, 120, 129, 141, 144, 146, 151, 162, 179,183, 189, 191, 194, 202, 210, 217, 225, 232, 233, 236, 237,239, 241, 243, 253, 255, 270, 275, 277, 288, 293, 310: n = A,T,C or G
  misc_feature 314, 319, 320, 325, 326, 333, 334, 349, 370, 378, 379, 400,416, 430, 432, 438, 439, 444, 457, 463, 471, 479, 484, 490,510, 522, 539, 550, 575, 587, 592, 595, 596, 605, 609, 612,614, 620, 636, 644, 687, 703, 719, 737, 741, 748, 750: n = A,T,C or G
  misc_feature 757, 764, 775, 780, 789, 793, 804, 811, 814, 815, 821, 822,826, 827, 828, 829, 831, 836, 848, 852, 856, 858, 862, 867,879, 885, 890, 895, 900, 903, 905, 909, 913, 915, 928, 933,938, 948, 949: n = A,T,C or G
gncntactttnttatcntancactctgctttncgtcatcatcgantcctatnatgtgggttnacctnatgcgggnntaanccagnaacancntggcccatgtnnccntgaactcacattntgttcatgnattccagaattnttnantgganagattaatagncagaaaccccactaggnacanatcacnanacngacgcttntagcttgnagacctnttaggcanaaagtannaannanantnggatcttgcngnccttaatctcttccnggaanangggcctatagntggcnacttggaaaacacggcnctgntccanngtttnntgccccnnacccgagacaccacnagtgtcacctccaaggggggncttcaaannttggggtgcgcccggtacctnttgaaaatgaaggtcncccccaaatggggngngagttnnccatncctcgccccttgngggttnatttgggngaacctcnttggncccctntttttacttttagggggcancccccattttcncctttgggacccccttnggattttgtcnccttgggaaaacaatttttcggggnccaaaactttanaattnaannttggtttanagcnaanantgtggncccaaaatgggtacangggggttnccccaacaaaagccggctctttttgatattgcatacctcaatncccacttgtcaatccntttttaattactttancctctaacataatgaatnttancgccctnanaattccntcctganatacatgtgangcctnttgcctganaaantgacacgaatnatttttnaanngatctnntgannnncnctcancatacgatattntacntctngncttnagaanactcttttattncctggnagatnaaaanggtancantntaangctntnttgtcatcctcanagganttaangctataaaann

SEQ ID NO: 5925 - DNA, 779 bp, Homo sapiens
  misc_feature 1, 3, 6, 15, 33, 35, 38, 40, 43, 45, 52, 54, 57, 59, 61,71, 75, 78, 79, 80, 81, 92, 96, 101, 117, 122, 128, 145,148, 149, 155, 156, 161, 163, 173, 178, 179, 183, 190, 201,209, 220, 222, 255, 258, 286, 302, 307, 317, 324, 332, 342: n = A,T,C or G
  misc_feature 343, 370, 388, 394, 417, 433, 459, 487, 549, 557, 584, 602,694, 721, 722, 729, 732, 747, 760, 764, 771, 779: n = A,T,C or G
ngnttnaacacctgntgtcgttctgcaggatgnangancnctngnttcgaangngcnangngtgcatgatnctgnccnnnnattgctagcgntaanacccncgagggagtatggatncctgnaaagcnctctggtccttgggaanccnntccttnngtgcntnttattactgnaattnntcanaagattntgagatgctcncagtgtcncattgctactntnattgtaatcattatgggattgatacgctgtcanaantactgccagcggcagctggagttgcttngcatttcacagtacanacagnagactatgtnaataatnggcagaanaattctactnngctgtggaattcccaaactaatatggnccagaaactagctaatcnaatcanttatgtccaacaaactgtaatgnggctaggagattgagncgttagtctagaatatagaatgcagntacaatgtgattggaatacttctgattnttgcattactcctcatctgtataatgaaagacagcatgagtgggaaagagttaagaaacatntgaaaggncatactggaaatttactttagatattntgcaactgaaggaacaantttttcaatctttctttggcacatctggacacttaatgccaggaactgaagttgcttggaaggcgcttcaaaatgggattaagcaactattnaccccattaaaaatggatcaagaccannaaactanaanaaaaactcgaacctnttaaaaccattantgangtcggantaccttan

SEQ ID NO: 5926 - DNA, 935 bp, Homo sapiens
  misc_feature 6, 11, 12, 13, 14, 15, 16, 17, 18, 19, 20, 21, 22, 23, 24,25, 26, 27, 51, 62, 70, 71, 77, 85, 93, 100, 101, 105, 106,110, 118, 121, 124, 129, 136, 146, 155, 158, 167, 169, 186,192, 194, 195, 201, 202, 206, 207, 217, 224, 225, 237: n = A,T,C or G
  misc_feature 243, 246, 248, 254, 255, 266, 272, 280, 307, 310, 317, 326,351, 352, 356, 358, 381, 385, 393, 396, 421, 426, 438, 440,452, 453, 462, 487, 489, 498, 505, 508, 511, 513, 518, 531,533, 543, 545, 553, 562, 568, 573, 576, 577, 581, 604: n = A,T,C or G
  misc_feature 610, 615, 620, 637, 640, 642, 650, 655, 665, 668, 669, 671,672, 673, 679, 680, 686, 687, 688, 710, 717, 725, 734, 736,739, 754, 757, 772, 779, 782, 789, 805, 809, 815, 817, 819,842, 857, 858, 862, 864, 872, 874, 878, 893, 896, 904: n = A,T,C or G
  misc_feature 912, 918, 920, 924, 935: n = A,T,C or G
atgggnatggnnnnnnnnnnnnnnnnntttttttgtttaaaaacccctttnaaaaattgggnaccctttnnggggtntaaattanaatccctnttgaggnncttnntacnctccctcnaanaanttaanacactantatggccgtntttttcccnccntacctttgntntacacccccattgtgcnaaaagntnncgcaannggtnncgaccaaacnttgacannctctatagtaantttacnacncnacttgnncacttcgccanctcttnaacgccanactagtagcagaagtactccacccttnaanaaaacanacaactaangcccttttactgccctcatcatccnnttangnacctgcttacctatgaatgcctnttanacatacanatntaatacctggaaaatcatccacccngcccncatattcaaacnanacaacacatccnnacactaganactcttgcccccacatcctcaggtncnacaaaacanaaaaggnttnctncncatanttcttactggccntncctgaactangnaccgcatncaaaccacntcatcncttantannttcncttgctccttagccagcttctgncctganaaccnccaanctggaaaaacacatctnccnanatccattncttgngatcacaaanacnntnnnccgcgnnctcaannncctactcaaagatccactgtcncatctgnccccctanacccctttncntangcattcctaactttntanacaaactgctttacncttagtncanggaactnctaccttgcatcatcncccntttttncntnactttcttcctttgatccttacncttcaaagggccttnngaancnttgacccnanaatnaaatttaattccccnttnttggaggngtccttcnaaaccnantttntaaacaccccn

SEQ ID NO: 5927 - DNA, 752 bp, Homo sapiens
  misc_feature 3, 4, 7, 10, 11, 28, 654, 669, 671, 675, 713, 714, 737: n = A,T,C or G
ggnnttnaanntcagctcttgttctttntgcaggatccctcgattcgaattcggcacgaggcaagacagccacatttgctatttccatcctgcaacagttggagattgagttcaaggagacccaagcactagtattggcccccaccagagaactggctcaacagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttctccaaaatggatcaaaatgtttgttttggatgaagcagatgaaatgttgagccgtggttttaaggatcaaatctatgagattttccaaaaactaaacacaagtattcaggttgtgttgctttctgccacaatgccaactgatgtgttggaagtgaccaaaaaattcatgagagatccaattcgaatttcttggtgaaaaaggaagaattgacccttgaaaggaatcaaacagttttatattaatgttgagagagaaggaatggaagttgggatacacttttgtgacttgtacgagacacttgaccattacacaggctggnatttttctcaatacnangccncaagggtggacctggcttgactgagaagatgcacgccnngagactttacaggttcttgcttntggcttcgcgggaat

SEQ ID NO: 5928 - DNA, 728 bp, Homo sapiens
  misc_feature 2, 3, 5, 6, 7, 8, 9, 10, 11, 12, 13, 14, 15, 16, 17, 18,19, 21, 22, 23, 24, 25, 26, 27, 28, 29, 30, 32, 33, 34,45, 84, 89, 94, 96, 98, 103, 107, 109, 111, 116, 117, 118,119, 121, 130, 135, 145, 146, 170, 203, 231, 241, 248, 251: n = A,T,C or G
  misc_feature 252, 258, 281, 283, 294, 300, 327, 329, 335, 340, 361, 392,393, 396, 420, 450, 459, 462, 477, 488, 491, 494, 496, 517,519, 531, 543, 554, 558, 569, 573, 591, 603, 605, 607, 608,611, 613, 621, 633, 640, 643, 657, 659, 684, 698, 701: n = A,T,C or G
  misc_feature 712, 718, 719: n = A,T,C or G
gnngnnnnnnnnnnnnnnngnnnnnnnnnngnnngttttttaganacagctcttgttctttttgcaggatcccatcgattcgcnctacncaagngntnagccnactncncntcaannnnanactgggcanggatnagactcatannaacattgtgctgcattgagcaccncagattcagggagccatcaccactacatggcanattgtgatctataaattgctggggcatnatcacatggntccattntcnnaatggncaaggatgcttgcacctatcgancngggctatgttnagtatncctggtcattggctaaactcatagctnancgtaancggantataaccattgacctatgctngtggacatttgacaccatcagtgtacttatnngantgatcactgatgcctcatgacacngacctttatcaaaggacatgatggccaggncctcttgangcntaccgtgctatcccngaatgttgctnctnctntnggggaattttcaacctgaggntntgaaataatggncaaactcaccancatggcttganggcntacacactggntgtnaaacaactaattgactgngatacagaaggntncnntgncnacttctgnaggatagatctnagaattnttnagctgtaggctacntnagaaatcggtacaccctccatcganaggccatgatgtcnatngtacacaactnaccatnncttcatgta

SEQ ID NO: 5929 - DNA, 870 bp, Homo sapiens
  misc_feature 7, 9, 11, 13, 14, 19, 22, 23, 24, 25, 29, 30, 45, 55, 60,64, 65, 68, 72, 73, 76, 79, 80, 82, 91, 96, 97, 102, 104,108, 111, 115, 125, 134, 135, 138, 142, 144, 146, 164, 166,167, 170, 173, 174, 178, 180, 182, 183, 190, 191, 196: n = A,T,C or G
  misc_feature 197, 216, 219, 227, 228, 238, 247, 251, 256, 258, 260, 261,263, 264, 266, 281, 299, 302, 304, 315, 326, 328, 329, 342,355, 356, 360, 365, 368, 371, 375, 376, 384, 403, 409, 411,412, 414, 433, 440, 449, 453, 454, 460, 463, 464, 466: n = A,T,C or G
  misc_feature 467, 476, 480, 493, 496, 501, 504, 505, 507, 510, 514, 515,522, 527, 528, 531, 536, 537, 540, 549, 551, 554, 555, 557,563, 564, 566, 575, 577, 579, 582, 584, 587, 593, 599, 601,602, 604, 607, 610, 612, 616, 617, 618, 620, 626, 627: n = A,T,C or G
  misc_feature 628, 629, 630, 637, 646, 653, 660, 661, 663, 668, 676, 683,685, 692, 694, 696, 698, 703, 709, 712, 715, 717, 720, 727,728, 729, 732, 737, 739, 745, 747, 749, 751, 753, 754, 763,772, 774, 775, 779, 782, 792, 793, 794, 795, 813, 822: n = A,T,C or G
  misc_feature 823, 827, 830, 832, 837, 839, 841, 844, 847, 849, 852, 856,859, 864, 866: n = A,T,C or G
gagaagngnantnncgganagnnnnagtnngccagttccaaaccnggaaacgccntcgcnaagnnggngggnnggnacnngnaaggcgcanccggnncaccnanccgnggncccnaggaccaggnccgcacccnncangcgncnantggaccccaaggagctcnanngcngcnnacancnannaccgggnncacannggtagcaagaagaggggancgncaagcagnngaaagcagcnggcgaacancaanccgangnannannanacaggaacacccganaaggaagcggacctatanccnangcccacaaganaaagacaccangnnccatgcttaccanagggaggcaagcnnaatngacanccnacngcanngaacctgnacacgcggatggacacccngcgcgngnngngaatagacggacggacagncaactangcccaaaangcanngccaanggnngnnccgccaacngggnacagtgaacaagngcnattgnggnngngcnggannacaccancatcnnaanggcannagnaagcaccgncnagnncnggacannanagccctgcnangngancnccnaaccangaacanannanggnacnangaannnancaaccnnnnnggggaanaaaacccanccacgangaacaanngnacccnggaccgtnggcccananaaaacgngncncnaaggncacgantcncanancgngggcccnnnacnaagcncnccatcnanangngnnaagctccgnggcgagcananngganacnacacccacgnnnngacacggaaaaccaccgncagaaaccnnacgngancncccanangnggncancnaancaanagngcccncncccc

SEQ ID NO: 5930 - DNA, 870 bp, Homo sapiens; identical to SEQ ID NO: 5929
  misc_feature 7, 9, 11, 13, 14, 19, 22, 23, 24, 25, 29, 30, 45, 55, 60,64, 65, 68, 72, 73, 76, 79, 80, 82, 91, 96, 97, 102, 104,108, 111, 115, 125, 134, 135, 138, 142, 144, 146, 164, 166,167, 170, 173, 174, 178, 180, 182, 183, 190, 191, 196: n = A,T,C or G
  misc_feature 197, 216, 219, 227, 228, 238, 247, 251, 256, 258, 260, 261,263, 264, 266, 281, 299, 302, 304, 315, 326, 328, 329, 342,355, 356, 360, 365, 368, 371, 375, 376, 384, 403, 409, 411,412, 414, 433, 440, 449, 453, 454, 460, 463, 464, 466: n = A,T,C or G
  misc_feature 467, 476, 480, 493, 496, 501, 504, 505, 507, 510, 514, 515,522, 527, 528, 531, 536, 537, 540, 549, 551, 554, 555, 557,563, 564, 566, 575, 577, 579, 582, 584, 587, 593, 599, 601,602, 604, 607, 610, 612, 616, 617, 618, 620, 626, 627: n = A,T,C or G
  misc_feature 628, 629, 630, 637, 646, 653, 660, 661, 663, 668, 676, 683,685, 692, 694, 696, 698, 703, 709, 712, 715, 717, 720, 727,728, 729, 732, 737, 739, 745, 747, 749, 751, 753, 754, 763,772, 774, 775, 779, 782, 792, 793, 794, 795, 813, 822: n = A,T,C or G
  misc_feature 823, 827, 830, 832, 837, 839, 841, 844, 847, 849, 852, 856,859, 864, 866: n = A,T,C or G

SEQ ID NO: 5931 - DNA, 759 bp, Homo sapiens
  misc_feature 5, 6, 7, 9, 10, 11, 13, 46, 48, 87, 100, 104, 106, 107, 116,122, 149, 157, 162, 164, 167, 182, 189, 201, 202, 206, 207,210, 213, 221, 234, 235, 237, 240, 254, 258, 262, 268, 283,297, 305, 306, 330, 344, 352, 358, 361, 364, 373: n = A,T,C or G
  misc_feature 376, 387, 388, 396, 398, 399, 402, 413, 414, 415, 417, 420,422, 427, 428, 431, 433, 440, 443, 460, 474, 490, 494, 498,500, 504, 511, 516, 526, 528, 550, 553, 559, 569, 584, 597,600, 606, 619, 632, 635, 643, 645, 647, 662, 665, 666: n = A,T,C or G
  misc_feature 680, 695, 701, 703, 710, 715, 717, 720, 731, 732, 738, 740,748, 749, 752, 753, 754, 759: n = A,T,C or G
agagnnntnnntntttgaatcctaatggctggctacttgttctttntncaggatcccatgcgattcgaattcggcacgcaggggcgncccatcttgtggntcantnnctatgcctnctcccntgaccacccgacagacgtggactacanggtcatgntcacngntancgaattctacaccangctgatnggctttgacaanntccnnctntancagttgtncaaatccactatnncngcnaactcgagggtcangccnaacngtaacnatggccagtgagggnacctacgcaactgnactccganngttgtatggagaaactggtagacntcaaagactgcctntccgcttngtggtnccngcnacagaggangangtcctacgtgnntgagggtncnnccnttggggttatnnnancgnantaggnntancnctggacnganctggaggcgcatgacancacatgatgctttntgagggcctgaagatnatcntgancnacangtgtccngtgangccctgtgantncattatcatgtagatttaggtngangaatgncctgggacanatgtttgtacatagnggccacctatganttnacagantatctcataactnatcagattgcttnacngtctgggnancnaactcactcattggnaanntcttgcatgctatncccaatgggtggatngccttnancttaaanataangntgntttttatcaanngggcananaaaccgtnntannngggtn

SEQ ID NO: 5932 - DNA, 738 bp, Homo sapiens
  misc_feature 38, 43, 45, 52, 59, 61, 64, 77, 78, 80, 81, 82, 85, 87, 96,100, 101, 102, 111, 112, 113, 116, 125, 128, 132, 134, 138,139, 144, 146, 155, 159, 165, 168, 169, 170, 173, 180, 188,193, 201, 203, 204, 213, 217, 221, 228, 232, 236, 239: n = A,T,C or G
  misc_feature 244, 248, 255, 258, 263, 267, 275, 279, 284, 285, 287, 289,302, 303, 306, 311, 314, 342, 343, 347, 363, 367, 372, 374,375, 377, 385, 399, 401, 434, 451, 454, 455, 468, 472, 473,474, 490, 495, 498, 511, 515, 516, 524, 527, 529, 550: n = A,T,C or G
  misc_feature 560, 568, 569, 573, 574, 577, 581, 583, 613, 620, 628, 632,637, 650, 652, 656, 664, 677, 678, 679, 681, 691, 705, 708,717, 720, 735: n = A,T,C or G
gaattgctctgtgtttttgcaggatccatcgattcggnagtgngnagaggcnccacacntntgngataaatgcactnnannnctncngccttgaanttcnnnaggggtcannnctnctactcacnggnaggngngccnnaagananctgtgggtnctgntggatnaannngtnattgacngccctggnctggntcaaaacncnnccctagtcntcangctncagggtnaggnacanacngaatntacntctcctntgngaggnatcntactattncgtnatggnnancntaatgctccacannaangtgcngtngactcacgctgctacgactctcgagacnnttcntagaagatcattgtcntctntaccncnntnggaacttnaactatgtattgananaaccttgaggatgctatgtggccacagattccntattcaatggaaaacgnccnnctacattatgcangggnnnctttctgaatcgtgtngcacntcnttcatggggctcnaatnngccgcttnaancncaaatattgggcgcttgcacngctttgacantgtgtaanntctnngtntgcnangctatacttggacccatttgccctgtatgngcccttngcaatggnttcntttcnaagtataactacnancttncaaatggncaaggtcctgatnnntnccattttgcnaacgtgctcatttnaanactgactgnaancgtttttgacaaaanaat

SEQ ID NO: 5933 - DNA, 856 bp, Homo sapiens
  misc_feature 2, 4, 7, 8, 9, 10, 11, 12, 13, 14, 15, 16, 17, 19, 20, 21,22, 24, 25, 26, 27, 28, 29, 30, 31, 32, 33, 35, 36, 37,42, 44, 48, 51, 89, 93, 99, 106, 107, 108, 113, 122, 125,126, 130, 133, 134, 138, 142, 145, 150, 151, 161, 164, 165: n = A,T,C or G
  misc_feature 166, 169, 175, 176, 178, 180, 185, 188, 191, 193, 197, 204,205, 207, 208, 224, 226, 228, 232, 233, 240, 241, 244, 245,250, 267, 270, 276, 288, 303, 310, 318, 326, 338, 344, 349,354, 356, 364, 368, 373, 377, 379, 384, 385, 389, 396: n = A,T,C or G
  misc_feature 401, 404, 406, 414, 434, 447, 450, 464, 477, 479, 518, 549,592, 600, 609, 631, 643, 649, 659, 668, 671, 676, 718, 727,739, 742, 748, 761, 762, 763, 783, 784, 793, 797, 805, 825,844: n = A,T,C or G
gngnagnnnnnnnnnnngnnnngnnnnnnnnnngnnngtttntnatancangctcttgttctttttgcagggatcccatcgattcgaantcanctcgancatggannncctcncctcagcantcnnatgngcnncctnggcnagntcacnnttgctgcttnagnnnttnctgtcnntncnaattntgnaangncttnaatgtgnnannaatcaggaaaatgctncntncaannctttagnnttnnaaccntccatattcttaacatntgngacatnccatgggatgcnattaatattcaaggnttttatncggtactnaaaaatanacacttctaccngtcaangttcngaaanancgatcatncgcntgaancatngnatgtnnatancaacctntgaanagntnctcatttncacctgaaatcatggcactnatagcaacctttntanaaggctataaaaanggacttgaatgtncnaattgcccaagaagagcgctacccttcgggaaggggaancctgaatgttgcaaccactggggataataantacccttattgtcaagaaaatggcattggggggcacattcatntgaatttnggacctggngactccttaccgaaattcccanccaggttccacnaatggnaatttgaagncccgtttgnctnttcgnggaccagtggggaaaagcaattaaaaggccaaaatccttccnaaacctttntcaagggttttnagnaaagtncccacatggtttnnnaaaggctttaaggacttgcnnttgggaaangggnaaaaaccntttaaattgtaaggcccaanggattccggaataccgccngtacaataaaaa

SEQ ID NO: 5934 - DNA, 721 bp, Homo sapiens
  misc_feature 3, 7, 8, 45, 119, 272, 298, 312, 343, 351, 362, 366, 372,375, 377, 384, 390, 393, 397, 403, 405, 418, 432, 452, 456,462, 465, 466, 472, 488, 495, 498, 502, 505, 506, 507, 508,509, 511, 516, 517, 525, 533, 534, 536, 540, 542, 544: n = A,T,C or G
  misc_feature 561, 562, 564, 570, 571, 572, 576, 580, 582, 588, 599, 623,625, 632, 634, 636, 655, 657, 669, 674, 684, 692, 693, 702,705, 709, 711, 712, 716, 717: n = A,T,C or G
ggntttnnatcagctcttgttctttttgcaggatcccatcgattngaattcggcacgagagaaaatcagggatgtattaggaaagtaacagtctctcatcaagaagccctggctcaggnatatgaatatcagtactgtggagaggccctatggatgccatgaatgtggaaaaacttttggtcgacgcttttccctggtgttacaccagaggactcatactggacagaaaccatatgcatgtaaggaatgtggcaaaacctttagccagattncaaaccttgtgaaacaccaaatgatncatactggaaaganaccccatgagtgtgacgactgcattcagacnttcagttncctttcatggnttantgaacnccnantaacgcncactgnggngaanccttangnatgtactgagtgnggaaaggcctttanccgagcctacaacctcactnggcntcaganaanncacatntgagggaaacactatntatgtanganatgnggnnnnncntttannactggctnagaactcnntngccncnanattacacatactgaagnnanaccttnnngatncatngnatgtgngaaaggcattntgccgtttcttgcaccttactccnangtcatancntncctacaactcaaaaccccntnttgaatggtgcngaatntagagaaagncttttcgnnggaatctcnttncttntnnaaannattc

SEQ ID NO: 5935 - DNA, 760 bp, Homo sapiens
  misc_feature 4, 5, 9, 10, 13, 15, 16, 34, 42, 49, 50, 53, 54, 56, 58,61, 67, 69, 71, 75, 86, 99, 120, 127, 134, 147, 155, 160,161, 166, 169, 170, 175, 176, 180, 187, 188, 190, 199, 201,207, 209, 213, 214, 249, 251, 253, 266, 278, 281, 287, 288: n = A,T,C or G
  misc_feature 291, 294, 296, 297, 299, 305, 314, 316, 317, 320, 325, 339,342, 346, 352, 357, 360, 366, 367, 374, 378, 382, 383, 385,386, 388, 393, 394, 398, 399, 403, 429, 437, 440, 441, 445,454, 455, 457, 465, 467, 468, 470, 472, 478, 482, 485: n = A,T,C or G
  misc_feature 492, 512, 525, 528, 538, 544, 560, 569, 582, 584, 586, 591,592, 594, 596, 604, 618, 628, 629, 647, 648, 652, 655, 663,692, 694, 696, 713, 715, 718, 732, 736, 754, 759, 760: n = A,T,C or G
gagnntttnnccncnngaaagcccttctgaaatngcttgggnaggtcgnnctnncncncangcagcnanangcgntggcgaattcngcacgcaggcaanactttttcctggggcaggggngtcagcnattattnaattggattattnctaagttngctanntgggncanntgtgnngagnagggagnntncctgccacntnttctgntncccnncttctgcccacacatgcagcatccaaagtccattnantnaatgaatggacanagtgccgagcanacnggggcnnaancangnncncagtcnacgcatccngnntcntaggnaaagtggtgaccgntcncggngggacntgccnaanccctgnnacacagncggncacnntnnanggacnngcanncctnggatgtgcctcaggaaaaacagggcnagccttcnagnnccgnatacgagtnncnggccttananncnanaacaanggcnctnacttgcngcatgcttcactattctttnaggcacatatatnttntcttattagntcctcncatcccatgagggacncagtggctnatgcctgggaaancngnccttnngnangtcaaagngggaggattgctcnacctaggaanncaagaccacgctgggcgnnatantgngaacccancggtacgacttgaagaaaaatatcctaancncngccttactaactttagngngcncaattacgtaaganccanacggatcagtttcaaatnagggnn

SEQ ID NO: 5936 - DNA, 766 bp, Homo sapiens
  misc_feature 1, 2, 3, 4, 5, 6, 7, 8, 11, 12, 13, 14, 15, 16, 17, 18, 19,20, 22, 23, 28, 30, 31, 32, 33, 34, 35, 36, 41, 597, 669,674, 693, 735, 745: n = A,T,C or G
nnnnnnnnttnnnnnnnnnntnnttttnannnnnnnttttnaataattgctattgttctttttgcaggatcccatcgattcgaattcggcacgagcccagccccaccccagccccaaaggaggctgttcgagagggacgtcctccggagccaaccccagccaaacggaagaggcgctctagcagttccagttccagctcctcctcttcatcttcctcctcctcctcctcctcctcttcttcctcctcctcttcctcttcttcttcttcctcctcatcttcctcctcctcgtcgtcttcctccccttcccctgctaagcctggccctcaggccttgcccaaacctgcaagccccaagaagccaccccctggcgagcggaggtcccgcagcccccggaagccaatagactccctcagggactctcggtccctcagctactcgcctgtggagcgtcgccgtccctcgccccagccctcaccacgggaccagcagagcagcagcagtgagcggggttcccggagaggccagcgtggggacagccgttccccagccacaagcgcaggagggagacacctagccctcggccatgagacaccgntcctccaggtcttcataaattgtctttgggggattccaccacacccaatgctctggagccacaaggagtgtnccttnttcccacagaccgtggganggtccttgctgctttctttgaacttggcagccttggatgganggctcctttncctccctttttttttttttgt

SEQ ID NO: 5937 - DNA, 851 bp, Homo sapiens
  misc_feature 8, 9, 10, 11, 12, 13, 14, 15, 16, 23, 24, 25, 26, 27, 28,29, 30, 31, 35, 47, 60, 65, 128, 137, 141, 143, 173, 176,179, 180, 184, 187, 217, 218, 224, 226, 234, 237, 238, 239,244, 245, 246, 256, 272, 274, 276, 295, 296, 299, 307: n = A,T,C or G
  misc_feature 308, 324, 333, 342, 346, 351, 392, 395, 424, 441, 462, 463,467, 470, 471, 475, 489, 497, 498, 502, 506, 510, 517, 524,535, 538, 542, 550, 555, 558, 569, 573, 574, 594, 601, 605,616, 617, 630, 639, 640, 641, 662, 673, 683, 685, 689: n = A,T,C or G
  misc_feature 691, 698, 699, 702, 709, 713, 716, 725, 727, 732, 736, 744,745, 746, 751, 754, 755, 760, 765, 767, 770, 771, 783, 785,795, 799, 800, 804, 811, 812, 813, 814, 817, 820, 824, 825,826, 827, 831, 832, 839, 840, 841, 842, 851: n = A,T,C or G
gagaagannnnnnnnnagaaagnnnnnnnnnaggnaggttctaaatncttggctatcganctctnagcaggagcccatcgattcgaattcggcacgaggcgggcgctaggcgcgcgcacccagcactnggtcccagncgananatctggggcagcgcgcggtggaagctgcgngcngannggancanttctggctcacgaccttgacgctagcgcgnntatcangnggaaaccncgnnnccacnnnaacaaaaagntggctggatgtggtgncncncatacctggaatcccagcnnctntagcggcnnaagcatcagaatcacntgaacccanaacacaggncgcnctganccaagattgtgcccctgcattctagcctgggtgacagtganacnggctcaaaaagataaaggtgtacagggantgtatattcagacaacntggtatggaagatgtgctacnnctantgnnccangctgatactaagtnaacactcnntacnatanaganggagatntgggacncataggactgnggncatnttaattanttcangantgttttccacnagcnnttaactggatttcacattanagaaacntttncaaggaccctnnaacgggtaaattnccaacggannnctccaaatgtaccaattttantgccccgaatngggaaaattncnacangnccctttnncanggtatgnacanagnacttttaantnacccnccantcaacctnnnaccanttnntttantccangncannctaccagttgtncnaccacaaagntttnnaagncccattnnnnttngtnaatnnnngggnnaaacccnnnnacaaattcn

SEQ ID NO: 5938 - DNA, 731 bp, Homo sapiens
  misc_feature 657, 658, 659, 660, 661, 662, 663, 664, 665, 666, 667, 668,685, 693, 695, 696, 697, 703, 712, 720, 729: n = A,T,C or G
ctcttgttctttttgcaggatcccatcgattcgaattcggcacgagattggattgccacacggctcacattgcatgcaagtttgctgagctgaaggaaaagattgatcgccgttctggtaaaaggctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaaagttattagtttttaaaatcagtctttttaatggaaacaacttgaccaaaaatttgtcacagaattttgagacccattaaaaaagttaaatgagaaaaaaaannnnnnnnnnnnaaaaaaaactcagcctntaaaactntnnngaggcnttttcctanatcccacntgataaganct

SEQ ID NO: 5939 - DNA, 755 bp, Homo sapiens
  misc_feature 2, 3, 7, 8, 9, 10, 11, 12, 13, 14, 15, 16, 17, 25, 33, 407,659, 672, 680, 699, 703, 704, 707, 717, 718, 724, 744: n = A,T,C or G
gnntttnnnnnnnnnnnttttaagnaatttgcnactcgttctttttgcagggatcccatcgattcgaattcggcacgaggattacatagtgacatatattagcttttcgtccacatttgataacattgctaatattttcttttttttttactgaactctttgaatttaaagttttctctcatttaaatttattaattaaaaacatacctttactctgttccctttagcatttcaacctgatgttaaaagatgtgtatgtgtgatatgtgtgtttgaaattttaactttcatcttggagtatttaattctctgaagcagtgcatgactcttgctcttcagcctcttgagagtgtccctggtttatattcctgatgatacaaaccctggaatttcttgtctgaagtgtnaacactttatttccaggtcctaatttgatttgaatagtggaagttcagattcaatgcattaatgacagattctatgttgcttcttcagatttgccagacagaaaaacctacttatgtgaggaaatcattaggctttttgactatcctctttgtataatgagactcttttctcattagatgagtaaaaagatccagagatgatcaccagtatcccccagaattcatatatatttaattgaaaagaaacaaatnctgggattctttnctaaaaanggtggattacatttcttgnctgnntgnacatctttgnntaacgngaagaaaaataaaaatattnattttccaccc

SEQ ID NO: 5940 - DNA, 777 bp, Homo sapiens
  misc_feature 2, 3, 4, 5, 6, 7, 8, 9, 14, 27, 68, 69, 73, 75, 76, 79, 80,85, 95, 97, 99, 100, 101, 103, 105, 111, 116, 118, 119,126, 127, 129, 130, 131, 133, 137, 139, 146, 147, 150, 156,157, 158, 162, 164, 166, 169, 171, 172, 179, 184, 186: n = A,T,C or G
  misc_feature 187, 189, 190, 192, 194, 200, 201, 205, 209, 210, 213, 215,219, 222, 232, 233, 235, 242, 243, 245, 248, 258, 259, 264,271, 279, 280, 288, 295, 299, 303, 306, 317, 318, 328, 331,335, 337, 338, 340, 369, 370, 377, 379, 387, 391, 396: n = A,T,C or G
  misc_feature 402, 406, 408, 409, 416, 420, 421, 422, 427, 428, 436, 437,440, 445, 448, 461, 462, 478, 479, 489, 492, 494, 498, 499,503, 505, 508, 509, 518, 525, 527, 533, 534, 537, 540, 554,559, 566, 568, 581, 584, 587, 605, 613, 617, 619, 621: n = A,T,C or G
  misc_feature 623, 627, 642, 645, 646, 650, 651, 660, 671, 682, 697, 700,707, 709, 711, 723, 727, 729, 733, 750, 751, 760, 765, 768,770: n = A,T,C or G
gnnnnnnnnctttnaaatcgcttggcnttttgcaggatccctcgattcgaattcggcacgagagcggnntttntnntgnntgccnctcatttgtngnannnantngacttnatatntnngatgatnnannnangtangntatgagnnatncacatnnnattnangntgnannatattcnaaggnannanntncncagacnntggntggnnacntntcanatngtttagactnngncaaaggnnangtnacaacggatnngaccncacctanactgagannacctggancctcagnatcnatcnggnaatcgctcacnnagtatacttncancagnanntntaaccttagatactcgatcttaaacttgnntatccantntaaaaacngtcntttcngacggntgtntnncatcaancagnnnatctnnaaatctgnncanaggancgnttttaaactcatnnctggaatcctcagatnnaggacccatncangnaggnntgancntgnntgccctgtnagcacgnanttccanntgngtnaactctcacaatgngtttnaagaacncnaaaggctggcccntgntcntatgagtgattctccctncttatctngggngncncnattnaatctttggaaaccnaannttcnntaatggttncccactggttnggaaccaattngaactgcaccttccngtncctttantngnggcaaaccaaancatncnttancattccatttgaccctnnttttttacnttaanacnanccttgac

SEQ ID NO: 5941 - DNA, 761 bp, Homo sapiens
  misc_feature 4, 5, 7, 8, 9, 14, 15, 16, 62, 66, 71, 80, 90, 97, 100, 101,103, 107, 108, 109, 113, 124, 129, 130, 135, 138, 139, 151,161, 171, 183, 191, 195, 206, 211, 213, 226, 229, 230, 231,239, 245, 259, 261, 263, 265, 266, 268, 270, 276: n = A,T,C or G
  misc_feature 281, 294, 302, 306, 307, 309, 310, 315, 316, 318, 324, 329,335, 340, 341, 348, 351, 352, 353, 356, 360, 374, 387, 391,395, 402, 406, 407, 411, 416, 422, 425, 434, 446, 456, 482,489, 500, 506, 511, 516, 517, 527, 528, 529, 531, 551: n = A,T,C or G
  misc_feature 559, 565, 569, 572, 583, 588, 604, 616, 621, 624, 632, 633,638, 644, 692, 700, 705, 712, 715, 722, 733, 743, 744, 747,755: n = A,T,C or G
aggnntnnntttgnnnctaatggctggctacttgttctttttgcaggacccatcgattcgantgangctcnagcaggccncatgagatcncctgctnggnncnttgnnntctnatggccactgntatcnnagccntgnnctgaaggtgcangctcacgcgncggaggtccnttgagacccagnctgcttcnatancagtccggtcnctcananctcccactggtanacnnncatgtagncactgntgcagctgactgcngnancnncntntgtggncacantaagattcgccgngccttgcntgannanntactnntnatatcnatgantgctgnctgannagaactngcnnntcnatgnggactgtcttcagnaccctatatggcntccntggntctgttnccgnngacnatttngcgacngtnaatgtgccncattgtgctctnatgccattcnatactagattccacagaaggagaccntgcgatntgcttaaatantgctgntgaanagctnntaccgaatcnnnanagttcataaaacgcctcctnaggcagantctgtnatcntcngtagcatcccnaatangatcgatatgctaacntacaactgatgncctgngantaatcaanntcttnatttantatcaatgaaatgctgctcctggaacttaacctggaatggtgcagctncaagcttngtcgncgcttcncancttggtncccgatttccnggccacttannccntttgaaanttccct

SEQ ID NO: 5942 - DNA, 761 bp, Homo sapiens; identical to SEQ ID NO: 5941
  misc_feature 4, 5, 7, 8, 9, 14, 15, 16, 62, 66, 71, 80, 90, 97, 100, 101,103, 107, 108, 109, 113, 124, 129, 130, 135, 138, 139, 151,161, 171, 183, 191, 195, 206, 211, 213, 226, 229, 230, 231,239, 245, 259, 261, 263, 265, 266, 268, 270, 276: n = A,T,C or G
  misc_feature 281, 294, 302, 306, 307, 309, 310, 315, 316, 318, 324, 329,335, 340, 341, 348, 351, 352, 353, 356, 360, 374, 387, 391,395, 402, 406, 407, 411, 416, 422, 425, 434, 446, 456, 482,489, 500, 506, 511, 516, 517, 527, 528, 529, 531, 551: n = A,T,C or G
  misc_feature 559, 565, 569, 572, 583, 588, 604, 616, 621, 624, 632, 633,638, 644, 692, 700, 705, 712, 715, 722, 733, 743, 744, 747,755: n = A,T,C or G

SEQ ID NO: 5943 - DNA, 781 bp, Homo sapiens
  misc_feature 2, 4, 7, 8, 9, 10, 11, 14, 15, 16, 17, 19, 20, 23, 24, 25,26, 27, 28, 29, 30, 31, 33, 34, 35, 343, 390, 396, 632,648, 680, 756, 758: n = A,T,C or G
gngntgnnnnnttnnnngnnagnnnnnnnnngnnngctttttagatcagctcttgttctttttgcaggatcccatcgattcgaattcggcacgaggaaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctanggtcactagtggattatgaaaatgctaataagcactggataaagcangagcanaaaatcaagatgttctacaggccgaacttcccaacaattatgttgtcagaaatttgaaaaaatatctgagtctgcaaaacaagaacttatagattttaagacaagaagagttgctgcattcagaaaaaattagtggaactggcagagttagaactgaagcatgcaaagggtaatctacagttgctgcagaactgcctggcagtgttaaatggagacacattaagccacacttccgnctttctggttaaaaanggctggcctttccttcaaattttatttttggntttcttaaatggatggttaagccttttatgcctcactgggaaaccaaaccaaaaagccacttggaaaaaggtgccntnaacttcctcttttttctggaaga

SEQ ID NO: 5944 - DNA, 797 bp, Homo sapiens
  misc_feature 5, 8, 10, 20, 28, 31, 35, 37, 45, 631, 662, 667, 699, 700,703, 726, 730, 736, 756, 774, 785, 787, 791, 792: n = A,T,C or G
ttacnatnantgtgcttganggcttggnccnaaananattggctntggcgaattcggcacgaggtgagaaggttaggtccggctcagactgaataagaagagataaaatttgccttaaaacttacctggcagtggctttgctgcacggtctgaaaccacctgttcccaccctcttgaccgaaatttccttgtgacacagagaagggcaaaggtctgagcccagagttgacggagggagtatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacacattcaaaaggatcgttttgttttgtttttaaagaaaggtgagattggcttggttcttcatgagcacatttgatatagctctttttctgtttttccttgctcatttcgttttggggaagaaatctgtactgtattgggattgtanagaacatctctgcactcaagacagtttacanaaatnaatgttttttttgctttttcaaaaacaaaaanntcntaaaaaacctcgagcccttttanaacntattantgagtccgtatttaccttanaatccagaccctgattangatccatttgntnaagnnttgct

SEQ ID NO: 5945 - DNA, 752 bp, Homo sapiens
  misc_feature 2, 3, 4, 7, 10, 11, 85, 547, 675, 733, 748: n = A,T,C or G
gnnnttnaanngctggctcttgttctttttgcaggatcccatcgattcgcgaaggggaagaacagatcctctgaaatttcaaatngaaagaaaagatatgttagaaaggagaaaagtactccacattccagagttctatgttggaagtattcttcgtgttactacagctgacccatatgccagtggaaaaatcagccagtttctggggatttgcattcagagatcaggaagaggacttggagctactttcatccttaggaatgttatcgaaggacaaggtgtcgagatttgctttgaactttataatcctcgggtccaggagattcaggtggtcaaattagagaaacggctggatgatagcttgctatacttacgagatgcccttcctgaatatagcacttttgatgtgaatatgaagccagtagtacaagagcctaaccaaaaagttcctgttaatgagctgaaagtaaaaatgaagcctaagccctggtctaaacgctgggaacgtccaaattttaatattaaaggaatcagatttgatctttgnttaactgaacagcaaatgaaagaagctcagaagtggaatcagccatggcttgaatttgatatgatgagggaatatgatcttcaaaaattgaagctgcaatatggaaggaaattgaaaccgtcaaaaangtcttgattcttgagaatgaatttgggtagttgcagaagatccattggctcttaagangatatattttgaganccat

SEQ ID NO: 5946 - DNA, 742 bp, Homo sapiens
  misc_feature 5, 6, 7, 8, 9, 10, 47, 652, 678, 698, 728, 742: n = A,T,C or G
agagnnnnnnttttatctctaatgctggctacttgttctttttgcangatcccatcgattcgaattcggcacgaggttgcctgcggcgtccacttccttggccgcccttgctacactggctgattgttgtgcagccggcgccatgtctgtgagcgagatcttcgtggagctgcagggctttttggctgccgagcaggacatccgagaggaaatcagaaaagttgtacagagtttagaacaaacagctcgagagattttaactctactgcaaggggtccatcagggtgctgggtttcaggacattccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcattgaccagatcgggagaaaggatttcatctggatgtagaagattatctctcaggagttctaattcttgccagtgaactgtcgaggctgtctgtcaacagcgtgactgctggagactactcccgacccttcacatctncaccttcatcaatgagctggattccnggtttcgccttctcaactgnaaaatgactccctgaggaaccgctacgacngattgaaattgacn

SEQ ID NO: 5947 - DNA, 1245 bp, Homo sapiens
  misc_feature 3, 5, 21, 29, 375, 377, 378, 379, 383, 388, 390, 391, 392,396, 398, 402, 404, 411, 416, 422, 423, 432, 438, 439, 446,447, 453, 454, 457, 458, 459, 461, 462, 471, 472, 477, 481,482, 486, 490, 498, 502, 503, 517, 518, 521, 522, 523: n = A,T,C or G
  misc_feature 528, 532, 534, 542, 548, 550, 556, 557, 568, 575, 576, 584,590, 592, 594, 595, 596, 599, 604, 608, 615, 619, 620, 621,623, 629, 637, 644, 645, 648, 653, 656, 658, 673, 677, 689,690, 692, 693, 699, 701, 702, 707, 709, 718, 727, 731: n = A,T,C or G
  misc_feature 733, 736, 737, 750, 751, 756, 757, 759, 760, 761, 764, 766,772, 780, 787, 792, 795, 796, 802, 807, 818, 827, 835, 837,838, 843, 862, 865, 868, 871, 876, 882, 886, 889, 897, 899,902, 918, 919, 920, 923, 926, 932, 933, 937, 940, 947: n = A,T,C or G
  misc_feature 952, 955, 959, 964, 965, 968, 972, 980, 986, 989, 990, 991,993, 996, 999, 1003, 1004, 1005, 1017, 1027, 1028, 1029,1037, 1058, 1068, 1069, 1070, 1073, 1075, 1083, 1087, 1089,1092, 1098, 1100, 1101, 1111, 1112, 1115, 1117, 1118: n = A,T,C or G
  misc_feature 1120, 1125, 1128, 1144, 1145, 1148, 1156, 1163, 1177, 1182,1188, 1190, 1193, 1196, 1199, 1204, 1206, 1222, 1223, 1239,1241: n = A,T,C or G
gcntncctttgcatacctaanagctggtngttctttttgcaggatcccatcgattcgctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgnannngcangcccnannnatcntntgcntntccctcnctccnctcttnntttattcantccttnnccctctnncatttnnatnnntnnactcccttnnactcnttcnnccantctntatctccncatnntccttctctcctanntannntcacnctcnanctctcttntacttncnatcacnntcaccttctcntctctanncctcatcncactcntntnnnccnatccnctcnccccttnaccnnntnacttanacctcccnatctctnnatnttcanctntntatctacactctctntccntctcatctacanntnnatatcncnnccatnanacactcctntctctcacnctcncncannttcactcttactnntactnntnnnctnanactacncacacttntctattnctctnctnnactctnctatnctactctcctnctcttatcntcctctcncnncattnctacttctcatctccactntcncanctncctcntcttcntctntancctctccncntancattcttctttcattnnnacnccntcatcnnttanccnctatctnttctnctntccnctctnnccncccncactctcnccatcnccnnncnctntcnacannntctctcctcccntacctccacnnnctctcccncctctcatatactcttctcanatatctcttnnnatncntcacctcncacnanacntcaatncnncttaccttannccntnnanccatnctnaccctctctactcttnnacntattctcncattctnccttcacttatctntattntctctntntcnccntantctcncnctttctcatctccctnnctcacatcactctacntnctct

SEQ ID NO: 5948 - DNA, 1701 bp, Homo sapiens
  misc_feature 2, 5, 6, 25, 32, 36, 45, 52, 58, 68, 69, 71, 86, 102, 109,110, 113, 116, 127, 129, 130, 133, 144, 146, 147, 148, 149,150, 155, 159, 163, 170, 173, 176, 177, 178, 181, 183, 194,197, 204, 205, 211, 213, 216, 218, 219, 222, 229, 230: n = A,T,C or G
  misc_feature 239, 241, 243, 258, 262, 265, 270, 271, 272, 274, 275, 276,278, 282, 283, 285, 286, 287, 298, 305, 306, 313, 314, 317,323, 324, 325, 330, 334, 340, 349, 350, 352, 359, 361, 368,388, 390, 391, 396, 399, 400, 413, 434, 435, 443, 453: n = A,T,C or G
  misc_feature 458, 466, 469, 471, 477, 486, 494, 498, 499, 509, 513, 528,542, 548, 553, 556, 562, 563, 564, 565, 566, 570, 577, 579,582, 584, 590, 597, 608, 611, 614, 616, 622, 627, 630, 633,636, 638, 642, 643, 647, 648, 649, 652, 655, 659, 668: n = A,T,C or G
  misc_feature 685, 686, 688, 689, 690, 693, 699, 700, 709, 712, 716, 728,731, 740, 746, 747, 753, 758, 761, 765, 766, 781, 785, 787,789, 790, 796, 797, 803, 807, 814, 815, 822, 833, 834, 836,837, 842, 844, 846, 852, 861, 873, 878, 887, 891, 898: n = A,T,C or G
  misc_feature 902, 903, 904, 913, 914, 915, 917, 920, 935, 938, 943, 957,964, 967, 979, 980, 983, 985, 989, 992, 997, 1005, 1006,1008, 1011, 1023, 1033, 1038, 1044, 1045, 1054, 1058, 1059,1062, 1063, 1065, 1086, 1098, 1100, 1102, 1108, 1117: n = A,T,C or G
  misc_feature 1121, 1126, 1128, 1132, 1137, 1143, 1149, 1159, 1160, 1161,1163, 1167, 1181, 1183, 1187, 1188, 1192, 1195, 1198, 1202,1214, 1215, 1220, 1223, 1234, 1237, 1239, 1244, 1258, 1263,1266, 1268, 1276, 1279, 1296, 1297, 1304, 1330, 1333: n = A,T,C or G
cnggnnaccttctaattgttcttcntggcggncttnaaaaattgngcttgtngggccncctttaaacnncntgaaattatggcggnctttgggggggatganattatgnngtnctnttggggggctnannttnatggtctcccntnnnnnactcnatgntctntcctaanatntcnnntgntnctcctttcgcngcnttatctnntgtcantntcntnntcncctcttnnctcatccantntnttacatctcctctgncgangcnctcannnannncncgcnncnnnacatatacctntctttcnncctcatnnacntatacnnntctcnctcnccatanacctctttnnanctactcntnttatccnctctcctactctctccgtcncnngttcncanntatcatatacccncctgctatcgtccctcttcanncttctgcnaccctctctnacctntctccctnccntngcctanttcatcatnctatcccntctnncatcccatcnacanttctaccactcccancacccccttcctantctccntcctntcnaatctnnnnntttnatatctnantcncntctccncctatcntctttctcctntcnctntnccaccnccccnctnatntcncnttcnncctnnntcngtntccnacccccttnatccctacacacctctnncnnnacntctcgnntttcctctntcntctntaacatccactncanctatctttnatctannctctanctcanccncctnnccatactatccatanccanantnnttcaanntctccnaccnctcctcnncactctnttatctctctnngnnctctncncntctctntcactctanattcttatactntttcntactacctntccnctctatnactnnnctactcacnnntnctnatctctctctcctcntanactcnctcactccttatanatcttcnatnctatcacactannctncncctntcntactnatatcttnntnttntctctcacactntacatcactncgcantcatcnntctcctcantacnnccnncncctctctacatatatattccntctctctcctcntncntctctntctcctctntctntcatnanacancactnactctncatctntctctctatnnntntccntcactcacattctntncacnnccanttnccnctcnccgtatctctanntctcnacntctctctactnctntntctcncatcccactctatnatacntcncncctatttnccntactctctctacatacnnctctctncttctccactctctctctctctctcnaanttncncctctnctnttnntcatntctccnctcaacctntatcnctcnanatcnnctannctagtctctctntanncattctcntatccnnnntcnatntcacacancnnataactntctncatcactcctcactctctntatnctctctctcntntatactctctctacntntcnntntcatccanacacattnttcatnctatatnntccncncnctctcctctctcttntcatacatctacncacctatcctntccactctctcntctcatnctcncncatctntctacnnatcnctctctnntancnatnctnnctctncacatatctcactctcactcatctntctnnctcncnccntctccct

SEQ ID NO: 5949 - DNA, 756 bp, Homo sapiens
  misc_feature 5, 6, 7, 8, 9, 10, 11, 12, 15, 27, 42, 50, 57, 80, 90, 95,122, 151, 152, 186, 211, 244, 246, 248, 265, 269, 273, 284,308, 324, 329, 337, 342, 345, 402, 425, 428, 450, 451, 452,453, 468, 483, 507, 526, 532, 534, 555, 556, 572, 573: n = A,T,C or G
  misc_feature 588, 589, 590, 607, 612, 637, 646, 650, 675, 676, 691, 710,722, 723, 726, 732, 734, 750: n = A,T,C or G
agagnnnnnnnnttnttctttgcttantggcttgggctcctngttctttntccaggnagcccatgcgattcgaattcggnacgaggtgtnaaagngaacttttaagggaggttcctgctgtnccagaaacccttcaagaaaaagcgaaggnntttctcagagctgaagatcaagcgcctgagaaanaagtttgcccaaaagatgcttctanaggctaggaggaagcttatctatgaaaaagcanancnctatcacaaggcatatnggcngatntacagaactgnaattcgaatggcgaggatggcaanaaaagctggcagctcntatgnacctgcanaaccnaanttggcgtttgtcatcagaatcagaggtatcaatgcgagtgagcccaaaggttcgaanggtgttgcagcttcttcgccttngtnaaatcttcaatggaacctttgnnnngctcaacatggcttntattaacatgctgangattgtagagccatatattgcatnggggtaccccaatctgaantcagtncntgaactaatctcaaacgtggnnatggcaaattcaatannaagccgaattgcttnnncagataacgctttgatngctcnatctcttggtcaatacggcatcatntgcatggangatntggttcatgaaaactatactggtgnnaaacgcttcaaagangccaattacttcctgtggnccctcaaattgnnttntccacnantgggaatgaagaaaangacccc

SEQ ID NO: 5950 - DNA, 748 bp, Homo sapiens; identical to SEQ ID NO: 5923
  misc_feature 5, 6, 7, 8, 9, 10, 44, 71, 74, 81, 91, 92, 111, 117, 118,128, 136, 141, 145, 166, 175, 187, 192, 194, 196, 201, 205,207, 210, 212, 224, 241, 278, 300, 324, 352, 359, 370, 383,388, 391, 392, 397, 410, 411, 445, 458, 459, 464, 465: n = A,T,C or G
  misc_feature 475, 476, 478, 501, 503, 513, 518, 531, 541, 568, 580, 583,606, 613, 620, 632, 651, 666, 702, 704, 705, 706, 739, 747,748: n = A,T,C or G

SEQ ID NO: 5951 - DNA, 674 bp, Homo sapiens
  misc_feature 415, 452, 656, 667, 673: n = A,T,C or G
gttttctcctgttacatcatgctgaatcctttcccttagccattagcttttattatgtggtcttcataggaaagccaccctggtgccaagcctagcttgtggggaggggtatgtgttccagaaactgctctttgtgttcccttcaatgaggaaacaacatgtgtctacttatgtggcatccaactgcttggagctccacacttccctttcgcgactcaggctctggtgctgttgccaaatccttgcttggcaaagactgttcgatcatgtggggtccttatttacaagggaaagctgggccagaaggctagcaattcaggtgttaccgctattgctgtaccttgtgttaggacattgtgtttgtgcatggactgtgcctccaaactcagtagttccgtatctaaatataaagtantgttagaaacctgaaagtacagaatctcaaccttacnagtctttcccttagtcctgtggccttcctaagccagctgttaaccgtgttgattccttccacttcccccaaagtaaggcaggcaacagatatgttgattgtcttagaaagtaatctggttcctctgaactccattgaattccagtttgacgcatactgcctggaaccagactgtttgcttacagctttttaaagaaaaatctgncttggtcctgnccccant

SEQ ID NO: 5952 - DNA, 589 bp, Homo sapiens
  misc_feature 529, 579: n = A,T,C or G
attgaggaagatctaggtaaaacctttaagttaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtakatcgggataattccaaatttgaggagtggtgtattgaaatggctgagatgcgtacaaagatgtggataaaggaaaagcaaaacacgaagaggttaaggagctgtaccaaaggttacctgctggagctggtctgtaagatattctgggacagcactgttgccattaagtgccttgtttttttatgttcacaaatgtatatgaagaaactttctcaaacttactctttctaataacccactaaagccagcttaaacactctaaaagtactttgtaaaccaacaataacttgatgtgtagcattccatattatttccattacgttgtactcctaaaatggggagctgttaatnaattataacctttagggtcagcactctgcatccctggagtattgttggtntttatatttt

SEQ ID NO: 5953 - DNA, 660 bp, Homo sapiens
  misc_feature 615: n = A,T,C or G
aagggaaggaggctgctgggtagcaaataagccccttcttttcttggtgagttgatgacctccaatagctcccagtgkcaygrgkacccagtacgcattagctggtgttgggttgattgagacctggggcagttcctggggcaagaasccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcagaggtggcagggccctatggagcaccaactgccctcaaccccaccctgtgcccaagactgggaagggattgatgtcaggctgtggccataggtagcatgagttgcccaaggagggacagagcatatctttgctgaggcttggctgaggggcttatgatagggcttgcagtacctcacagccccctgtgggcacagncaccctgaggtttacccaggcaaatatattgattagcaggaaaaa

SEQ ID NO: 5954 - DNA, 615 bp, Homo sapiens
ccatagcctgttgagtgttcccagatgtgactcacctttctgctgccctcttcatgcaggcctactgactcataakkcacgwkgtcccaaaagccaccccacaagcctgagccaacctgctgcctgacgccacagtcattggcagaggtctgggcattattaatytataaaaatccatgctttacacctggacagtasacagggacttcagagattgcacgttkgaatacattctcccaagactgaggttgttcggttttaattcctgtagtccaatcacacaatttcttatggaaaaccttttgtgtttctggtatttaataacttgaagggatagcaaaatatactgtgtattcagagggcctctctgcagctgctagctcagacaccaaaggggtaaggcccaggacattcatatctttaaaagctgcaaacctggtaacctttaaacttttaaaacaaatgtcatatggggtaacactgaccttttataatttgatgtctcaaatgtagagattatctaaaaatcgtaacttgaataccttgtaatttttctcttaaaaaagaagacttgtgtaagtctctgcatcaacgccaataaacatgttgcttaat

SEQ ID NO: 5955 - DNA, 937 bp, Homo sapiens
gtggtggctcacgcctgtaatcccaaagtgcatggattacaggtgtgagtgagccaccgcggccggcctctatcattttctgactcagcagctccaccaaaattgacatcctagcaaacactgtgaaggaattaacctaagtsyttccagagcatctcatgtaacctctatggagtaagtcactttttctgtaacatgtggcttttgaccttgatgaagactttgacttctcatccctgtctacatggaggaagatgattcagtggtggggaaaatgaacctcggtaacatttccaatgtccttcaagagggaaacaagttcagtgttatcatcgtggcattcgttagttttttttttttaaatcacktgtttagatacaactttatttttttatacctacatagcacatgactggggggataaagcatgtataagttgggagagggtaaagaatgtgtgactatgtatacagaaaatagactaaaatgtgcagcaaaatgatatatactgtaatctggtttttgaagtatctactattctggaatattgttaaacaactttttgcttttgaaaaaaaaaaggtgccttgattcagttgcgtgacttagaacattcatcctattttattgtgatttttaatgtcttctgaccccaaactgtgtttttggttgcagtctggcggctgcaggcatagcgtcggttttgttccaataacagagaccaaagagttaatcagatatggttcagctgctacaattgtatgattcaaaggcaatttaatcaccccaaatttccatggcccccacagtcaagacctgccattcgttttctcttgcaggttggagtaaatttgcactttgaatcatgtgggtcatttggggaccttgttcttttctattttgctttattaataaaggaacttgtagaaaaaaaaaa

SEQ ID NO: 5956 - DNA, 653 bp, Homo sapiens
  misc_feature 428, 543, 582, 603, 625, 639, 647: n = A,T,C or G
gagacctctaacctcccgcagttgagcaaatacactctgagagacattagggactgtggcaaaaagcaggcaatccatgtgtgtcacttaagccttgagcacagttcagtaggcaacaaaccaggaactgtcctggcagataagacagactgtgmaaggtcatcgtcatyggcatgggaagggcattaattaccaaagtggagacasagtcactgtctccaagagcatttggaatcacttcacagagttctcaaggaggggaaggctatctgtcagctcctggcgggactgctgccccatatactgtgatgaattgcttcacatatctgagttctgatgggaaggagtccaagtgcggtagctgtagagaacgctggggaagcccagttctatgtagctcacgtatgaaaggaatattcatgaagagnaaaacagaggcattatttgagattaactgcctgagaaacctagtctaatcccaagtgtctagaaaatgttgactacttgccatgtgcccagtaaggtgcttggagctttatatgnatcctctcatttaaccctgtgacatagttatgctggtanaccttgctgcgttcgtgtacnttgaatgaagttgaagcttaanggaaggttaaaacnccaacccnaactga

SEQ ID NO: 5957 - DNA, 559 bp, Homo sapiens
  misc_feature 348, 490, 553: n = A,T,C or G
ggaagaggatgactgggtatgctgtgccacccttgagggccatgaatccactgtgtggagcttgggctttgacccgagtggccagcgcctggcgtcttgtagtgatgaccgtactgtgcgtatckrgcgtcagtawctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgctgtkttcaggaggatcccaactcggatccacagcagcccaccttctccctganagcccacttgcatcaggcccattcccaggatgtcaactgtgtggcctggaaccccaaggagccagggctactggcctcctgcagtgatgatggggaggtggccttctggaagtatcagcggcctgaaggcttcttgaagctnacctcgacttttggacagagtaatggactccccagaaaacgttcatataagaattttaccagncccttg

SEQ ID NO: 5958 - DNA, 554 bp, Homo sapiens
  misc_feature 523, 528, 549: n = A,T,C or G
gaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggccmwtagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaattcaatgttcacatgaacaaacaagctgcccccaggggtaccattttggggagggggaatctttttttttcttttcccctttaaaaaaaaacacntttgncccgaacattttcccattttnttttt

SEQ ID NO: 5959 - DNA, 477 bp, Homo sapiens
gctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttgccatggcagccaaacggaaggctgagaatccatctccacgaagtccgtcatcccagacacccaattccaggagacagagcggaaagacattgccaagcccgctgcagtctgcaaaggtcttcacaaatcagaatcaactggtaatt

SEQ ID NO: 5960 - DNA, 957 bp, Homo sapiens
  misc_feature 793, 814, 899, 921, 933: n = A,T,C or G
aatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttacagaagcattgatggcagtccgaaatgtctctagctcatataacttaatagtaataactaaaaaacttttagaatttacttttgaaaggagggaagccagttctgaaatgagtataggttgatttcatagtccncctaattaagagtttagctcnttggtaaactccaaatacataaactttttaagtggagttccatttactggaaggattaaaatgggtacagtgccagccatattcnccaaaaatattgtctaccggcntattttggtaanccgttaggttggggttttggttcc

SEQ ID NO: 5961 - DNA, 534 bp, Homo sapiens
  misc_feature 379: n = A,T,C or G
cttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgttcggcctctcctgttaaacaaaaacattctaaaagccattgttcttgcttcatggacaagaggcagccrgagagagtgccagggtgccctggtctgagctggcatccccatgtcttctgtgtccgagggcagcatggtttctcgtgcagtgctcagacacagcctgccctagtcctaccagctcacagcagcacctgctctccttggcagctntggccatgacaaccccagagaagcagcttcagggaccgagtcagattctgttttgtctacatgcctctgccgggtgccggtattgaggcacccagggagctgttactggcgtggaaataggtgatgctgctacctctgctgctgcactcacagcc

SEQ ID NO: 5962 - DNA, 300 bp, Homo sapiens
caytygkcaggggmsaggggacagcaaggtgggaggttgaagagctttgaggctcagcagcatgtttgtggcattcggtggacaccatggccttgggcggctggacaggtttttgtgatgtgarggacaygcatggggcacatggtaagcttggcaagggctccaggaacgctgacgaagggttttaggacccccacccccatgcctgtaccagggctggcctccagagcgggtgaggacagagcagctgtgggcttttcattctgaggtcttggcccccctggccaccgcaagggactc

SEQ ID NO: 5963 - DNA, 598 bp, Homo sapiens
tttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctcctgtggtttcaaattattaaacacacttccatttctcttgg

SEQ ID NO: 5964 - DNA, 1416 bp, Homo sapiens
  misc_feature 744, 814, 1217: n = A,T,C or G
agtgagtggtcttaccaaaaatccagtatccttgccatccttgccaaatcccactaaaccaaacaggcgttccttctgtgcccagtcctagtattcaaaggaaccctactgccagtgctgcaccattgggaacaacacttgctgtgcaggctgttccaacagcacactctattgtacaagccacaaggacttctttacccacagwgggcccatcaggactctatagtccatcaactaatcgaggtcctatacagatgaaaattccaatttctgcatttagtacttcgtctgctgcagaacagarcagmwataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgaccattgcaacccatacaaccagcaccgcctcttcaaccatctggggtgccaacaagtggaccatctcagaccaccatacacttactacctacagctccaactaccgtgaatgtaacacatcgtccagtaactcaggtgaccacaagactccctgtaccaagagctcctgcaaaccaccaggtggtttatacaactcttcctgcaccaccangctcaggctcccttgcgaggaactgttatgcaggctcctgctgttcggcaggtcaatccccaaaatagtnttacagttcgagtgcctcaaacaaccacatatgttgtaaacaatggactaaccctgggatcaacaggacctcagctcacagtgcatcaccgaccaccacaagtgcatactgagcccccacgccccgtgcacccagcacccttaccagaagctccacaaccacagcgtctgcccccagaagctgscagcacatctytgcctcagaagccaccccacttgaagttagcacgcgttcagagtcaaaatggcatagtactgtcatggagtgtcctggaggtggatcgaagctgtgccactgttgatagctaccatctctatgcttaccatgaggaacccagtgccactgtgccctcacaatggaaaaagattggggaagtcaaggcacttcccttgcccatggcatngttactctcacccagtttgtatctggtagcaaatactactttgcagtacgagccaaggatatttatggacgttttggtgctttctgtgatcctcagtcaacagatgtgatctcttctacccagagcagttaaacttgggagctttaaaatttcccctttaaaatttcacttttgggcctggttttaatctgtgcatgaa

SEQ ID NO: 5965 - DNA, 300 bp, Homo sapiens; identical to SEQ ID NO: 981

SEQ ID NO: 5966 - DNA, 300 bp, Homo sapiens; identical to SEQ ID NO: 1006

SEQ ID NO: 5967 - DNA, 634 bp, Homo sapiens
caagagagagtgatagaattggcagtgaaatatacgaaccaccctcctgccctctgggttcacaatacgtgtacacttgactgtgaagtggctgtgagagtgggtggagagttcttctttgaccctcagcctgcggatgcctctagaaacctcgtgttgattgcaggaggagtcggaattaaccctctgctttccatcctgcggcacgcagcagcatctcctcagagagcaggcaaacaaaagaaatggatatgagataggaacaataaaactattctacagtgcaaaaaataccagcgaactcctgtttaagaaaaatatccttgatttagtaaatgaatttcctgagaagattgcatgcagtttgcatgttacaaaacagactacacaaatcaatgcggaactcaagccatacatcacggaaggaagaataacggagaaggagataagagatcatatttcaaaagagactttgttctatatttgtggcccacctccaatgacagactttttctccaagcaactggaaaacaaccatgtacccaaagaacacatttgctttgagaagtggtggtaggaggcagacaaaggcagaaaaaataaagaggtgagatctactcaggaaaaaaaaaaa

SEQ ID NO: 5968 - DNA, 672 bp, Homo sapiens
ggccaaagaggtgctacatgcattgaaagaaaaggttacttcactacctgacaaccataaaaatgcccttgctgctaacatagatgaaattgtatttacatcaacaggagacatctccatttactatgatgagaaaggaaggaagtttgttaacatcctgatgtgcttttggtatctaaccagtgccamcatccccagtgaaactttaagaggagccrgtgtattccaggttaagttggggaatcagaatgtggaaactaaacaacttcttagtgcaagctatgagtttcagagggagttcacacaaggagtaaagcctgactggaccattgcacggattgaacactcaaaattattagaataattttcttggaaaaatcagcttatggactttagcagttgctgtgaaaaactaaggaagaaaaattttggggtcatttgatcttcacttaatctaagtctgtgaattacttttatattattttgaaatactccttgcagtatattggcatgatacagtaaaagcattttccacagattgttatcaccttctttaaaagaagtcaaaatttaaaaaatacaatagcacgttgttggtgtcatattcaataacatttccaatgctacatataattttatagacataataaagaaggtattgaaaaaactaaa

SEQ ID NO: 5969 - DNA, 738 bp, Homo sapiens
catttgtaaagctgcagggaaagaggttccacttcccagcaaccccatcctaatggcttatggcagtatctcaccttcagcttatgtattagagatttttaaagggatcaagtcgagtgagctggaagaatctctacattgtgctgcctttctcttatgtcccagacattcttaaactctttaacgaattcattcagctgggctctgatgttgaacttatatgccggtgcctcttcttcctccttaggattcactttggacagatcactagcaatcaaatgcttgtgccagtgatagaaaaattaagggaaacaaytatttcaaaagtcagccaagtccgggatgttatcggcttcaatatggctggtcttgattatctcaagagggaatgcgaggcaaaaagtgaagttatgttttttgctgatgctactagccacttggaagagaagaagaggaagaggaaaaagagggagaagttgattctaacgttgacttagaactgaaatgtggtatctttttttttttcaacatttttcctttaaaggactcctaaactaagcacagaagagttggcgtcatcttaaaaataccaagtaacagaagatcgcattgcagatgatatcaggatgtggtttccagctttgcctgagggaattccaacatgagattatgggctggctccatttcttggacttaaaatgcattattagtttaaaaatctttctgtgctctcaaagc

SEQ ID NO: 5970 - DNA, 1203 bp, Homo sapiens
gcactgttttagctcttgccaaacctccttcgccctgtgcgccaggtacaagcagtcagttctcggcaggggccgaccgggcaacttccccccttgtgtccctctaccctgctttggagtgccgggccctcattcagcagatgtccccctctgcctttggtctgaatgactgggatgatgatgagatcctagcttcggtgctggcagtgtcccaacaggaatacctagacagtatgaagaaaaacaaagtgcacagagacccgcccccagacaagagttgatggagacccagggattggacaccatctcccaaccccagggactcgggcaagggtgccgaagatagacaagaggcacacagagacagaccaactggcagccaggcagccccagaggagagagacattcagacagaggaaagtctccctgcccctcattccttccaagatgagaaaaacttgccgccaccccccgacactgatgccagggaggtgggaggaagaagtgggaaatttcccttcccagtacccccaagaacgtctgagccttcaatgttgaattttttctttattaaaattacttttatcttataaaatcaactaatcaaaaatgatatagacgacagcactggctctgtgaaggtggcatctttctgggcaggcaggccatggggcatggaggagggtgcaaagatatgggttgctgtcttctggcctccagctgcatggaggccggcccagggtctagggtgtgcactgggcaagggcagggcggcaggtgtcaggccggcttggacaatgaaaccctgaccttgctgcattccttttgcttccaccaccactagcttctttggaatcttggggtgggggtcatctttggggattatggctgccacccgggatttgagtgtagggagtgtgggagcagccttggcagatkggcacccgtgccctgcaggtgttgacaagatccgccatctgtaatgtccttggcacaataaaaccaaatgtcagtttccctgagccccgactctgttctgtgtggggcaggggttgggcgggcctctgggcagaggatgcaatggcacggaccttggcttgacctcagaggtgtgaatgctctccagcagggtctgtctgggggcctggagtttgtatttgatttgctgcttattaaacctccttctggacctattgccactgg

SEQ ID NO: 5971 - DNA, 669 bp, Homo sapiens
aattactggaacccgggaggcggaggctgcacagtgagccaagattgcaccactgcactccaggctgggcaacagagtgtgactccgtctcaaaaaaacaaaaacaaaaasaacttckscctmckmsrcagactcctcccctggtcaccactagtgatccaccttatggatctcccaaggccacctctgcctctgctctgtgttgtattatttgggggacctgtggtctggcatgcattgtacttggtkscccaaagggctgtggcatctgataagtgatttatcctcaggcacagatttgcactatgtcacccacttacttgtatgtagaagtgagtcaccggctggcaaatgggcatagctgctgggcagtggatgcagctccatgcatgttattctcatttgatacaggatctcattggcttctcacagcaatcctgtgcactataggtattgctcccgggaacagatgaggaaacaggagagtgcgagattacagtaattttgtaaatgggaggatttgtgaaggtttcagacatacaccctctctcatatgtcaaggatatgaagtctaatgaatcccctaaagcagcaggggttggcaagcttgtgccctggggccaaatcagcctactgcctgtttttgtaaataaagttttattggaacac

SEQ ID NO: 5972 - DNA, 476 bp, Homo sapiens
  misc_feature 415, 437, 456: n = A,T,C or G
ggtgccatggagttcaccatctgcaagtcagatatcgtcacaagagatgagttcctcagaaggcagaagacggagaccatcatctactcccgagagaagaaccccaacgcgttcgaatgcatcgcccctgccaacattgaagctgtggccgccaagaacaagcactgcctgctggaggctgggatcggctgcacaagagacttgatcaagtccaacatctaccccatcgtgctcttcatccgggtgtgtgagaagaacatcaagaggttcagaaagctgctgccccggcctgagacggaggaggagttcctgcgcgtgtgccggctgaaggagaaggagctggaggccctgccgtgcctgtacgcsacggtggaacctgacatgtggggcagcgtagaggagctgctccgcgttntataaggacaagatcggtgagnagcagcgcaagaccatctnggtagacgaggaccagcttt

SEQ ID NO: 5973 - DNA, 340 bp, Homo sapiens
  misc_feature 319, 324: n = A,T,C or G
aatcccacaaagcctagcaccaaacttctttttttcttcctttaattagatcataaataaatgatcctggggaaaaagcatctgtcaaataggaaacatcacaaaactgagcactcttctrtrcamwarcymkagactrktswcwmwcagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatacaggattatngaaanaatattttgtggtata

SEQ ID NO: 5974 - DNA, 610 bp, Homo sapiens
gttaacttctctgagagagttccttgtaaggctacttataaatagtagtatatatatatatagtttatggcagggaagatctgggaagtaagcaaaaagagcctttagttaggcaacatagaacaaaatagaggtcacaggttccatgcactgaagaatggaattgaaatagagactccagggtcatagactcttggaaggaagactagagtacattcatgaccctcacccttaattacttcacaggtgagaaaaccaagagctacagaaaataagttattcctcagywccagggcctrsytccttggagaattgggttaaaattcaaaataaccttctaaaaaattctttcagaaacgagtagtgaaagccagtggatcaaattcagtgatagttaacagagaaacagcagcatagataagtaagccaatttaatgtagggagcaaccactagtgtacatgatctcagctcatctggtactaccaagtaaaaatgaacctgggccagccacagtgactcatgcctgtactctcagcgctttgggaggccaaggtgggaggattgtttgaggccaggaatttgagaccatcctggtcaacatagcaagac

SEQ ID NO: 5975 - DNA, 300 bp, Homo sapiens; identical to SEQ ID NO: 1857

SEQ ID NO: 5976 - DNA, 300 bp, Homo sapiens; identical to SEQ ID NO: 1106

SEQ ID NO: 5977 - DNA, 757 bp, Homo sapiens
gctgccaccacccccgggcccagcctgtctgaaagttcagggtttaggccgagaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctctgactcggctccctactccctgcacccagctgggcgcagccttggggcctgcggtctgaatgtatccctcccctcagttttaacctgagctgccgaacgcacagtgggccgggggcgaggctgggggaagcggggcccaattacggatcccgggagttacaggtgccgacgtgatgtcgcttctctggtgcccagctcccttcctggtctgagactagctctgggggtggcgggggcccccacacgctygctcccgctccaccctgcccgtgctgctgctctgtgcctgctgtcagagccctggtgggggaggatgtggccaccctgagacccggaggagacgggcgtctgcctgggtttgcggagagccgcttatgggtgtggtccgtccagacaccttgtttcaagggggatgggcgtgagcgggcaagcagagcatccccaccgctgagcaagaactttttcttgtttttaaaccatcacgtcctcatttcacattggaataaagtgagtttttgaaacctgcg

SEQ ID NO: 5978 - DNA, 1316 bp, Homo sapiens
gtggcaacttgatgaaacagccaaatgcaccagggcaggtcactttcccattacactgattccacaattaaaaaaaaaaaaagaaaaaaaactcattgaratagctacagttctataggttaatttaaagcctcctttttctactcatttttgaaascaaaattacattttactattttacataaccagtgaaaagacgttgaaagcctacagctcactgtttttggtgctctggaaatgttgagggtgggtttttaaccagtgatttttaacgtgcagtgaatttgttagacttttaaacaccagctaaggtagtcaaacttgatccccattaaaaatcaaggaattaggggtcgggggagggtttaggagtgatccagaatgacctcccagaattactgtgcgtacaactttatttttcagagttttcattggaatggtaagagttttatgaaagacagttttaaaacttattctgagttaaatattaatactttaaaaaattattgtactagacttatcgcagccttttgaaagtagcagagtttcatcataccacatatataacagagcataaattttctataatcaggcaccttttgctgcttttgagtaagactgttttcctgtttaagtgttaagcatcgccagacataaaaatctattctctcctctcgattgtagcatagcctgacagctctagatacagcatttctatgatgaaaaatgagtatccatcaggaaatctagaagactagccgtgttttctcagactccacctttgtttgcactctgttgcctgtgaggagctttctggcatgtgattatttacttcaaaactagagttccaagcacctacattaattattttatattgtgtgcagaatagtatatcttttaatgtcagatatgatacactgcacatattgcttttgcactcttaaaatttttgtactaaataatagaaaatatttatattctttgagtgtgagctttgaatagatggcattatcactttattgttttttttttaacaaaaactttttctcaattattctattgcaatgttattctgagcaagtcctatgccaaatatcttgtataatgtttgtatggaagattaaattttactcttgtgtggtaagactatttcagttactgattttatagttggaatttgatattccagcacaaagtccacagtgtattcagaaatccaagttggtgtcatacatttcattttgatgtgaacttttctttgctttcctttgttctaagactccattttgcaataaacgttttgacagtaaaaaaaa

SEQ ID NO: 5979 - DNA, 377 bp, Homo sapiens
aacgcttcaattgttttgtagaaattttaataggaacttcaagaagtaaacctttataacattgtaaattcttacgtacagcatcacaaaagacaaggaatmctgtcatatccttttagcaaaatgakattgcctaggttcttgttgcaaaataccacataatgaaatccttcctgttgcatgattaactgggtgagaatatcatctttccttttggtccgtagaaatgtattattcactactccattcttgaggtttgttttttaatttttttggagacagtctcactctgttgcccagtctggagtgcagtggtgcggtctcagacgtctcactgcaacctctgtctcccaggctcaagtgattctcgtgcctca

SEQ ID NO: 5980 - DNA, 550 bp, Homo sapiens
  misc_feature 389, 489, 496: n = A,T,C or G
gaagacaccagtggtggaatcgagtgtttggccacagttcgggacctatggtagaaaaatactcagtagctacccagattgtaatgggtggcgttactggctggtgtgcaggatttctgttccagaaagttggaaaacttgcagcaactgmagtaggtggtggctttcttcttcttcagattgctagtcatagtggctatgtgcagattgactggaagagagttgaaaaagatgtaaataaagcaaaaagacagattaagaaacgagcgaacaaagcagcacctgaaatcaacaatttaattgaagaagcaatagaatttatcaagcagaacattgtgatatccagtggatttgtgggaggctttttgctcggacctgcatcttaaggncatgaatattctcccataacggattcaactatgagaagagaagtggcagcaataaggcagtctctcaaaagtcatactgccagagtctctagggcaaggngaaacanctagctgggcaatactcaattcacaacttagcattttgccatcttgaagcttgg

SEQ ID NO: 5981 - DNA, 447 bp, Homo sapiens
  misc_feature 303, 309, 318, 410: n = A,T,C or G
cgccagagcagcagtggggaacatcttcttgtctgctggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgytcctgggatacgctatgaactntgaccngctccccanccctccccaccaaggggttactgcaggggaagggctaggtgggggtccccgagatcttagggaatttttttagggggattttaagccagagntagtttgcgttcccagggaccaaggagaaagaagcat

SEQ ID NO: 5982 - DNA, 555 bp, Homo sapiens
  misc_feature 521: n = A,T,C or G
cgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccaggtgcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaagggggtgtgctgagttctataatataagctgccatatattttgtagacaagtatggctcctcccatatctccctcttccctaggagaggagtgtgaaagcaagggagcttngataagacaccccctcaaacccattccctctcca

SEQ ID NO: 5983 - DNA, 576 bp, Homo sapiens
gctacgtgggaggctgaggcrgragaatctctksmrcckmrgaggmrgaggttgcagtgagccaagattgtgccagcctgggcgacagggtgaggctcttgtctcaaaaaaaaaagtccacatcttcatgaaccctcagactctggagttgggtgtcggcttttttagccagcttttgtkssrwttrsykwkracctattaaagaaggaaagtgggtaatggagtcccagccactcaagagactggatatcccccgagaatggcttgggttaccagctatggacccttggaagatgaatctaatccttctcactggtttttctttgcaaattcatttgcttttatttttctaataacaataaactctattttccatgttctcagggcccctgggtagacagacacagcttgatttcagagcagacataggcgaagaaaacatggcattgagtgtgctgagtccagacaaatgttatttatatacacatccaaatttgaagagaaaatgtatttctttaggtttcaaacactgtaatagatataaagcaaaaataaaaacctgttgcaaagttaaaa

SEQ ID NO: 5984 - DNA, 631 bp, Homo sapiens
agtacccagagttgcgaggagttttttaactgatttagccaggtggcaatcatgagtgaatggatgaagaaaggccccttagaatggcaagattacatttacaaagaggtccgagtgacagccmgtkmgragawtgagtataargsatgggttttaactacagacccagtctctgccaatattgtccttgtgaacttccttgaagatggcagcatgtctgtgaccggaattatgggacatgctgtgcagactgttgaaactatgaatgaaggggaccatagagtgagggagaagctgatgcatttgttcacgtctggagactgcaaagcatacagcccagaggatctggaagagagaaagaacagcctaaagaaatggcttgagaagaaccacatccccatcactgaacagggagacgctccaaggactctctgtgtggctggggtcctgactatagacccaccatatggtccagaaaattgcagcagctctaatgagattattctgtcgcgtgttcaggatcttattgaaggacatcttacagcttcccaatgagaggccaggaagtgtgaacatactgatagaaaaagactatattttatccctcataaaatgttttaaawrtaaaaat

SEQ ID NO: 5985 - DNA, 300 bp, Homo sapiens; identical to SEQ ID NO: 1159

SEQ ID NO: 5986 - DNA, 699 bp, Homo sapiens
gtttcactgtgcggtgcagtgcggcggcagctcgtgaggaggacccgtacatkgacaccaccctgaaggcttgcccacctgtcagtatggatgtctgtgctttaagaatacagcttttcataggcttgaaagccatctgtcactttaaaaaccacatcatacttttgactaaagcagaaccctgaagccattccagagagaagacagtcacccaagaggcttctttcgagwaarsatmccmktgyymmarkcaaaatwcctgccwgtwkctgagrmtgagktgkaaytkgtatattktgwrtaykatctywccagtgcagctgtacaaagagatggtagactatagcaatacctataagactgtcaaaacccagagctgcattcaccttctcagtgaggctcatctgttagtgcgagctgscctgatggatgccagtcagctggaacctggagagaaggcagagcttttggaagcatttaaggaaagctgtgggcaccttggggactgttacagcaggcttgactcccagcattctcatctcaccttgccatactataagatgtctggtttgtctatggctgaagttctggcccgcacggactggacagtagaggatggattacagaaatacgagagaggattaaatcttttacattaaatccattccactttatggaaaacctgggatgtaaggaatt

SEQ ID NO: 5987 - DNA, 423 bp, Homo sapiens
  misc_feature 371: n = A,T,C or G
caggtagtggcccctgtaagcagggccagagtcgggacaaagagcaggagtgaagcagccaagagacagaggaccaggctggagccagtgggcacgcaggagcctgcctgggaagaagccggggggcaaggctggcatgggaatgaacacctgctggtgacacctctctgagcttcagttcccttaactagaaaaatagaacaggcccggtgcggtggctcatacctgtaatcccagcactttagrkatgrytgmrrcrrktrswtcwtsagrtcaggmswtccwwraccayymwrrccgacattggggtattagcaatgttttgttacttgggcattttcaagaggcagacatagtccagaagcagaagnttgggcaggtcccagatcttgttctatagccctttatcctgaagctcgtgcc

SEQ ID NO: 5988 - DNA, 366 bp, Homo sapiens
  misc_feature 314, 317, 337, 360, 364: n = A,T,C or G
gctccttcttactctagtatctctgcctttggtcagtcagagagcatttgatgagtaccatgctgggctggaccccatcctggctgccctggaagatagagacaggtcaccttgatccctgcctgtagcatttgggctggctgagatggtggargtgtgaacagaatattccagtccagtgtcctctgtggtagggatggggatggacccsggagaggccctcctgttcctggcaggaggtgggactcagagttaaaagtgaggtcaagrcccagtgcgatggctcacamctgcagtcctagcacttcgcgganttnaggtggatcaccagaacccngtagttcaagaccagccttgganaaanat

SEQ ID NO: 5989 - DNA, 952 bp, Homo sapiens
ggttctaccagtgcctacaccaagagtggctactgtgtcaacaggttttcttcacttctgccaggaggcaacaggcgaaactcaacagcaaaagactacaccattctagattgcatttacaatgaggtaaaccagacctactacgttctggatgtgatgtgctggcggggacaccctttttatgattgccagactgatttccgattctactggatgcattcaaagttaccagaagaagaaggactgggagagaaaaccaagcttaatccttttaaatttgtggggctaaagaacttcccttgcactcccgaaagcctgtgtgatgtgctatctatggatttcccttttgaggtagatggacttctcttctaccacaaacagacccactacagccccggaagcactcccttggtgggctggctgcgccctacatggtgtcagatgtccttggtgtagctgtgccggctggccgctgaccaccaagccagactatgctgggcaccactccagcagattatggagcacaagaagagccagaaggaaggcatgaaggagaaactcacacacaaggcctctgagaatgggcactatgaattggagcacctgtctactcccaagttgaagggttcttcccatagcccagaccaccctggatgcctcatggagaattaaagagagaagmctccttaaggagccacaggatggtacctggccccaaaaggaatcctggagaggaggacagtgacaacaggtgacttyattctttagagtgaactttccaaacccagtccagctggaaacagcttatctataatctgaaatgctggctcaaacagttatggggaggttcccagattgcgtagcattcagattgatttgagcagctcctactgtgataagtgtatcccagatccacaatgtaaatatatgtgatttgtaagaaaaaaaaaaa

SEQ ID NO: 5990 - DNA, 431 bp, Homo sapiens
  misc_feature 379: n = A,T,C or G
gcaccagcaggtagtggcccctgtaagcagggccagagtcgggacaaagagcaggagtgaagcagccaagagacagaggaccaggctggagccagtgggcacgcaggagcctgcctgggaagaagccggggggcaaggctggcatgggaatgaacacctgctggtgacacctctctgagcttcagttcccttaactagaaaaatagaacaggcccggtgcggtggctcatacctgtaatcccagcactttagrkatgrytgmrrcrrktrswtcwtsagrtcaggmswtcmwkaccaccmtkraaaccgcattggggtattagcaatgttttgttacttgggcattttcaagaggcagacatagtccagaagcagaagnttgggcaggtcccagatcttgttctatagccctttatcctgaagctcgtgcc

SEQ ID NO: 5991 - DNA, 1101 bp, Homo sapiens
tgaaaagggtaaacctgtttcacctcccaaatttatatattcaaagtatttacttaaaattcagaagccagaagttcatgtcatgattaccaggaagttcaggccagaatgaatccctagagaagccaggccaagcctggataattgcagctggatgaccctggcccgaaagtcacagttmaktckgmmykakkcctagttcaggcttactatctagaacctcatgctagcttaggttgcatgtttacattgctgcagtgtctttactggaagcttagttggatcgaaatggacaccgagatggagatgcttctggctacatttcgcagaaccccaggagacctgcatttagaccactctgtccatttgtgtgcccacccccacccccagggtctaagtgtagactccaagaggagcagcccagagcttggaggagaggtgtgtctggggsaccactggtgggtggtgctgctcttctttttgttgtagttaatgcggtgtcttttaatggactctcaggcctcccagacagccttgttcctttaaggcagaagctcttcttcattgtgtaccycctgggattcatgaggtgtgagatttggcctgcttgactttgaattcaagtttttcaagtgactctcagtgtcagaagaagatttcatgctgtccacatgtggtatgtccacagctcaccttcaaaggcttagatgtagccatcacagagagtggtattttattaagaacccaagtcccagcctgaccaacatggwgaaaccccatctctactaaaaatamaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttggggagctgcttcaactttggaatatatgtttgccaatctccttgttttctaatgaataaatgtttttatatactttt

SEQ ID NO: 5992 - DNA, 515 bp, Homo sapiens
  misc_feature 434, 504: n = A,T,C or G
ggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggttcctcatcgacggcgtggagtgcagcgacgtcaagttcttccagctggccgcgcagtggttcctcgcacgtgaagcacttccccatctgcatcttcggacactccaaggccaccttctaggccccacccaccaggggggcccacctccttgccccattgntgtgagggggcccagcttgcattttcttgtttaaacattttcagttttaattacagaggacagacgtttnaaaacacaaag

SEQ ID NO: 5993 - DNA, 710 bp, Homo sapiens
  misc_feature 710: n = A,T,C or G
cagagctgtatcttcagtggtgtgatgaagctacagtaggggagatcactcatgctaggtatggatctccttacccttggcctctgaatcatattttggcctatcaaaaacagtgggaagkcaaacgtaagrtgraagctatkggatggggaaagaagactctggaccaggtcttagaggatgtagaccagtgctgtcaagctctctctcaaagactgggaacacaaccgtatttcttcaataagcagcctactgaacttgacgcactggtatttggccatctatacaccattcttaccacacaattgacaaatgatgaactttctgagaaggtgaaaaactatagcaacctccttgctttctgtaggagaattgaacagcactattttgaagatcgtggtaaaggcaggctgtcatagagttatgtgttagtctcaggagtcttaacttttgaaatatgttttacttgaatgttacattagatattggtgtcagaattttaaaaccaaattactgctttttgaaacctcaaattatataatgtatcttatgtatgtgctttatattgttatttgtgtatacattaaaataattctgaattatttaatctgatatgttgtattctgtatcttgaaatttttgtttccttgaaacatgcatgcatttaaaaataaagcttaaacaactgtatggatgttaaaaaaaaaaan

SEQ ID NO: 5994 - DNA, 648 bp, Homo sapiens
  misc_feature 526: n = A,T,C or G
atttagtgagatttgtattctaggaagtgtgtgccgtcacttgttcatttacaactgcaaagattgtatgtctcctatgttttcctttcatgccaaagaaactcaccctttttaaaagccagcaggttgcacaaaccaaaaacaaaatattttgccccttaaataggcattttaagaagttttatttcctggtacttaaatattgtgtagagggaaagctagttgtaataatttgtaaaaatgcgtgtatttttaggaatgcgctatttccagtaagggaagtattgacatttttaaggaactgtgctgcattaaaatccacagttgcatgaaacttttaaaagtttaagatataaagtaattgctaaaatttgtgaactactcagaggactcaatgccctaacatgtaggggattgatcattgcgatgtttaggccaggatttctcatgattgtatatggttattgatcatttttaaggggctgaacctgctgcctttatacttttgacacctccctccctcccncccwccaaactgtggctgtaaacagtgactctgcatagtcagcgttatacttgatttctttgtgaatgcaaataaaataaaatttgtaagtccaccaaatattgacttaactaggtaaatgt

SEQ ID NO: 5995 - DNA, 906 bp, Homo sapiens
gtactttgagtgtttgggggttcaacacacacatgcaattttgcttaacaaaagtattttataatacagtttcatacagaattaccttaaaagggagtcttatgttttcaactacagatagttgwaagggatcataccagaagatattgatgatagtkgaaatattcttagaaggggtgtgtatgtcctagcctgtgtctaccatgtgtatgtattcttgacaagcagtataaaatacctgtgatttttctttacattagggataatgcataaggaattaatcttcatatatattatcatccctaatgtagcagggggaagtatttaattgcccatgatatgtattttacttatactatgccrgagrggaaactataaagtaattacmcatgtaatcttgggtttttcacatatgtaggtattcattttgagtaggttgaagaagaaaaaaaatatttaaatgaattgaattcctgatgggatagtatcaataagtatttaaaagccagtattctaaaaataataaagggtagggtcatttttgagtttgtttttcttttgctattgttaatattcaaaattaaagtgttacattggtacctgttgtcttaatgcatttattgagaacagcattgagatgatgaacaaggggttagcaatagcaaactctataattattttgactaattacttaagaggaaaacagtataagtatctcattcagtatttagcaattctgtaaaataagtattatctctatttttcagatgaggaagtaagggtttagcaaggttaagagatctatccaatttacacagcaagttagtagttgagcctgaccatgagtcttctgactctgttcttttcactatgcaatacgcaaacaataaaatgttatacaaatgg

SEQ ID NO: 5996 - DNA, 677 bp, Homo sapiens
  misc_feature 326: n = A,T,C or G
caaagccgtcccttcaaatccgtctttgtgcccactgccatagtcaaccccgtgagaagcacagccggccctgggactttaggacaagggtctcttcggaaagggcggagcagcatgagaaagaatggatccctgcagagacccctccagtccgggatccccactctcgtggtagsctcccycaracscagccccaccatggtccttcggcctcagcagttccaattctaccagccacaggggatcccctcctccccctcasccgtggtggtggagatggggtccaagcctgccctcacgggggagcccgccctcacgtgcatcancaggggcagtgaggcccggttccactccgcggccagctccctcattatggaagacaaagaaatccccatcaagagtgagcctctgccaaaaccgcccgcatctgccccaccatccatcctggtgaaacagaaaactcaagaaatggcatcgaaagcaagtcaaaaccgtgagatttcagaattacagccctcctccaccaaacattacacctccatccacctccggaaagcctgacagcagcaccctcaaggcgtccagctgaagcagcgtcttgggccagagatgacatctatttgccaccgagtgctgcactcggcaagagaagactcgagaagtagctctgcaaggca

SEQ ID NO: 5997 - DNA, 301 bp, Homo sapiens
  misc_feature 280, 290, 293: n = A,T,C or G
ggcagtgctgcgcggggctcccagccctgctgggaaggaccagggaaccactcagcaattagaccctcttggccctgcccccaccatgcacccagcagccagggagtgcagcggkcagcctggcagtgagtgaaacccaggcctycagccctccaaagcctggggccaccccctgtagcaggcgatgctagaataaggaggagagccagagctgaggctccttgccccttggcccctycaggggccatgggatctctgtctcccacacccctgtcacggnccgcctggancancccatagg

SEQ ID NO: 5998 - DNA, 427 bp, Homo sapiens
gtgatccgcaagttgtggaagaaatacgccaagcaaataaagtagccaaagaagctgctaacagatggactgataacatattcgcaataaaatctygsgycramagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgtaactgtgtttatcwttttattaatgttaaataaagtgtaaaatgcagatgttcttcaccccttttggtagaacaaaagcaggatgataaccatatccccccagtgctcatcaaagtaggacactaaaaatccatccatctcagtcaaagtcgagc

SEQ ID NO: 5999 - DNA, 775 bp, Homo sapiens
cttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttggtgtttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactaccccaggcaatttgctgtagataatgtgattgcttccaatgacataattatcccaaactctctgccccggatatactttgccaaacgaaatttgaattctctgaataaattggtcatgtctaa

SEQ ID NO: 6000 - DNA, 713 bp, Homo sapiens
gttggagaaatccaaagctgaccaaaacatggtccccaccttttggagcttacagtctgttctggggaacagagattcagccaaagtcaagaaacactggatgccagctagattatctgttctgtgctttggtgtctataagtacatatgtggatatgggttcattttatccctaaacttagtaccaaaccagcatttaatatctaattataaatctaatttggcctaaactttattattgcacactgcctgaacaaaacctatttgtctctatgtaaattttttcctcatggaacaagggtgtgaaatgaaaatattttaggatttatkcaaaracagactattctgttttcagcttcagaattgttctttgaatcctaaggaacctctgtcaacagttgaggttgctgttgaaaagaaagaagaaggaggcggaaatctctcagggagaattatttcctttcttttctatttcagatacctggaggggtggggagaagtaagaattgtaagggaggttcagtagtggggaattctgtgacagctgattgaagatgatgatgaagaacctctgcattctagttaccctttgcttcgctttcacctcttgtaaaattgggctggcaacaatgacattgtcatgctttatgtccaatatcctcctgtcgagatctaatggtcttaatcgtgccgtaaatggaattcccccacca

SEQ ID NO: 6001 - DNA, 529 bp, Homo sapiens
  misc_feature 320, 355, 359, 413, 442, 472, 513, 529: n = A,T,C or G
agcagctgcatctaggggcccttggtgagatttacactcagagcctggtcgccccccgttagcccagattcaaaaggtgaacatctgtttgcagaatctgattcatgagaaggtgagtttattgttttcagtttagacttttgggaagttggactagagaggggagttgttggggtcagtgctggcttaacagaaaacacagcgaatttcccctccagttctccccaagtccactgaacaaggctagttcctgcaccacccaggattcaaaggaaagacgaagggagcagaacttgtggcagcaacaggtaaacttcaanaaggagggcaggatcccaccctacagggctggganggancccaaaggccccatctgtttctcctccaggagttgtcaaggcagcagaaaggantcacccagccaaaggaggagatggctcancggggctgcaccaaggggccaagaggcctnacccgtgtctaaaccctcctctcactcccctaagcctggtngaaaagagtcagaaan

SEQ ID NO: 6002 - DNA, 459 bp, Homo sapiens
  misc_feature 452: n = A,T,C or G
ttcatttttaaaaagcttctccttattatgttgttgtttaacaactkaaacgctatctctagaccaggaataattatttgctatatawtacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctgggyrtagtttaaaagactggaaaatattaagtgtgtggggaatgtagagcaactgaaaatggcctacatctttcataggaaatgttaaaaccaatacaawtactttggcaaaactctgtccmacmttttctacccmtttcacccagggcactyccttccctggcttttgggttnccccggg

SEQ ID NO: 6003 - DNA, 300 bp, Homo sapiens; identical to SEQ ID NO: 1251

SEQ ID NO: 6004 - DNA, 540 bp, Homo sapiens
  misc_feature 463, 487, 506: n = A,T,C or G
gtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagcmwtaactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactgggcctgtgggtgatgcaaagctgctttgctctgtatctgggctgggacttgatctgtctcacaaggaaggccatgagggncatagggggaggaaggcttccttntcccccttcatctttctgnttccaaagggtgggtagggcaaggaggggagtta

SEQ ID NO: 6005 - DNA, 683 bp, Homo sapiens
  misc_feature 426: n = A,T,C or G
atacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcnrcagggctgccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaaaaa

SEQ ID NO: 6006 - DNA, 578 bp, Homo sapiens
  misc_feature 470: n = A,T,C or G
ctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccstaggccacaatcagagaatggaattcctaggtgactccataatgcaacgtggtagccacagagtacttattcattcatttcccagatcatcatgaaggacacttaactttgttgcgaacgtcgtttggtgaatnatagaactccaggccaagctagcggaggagctgggcatgcaggagtacgccataaccaaccgacaagaccaagaggcctgtggggcttcgcaccaagaccttgggcgg

SEQ ID NO: 6007 - DNA, 395 bp, Homo sapiens
cagaaattcaaataattcttttctgcttcaatgccagcagaaggtcccccaggtagacatggagaagcactttgttttaaataggagggtttcatagttgcatctgaagccacctggttctgttwawstgttrtcgtgcaggtwkwgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtatgtatatatatatatataaatatctttcccaatatgccccgttgacagtgtttaaattcc

SEQ ID NO: 6008 - DNA, 300 bp, Homo sapiens; identical to SEQ ID NO: 2047

SEQ ID NO: 6009 - DNA, 300 bp, Homo sapiens; identical to SEQ ID NO: 2049

SEQ ID NO: 6010 - DNA, 655 bp, Homo sapiens
ccattgttagcatcgtacacgattgtgatttttatgtcaaaagaagccaaaacttgcaatactatttttagcagacaaaaaaaagaactaagtataaaatgtataaatatttttgacttgaacatttggatggcactgggtsmamgtagagcatccatccttcggatgraatgtttggaaaaaagagacttttaaaaaggagacggttgttttaaagagtctgtttaggggttaaagtactgtaactcacgactgttaaaaaataaattttcctgtgctgtaaaggaaggtttcacagtaccactgagttagatttcagccacagatgcttagctttttttttttgtcttttttttaaggaggaagcctttgttttgttttcctgagccctcactctgtttttgtgctgttactcggtagagtcaagactgttactttttagccatggctgacattgtatcaataactaaaactgaaacattcaaaagcgaacagggaaaccgagggcttcaagcgtgctcagagccgtttcagacagtggaaatccatgacaaacaaaaggatgtgatcattaattgtaaagcgctttgtaaaattcacatttacaaaataataaagtcagttcaaacctaaaaaaaaaaaaaaaaaaaaaaaa

SEQ ID NO: 6011 - DNA, 300 bp, Homo sapiens
cacctgtgcccccaggctcaaggtctctggcaggtgcacaccagcccaactctgcagggcttctytccctgccaccaccccccaagccaggaccccactccttccccgaggctgagctgagccttttccaggggcagggcccaggagaccattcccagaatccatggggcagtagccagggctccggctgctggaggaagcagctatccacaaagcttcctgccccagagctgaggctgaggccccgggagaggcggcccctacccaaacactggctgctggcattccaccaagtgaccc

SEQ ID NO: 6012 - DNA, 345 bp, Homo sapiens
ttacttttgattgtgtctgatgggaactgagttgttggcctttgtgaaatgaaatttttggctcttgagaaagaattcttatgaattgttatgcgaattttatatatttaaagagggagatctggggctgttatttttaaacactttttttcataatacatattcccgagtagatatttataaaatatatgtttctttcattatgtgtttgtaaaattagagtttaaataaatatgctttgatgcatagttttgaactaatgtaacatgatttttcttttttaaaacagcctgaaaatgtactagtgtttaaaaataaagatttccattttctccaaaaaaaaaa

SEQ ID NO: 6013 - DNA, 703 bp, Homo sapiens
  misc_feature 410, 412, 420, 447, 610, 613, 614, 620, 639, 644, 678, 697,701: n = A,T,C or G
cgcgacgggggttcagggaatatttactgggcctctccgctccctctgctcttggaggtgccatgaggtcagttagctacgtgcagcgcgtggcgctggagttcagcgggagcctcttcccgcacgcaatctgcctcggagacgttgataacgatacgttaaatgwacysgtsgygrsagmcrycagmgcggaaggtgtctgtgtataaaaatgatgacagtcggccatggctcacctgttcctgccagggtaatgctgacttgcgttggggttggagacgtgtgtaataaaggaaagaacctgttggtggcagtgagtgctgaaggctggtttcatttgtttgacctgacacctgccaaggtgttggatgcttctgggcaccacgagacactaatcggagaggagcagngnccagtctncaagcagcacatccctgccaacaccanggtcatgctgatcagcgacatcgatggagatgggtgtcgtgagctggtggtgggctacacagaccgtgtggtgcgagctttccgctgggaggagctaggtgagggtcctgaacatctgacagggcagctggtgtccctcaagaaatggatgctggagggtcangtnngacagnctctcagtgactctggggncactnggtcttcctgaactgatggtgtctcagccaggtnggtgcgttttgcaattctnctgngt

SEQ ID NO: 6014 - DNA, 404 bp, Homo sapiens
acaaggacaagaaagaaagtacggttgcaacggctggctcgcatgcatgccgacatgatggaggatgttgaggaagtatatgccggagacatctgtgcattgtttggcattgactgtgctrgtggagacacattcacagacaaagccaacagcggcctttctatggagtcaattcatgttcctgatcctgtcatttcaatagcaatgaagccttctaacaagaacgatctggaaaaattttcaaaaggtattggcaggtttacaagagaagatcccacatttaaagtatactttgacactgagaacaaagagacagttatatctggaatgggagaattacacctggaaatctatgctcagaggctggaaagagagtatggctgtccttgtatcacaggaaagcc

SEQ ID NO: 6015 - DNA, 300 bp, Homo sapiens; identical to SEQ ID NO: 1324

SEQ ID NO: 6016 - DNA, 593 bp, Homo sapiens
  misc_feature 517, 524, 529, 568, 581, 587: n = A,T,C or G
agcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggraggraccaggaatgttgttgctggaatgtctagggaaaactcactctaattgatccaggaaactcttccttccacggstttaagggggtactttgattcagggttnattcatnattgncccgaaggttcagtgggtttacgggctgttgaaattttnacaattttcttgnaccctntccaca

SEQ ID NO: 6017 - DNA, 447 bp, Homo sapiens
  misc_feature 400: n = A,T,C or G
gacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtaggattctggtgcatctgcaataactygagaaagccacacacatagggatcggccatcacaacagcagcctcttcggaaatcaggtgggttagctcaaccaatgggagagctggatgttggatgatccccacgggagccccantcccaatggcacccattcacagcttcatgcccgaggtgggaggtagt

SEQ ID NO: 6018 - DNA, 1170 bp, Homo sapiens
gggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatatttcattcttctatttcatatatttctatgacattatatcttagatgtgtaatttatgaactactactggattattttaatccattagaaattactattcacgcattctgtattcaattcatgtgatagctaatatatttggttttaaatgcatcttattttgtggttttcttctaggctgttttttgtgctttcttttaaaaatatataggttttaataatcttaattttcttttagtttgaaatgtatatactcattttattcattagtctaagataagaattgtaacacttctctaacctattatagaattgttaatacctttacccttctcttgaacacatcaaaggatgtcattgagtgttggtattggagtatagcatatctattattctgctcaattagaagatattgttcatgttgtatagagataataagtaattgtattgatctgcagatgcatccatctcttggattctcattccttctaccactgcagaactttcacctgtaatcactttcctttggccttaaggataacttttagggttacttttctactaaatttccaatttttgaccagatataatcttatattgtgctcttcctgaaaaatactattgttgtggatagaaatctgggttggtagttatttcttcagcaatttgaccatgtcattccactgtgtccctggcctcctgtatactggatgtgaatggatacaattatatattgtgtttatagttttcctgtgctataggaacagtattccccgaatctgatgcaaaggacaacacaccctagagattgtaacagtgagatgaaccaagtgattggatggggttttgagttgctggaataatggagttacagtgtacaatgcataagcaacataataaattatatatctggtgaac

SEQ ID NO: 6019 - DNA, 301 bp, Homo sapiens
cgccgcacagctgctgaatgscttggrrytwgstggygcrttwcmkcrmsymgsrcstgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcccgacccttccacccgggccctgctactcctggccttgctgatcctctacgccctgctgagccggct

SEQ ID NO: 6020 - DNA, 349 bp, Homo sapiens
ctgagatctgcttttactgaagtggatcaatgatgaaactagccaaatctgagcatcagaagkctttccrgtctacctgatgcatgatctctacagttctgagaagcaraactataaaacaatgtaaaacaataagggcatatgtctggtgtgtgtgtgtgtgtgtgkgkgtgtgtgtgtgtgtgyacscacaygtgtttataaagrtarcagytgtaggaatgaatgagattgrgggtgrgggggtgcrtatgtatgtctatgaaagcctaatcatttctgggcaatgatgwaaaggttttackactgatctttgtaactatgatggtttctacacttgacctgggct

SEQ ID NO: 6021 - DNA, 907 bp, Homo sapiens
gctgtacggagagtgctggaccgaggggagctgggagcaggtactgcctccatcctgagctgccgtcctttgaagggagaacctggggtagggttcgaggagcctggcragaactgtgcacctcctcgggaggagcagccccctcctgtgctgctttccccctcccttcaatatgctggggcggagacyckggcctccaaagtgcaattccgggaccccaaatcccagcggacgcaccaggctcaggtggcgttccaggtgtgtgtgcgccctggctcctacaccccgggacccccttccgctgcccttggagaacctcctgaccctcacttcagtccagccgaacttgagtgggtcactaaggagaagggggccacactcctctgtgccctgctggtacgggtggaatgaggggtgagacaccactactacaagcacagtcgggccgcgggcattgggactctgagtggcgactgctccacctcattcccgtgactcgtggcatgcgcaggtgctggarcttggcagccgcgcaggagcatgtaggcaggctctcagatgtaggtggcaagtggcacagctccatgtccggaggcccagcactccgtctgatgggaggagycgtgggagcccagctccaggccctggtacccctcttcatgcactgatttggggaacatgactcccttttactcccctaccccacatcacttaatttatttccgtttttgtttctggttactgtgaatcccagaggagtctctccctgtgcccacatgaagctgctttttccggggccaccgggcgggagtggggaagggtgggcgcacggaagatgggggcctctgtacagttgttactgactctgatttctaaggagccaataaacaccgtctcagaaaaaaaa

SEQ ID NO: 6022 - DNA, 865 bp, Homo sapiens
  misc_feature 829, 846, 860: n = A,T,C or G
acttttttaacgaatgggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggmtyytyagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccawtttgccaaactctgcatttcatttcatctaanggyttargcccctcttncttccgggggttanccgtg

SEQ ID NO: 6023 - DNA, 952 bp, Homo sapiens
tgcaacatcactgatatcagcatcctttaaaatattatctgmywcttgttctragagcmasaaagctgggaattcyttgayaragtkawkmasaatgcmkmcawaatgaatgcatgyasrctrytrtggtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataattacccagtctcgggtatttcttcatagcagtgtgagaatggattaatacctggatgcatgcatgtttgtgtaacaaacaggtcttttggcttatctagtaagta

SEQ ID NO: 6024 - DNA, 657 bp, Homo sapiens
gtatcacctgagcaaatcttttaaattatacattctgtgatatttccttgactttcttatccagcacttgtattgattatttttcattttgataatgttgggtttttaaaaactcctttatgatggaaaatttcaaacatacacaaaagtagagagagaatggtataataaacccactcagttttaaggattgtcaactaataccagttttatttcatgtatgactccaacaacttccccaaccagccttcagattatttgaaagcaaatttcagacatcgtattttactcatacattttctagtatctaaatctggaagagactcttttctaacagttctgtagcattaattatactcatactgttgtgcaacaaatatccagaaatcttttgtcttgcgaaactgaacctcttacccattaaacactaactcccttttttttcaccctgaaccatkggcaaccacaattttactttctttttctgtgagtttgattacttgatacttcatgtgagtggaatcatataatayyystctttytgtgactgacattttatttagcttaatgtcttcaagtttgacccataccatatcatgtggcaggatttttccctttttttttttttcagacggrgytcgytctgtcgccaggtgg

SEQ ID NO: 6025 - DNA, 969 bp, Homo sapiens
  misc_feature 620, 693, 771, 791, 801, 836, 862, 869, 880, 895, 902, 922,949, 961: n = A,T,C or G
ctgggagcgagacggtggcccggcccagccccatgggccacaccggctggtgagacgagaggatggggcagcaggggaccgggacctgcgggcagctgtggtgaatcaggacgctgaggagccaggaggcctkcctggaggcggtgctacgtcgactacaggsacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggcaggtggcgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgccgctggccctccccctgccaccctgtcgggtttccctgtttgggggtgggagcgtggaggagcccctggcagttggtggccagtgtagggctggccaggtnctggaggacatgcataccccagcactggtgagtggcaggaccacggggaggtggcacaggcctccctggagcnggattatctcggccccgccccccttcatttgggctcccgctgtgggcctggcctgggctgtgagcacagcttgccccnacctccggccatggctgtgnctggtgggtncgccggatgggagcccggggctcttgcttcctttncccgggaagttggttgcttccgggtngggaggnacagcattggnacaagaggggttttntttccanaggctgttcaagcaaagttnaagttgattccctgacaaagaagcatntgttttcccggngaacttgc

SEQ ID NO: 6026 - DNA, 280 bp, Homo sapiens
gaggagttaaattttgaagctctttgagaaaggtaccttttcttaacatgttkkwtaaataaaaatacaatggcttatttaaaatgtccctatgcatggtgaaatgttaaataccaagtggatgaatggttctcaaatatattgtaatggagaattattcacatgcatctattgtttaaactaataagtaaaatagacttcctttttctgttctgttttaaatgtgcactaaaattacctgcttgtggttaagcatgggctggacagtttattgattttt

SEQ ID NO: 6027 - DNA, 758 bp, Homo sapiens
gccacacgggcccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttkgtttctcccctgggcagccaacctgccccagaggcaccagacctgggctttctagcttttgggaccaggctgcccaaaggtactcctttatacacccggcaccttccacggagatgggtactttcccaagcaagcccc

SEQ ID NO: 6028 - DNA, 300 bp, Homo sapiens; identical to SEQ ID NO: 1370

SEQ ID NO: 6029 - DNA, 333 bp, Homo sapiens
atccagagaaatgatgtgccttgtgtaaagttgtggttaggaagggacagagccaggactctaaattctgtcctccggccataattccaaaactttctccaatgttaggtatgtaggctaaaatgtgctaacagcacttgtgtttttgtttccttttgttttactttttattatggcaaatttcaaacatatacagatacagaatagtttaatgaactcccatgttctcatcatgccagttcaaacatgaatacatggtcaaccttgtatcacttaaactcytgcasacaagccctgccccatcctgttgttttgaataaaatccatcattgt

SEQ ID NO: 6030 - DNA, 555 bp, Homo sapiens
aaaacactatttacctattttccaaggaaggaagtattgagattgacattccagtccccaaatacttatcttctgtgagctcacaagaaactcagggcggcccccttagctcctatgactggaacccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagcc

SEQ ID NO: 6031 - DNA, 1029 bp, Homo sapiens
aacaggaatatggaaagaaactcagagccgagttagtggaaaagtggaaagcagagagagaggctcggctggcaagaggagaaaaggaagaggaggaggaagaggaggaagrgatcaacatctatgcagtcaccgaggaggagtcggacgaggaaggcagccaggagaaaggaggggacgacagccagcagaagttcattgctcacgtccctgttccctcgcagcaagagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctkcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcaagtgcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagcaagactcgtgccattgcactccagcctggcgacagagtgagactctgtccccccac

SEQ ID NO: 6032 - DNA, 416 bp, Homo sapiens
  misc_feature 2, 3, 35, 39: n = A,T,C or G
gnnctatagaatacaagctacttgttctttttgcnggancccwtckagwskgaattatagtattgacgtgaatcccactgtggtatagattccataatatgcttgaatattatgatatrgccatttaataacattgatttcattctgtttaatgaatttggaaatatgcactgaaagaaatgtaaaacatttagaatagctcgtgttatggaaaaaagtgcactgaatttattagacamacttacgaatgcttaacttctttacacagcataggtgaaaatcatatttgggctattgtatactatgaacaatttgtaaatgtcttaatttgatgtaaataactctgaaacaagagaaaaggtttttaacttagagtagccctaaaatatggatgtgcttatataatcgcttagttt

SEQ ID NO: 6033 - DNA, 572 bp, Homo sapiens
  misc_feature 524, 538: n = A,T,C or G
aatggcctgcctcacacgtcagccagaacccagctgccccagtcaatgaagattatgcakgagatcatgtacaaactggaagtgctctatgtcctctgcgtgctgctgatggggcgtcagsraaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtgggaagctgtccttcaacaccgacaggagtttgggtgtgtgatggggaagagggggcttatttaactcgtctggttgcaggttcatggaagaagggagccagcaggagtcgtcttttcaggttttnggcaagctcggggntgttgggagagttttcctcccgaggggaccacct

SEQ ID NO: 6034 - DNA, 300 bp, Homo sapiens; identical to SEQ ID NO: 1389

SEQ ID NO: 6035 - DNA, 553 bp, Homo sapiens
ggtacacgaagaggtgataatgacagccaccaaggagatttggagcccattttagaggcatctgttctatcttcccatcataaaaaaagctctgaggaacatgaatacagtgatgaagctcctcaggaagatgagggctttatgggcatgtcccctctcttacaagcccatcatgctatggaaaaaatggaagaatttgtttgtaaggtatgggaaggtcggtggcgagtgatccctcatgatgtactaccagactggctcaaggataatgacttcctcttgcatggacaccggcctcctatgccttctttccgggcctgttttaagagcattttcagaatacacacagaaacaggcaacatttggacacatctcttaggtatgtaatgtcagtgatgtaatgagctggtgattcactttcttcctttttattttcatgtatttgagggtaagcacagaacttcagaaatgtatttggatttgccattttgttttctgaatttctaatgatgaattttctgactggtttactcgtagtttatcctggtttgca

SEQ ID NO: 6036 - DNA, 300 bp, Homo sapiens; identical to SEQ ID NO: 1392

SEQ ID NO: 6037 - DNA, 300 bp, Homo sapiens; identical to SEQ ID NO: 1394

SEQ ID NO: 6038 - DNA, 575 bp, Homo sapiens
ggacaagtccaagaaactggcggagcaggctgcagccatcgtctgtctgcggagccagggcctccctgagggtcggctgggtgaggagagcccttccttgcacaagcgaaagagggaggctcctgaccaagaccctgggggccccagagctcaggagctagcacaacctggggatctgtgcaagaagccctttgtggccttgggaagtggtgaagaaagccccctggaaggctggtgactactcttcctgccttagtcacccctccatgggcctggtgctaaggtggctgtggatgccacagcatgaaccagatgccgttgaacagtttgctggtcttscctggcagaagttagatgtcctggcaggggccatcagcctagagcatggaccaggggccgcccaggggtggatcctggcccctttggtggatctgagtgacagggtcaagttctctttgaaaacaggagcttttcaggtggtaactccccaacctgacattggtactgtgcaataaagacaccccctaccctcacccacggctggctgcttcagccttgggcatcttcataaatgg

SEQ ID NO: 6039 - DNA, 477 bp, Homo sapiens
  misc_feature 455, 474: n = A,T,C or G
aagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacacctttttacctggacacctggaggccagtgggtgggccccccaacaggcccaatctggttaytcagtccagcctattcaggcagagaggcagatgggggacaattgtttgacgcgggttcnggggtgattaaggaggaanttt

SEQ ID NO: 6040 - DNA, 555 bp, Homo sapiens
  misc_feature 536, 541: n = A,T,C or G
cccaggatgaactggttgcagtggctgctgctgctgcgggggcgctgagaggacacgagctctatgcctttccggctgctcatcccgctcggcctcctgtgygcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccagggacagcgtgggactttgatattgatgtgaacgcctctgtgtttgaaacaaacattcgagtggtagggaggactcctgtcttgttcatctgcttttccaagaaggctggggtgggaagtagaggctggatgggcctgtttccggggcttttccttgagaattggctnagganggcggcccgaaaat

SEQ ID NO: 6041 - DNA, 1175 bp, Homo sapiens
  misc_feature 1055, 1113: n = A,T,C or G
agattatgagcatgtagaagatgaaacttttcctcctttcccacctccagcctctccagagagacaagatggtgaaggaactgagcctgatgaagagtcaggaaatggagcacctgttcctgtacctccaaagagaacagttaaaagaaatatacccaagctggatgctcagagattaatttcagagagaggacttccagccttaaggcatgtatttgataaggcaaaattcaaaggtaaaggtcatgaggctgaagacttgaagatgctaatcagacacatggagcactgggcacataggctattccctaaactgcagtttgaggattttattgacagagttgaatacctgggaagtaaaaaggaagttcagacctgtttaaaacgaattcgacttgatctccctattttacatgaagattttgttagcaataatgatgaagttgcggagaataatgaacatgatgtcacttctactgaattagatccctttctgacaaacttatctgaaagtgagatgtttgcttctgagttaagtagaagcctaacagaagagcaacaacaaagaattgrgrgaaatwaaccaactggccytggaaagaaggcaggcmaagctgctgagtaatagtcagaccctrggaaatgatatgttaatgaatacacccagggcacacacggttgaagaggttaatactgatgaggatcaaaaggaggagtcaaatggattaaacgaagacattctggacaatccatgtaatgatgctattgccaatactttaaatgaagaggaaacactgctggaccagtcttttaaaaatgtgcaacagcaacttgatgctacatccagaaatattactgaagctagataagtttccattaagagaaaatgtatctgttaagtcatcgtcctgcaagcttggcgttactatgtattttttcttcttggagtgaaaatccttagatagtaaaactgttatagattattgtttaaaatctgataatctggtatttatttataattatggggcttgtcactttagttaaatctatttgtnctctttagtgtttgtttttatataggtatttcttcataaaatgattaggaggtaatangcagtttctgctgctggtctgtcattgaatgccttgttttcactaagttgggaggtttggtt

SEQ ID NO: 6042 - DNA, 752 bp, Homo sapiens
gtccgaagaaaaagactgtggtggcggagatgctctctccaatggcatcaagaaacacagaacaagtttgccttctcctatgttttccagaaatgacttcagtatctggagcatcctcagaaaatgtattggaatggaactatccaagatcacgatgccagttatatttaatgagcctctgagcttcctacagcgcctaactgaatacatggagcatacttacctcatccacaaggccagttcactctctgatcctgtggaaaggatgcagtgtgtagctgcgtttgctgtatctgctgttgcttctcagtgggaacggactggaaaacctttcaacccactgctgggagagacttatgaattagtgcgagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgaacacaatgaggcatatacatggacaaatcccacctgctgtgtgcataatatcattgtgggtaaactgtggatcgaacagtatggcaatgtggaaattataaaccacaagactggggacaaatgtgtgttgaattttaagccatgtggcctttttggtaaggaattacacaaagttgaaggctacattcaagataaaagca

SEQ ID NO: 6043 - DNA, 300 bp, Homo sapiens; identical to SEQ ID NO: 1420

SEQ ID NO: 6044 - DNA, 530 bp, Homo sapiens
ggatttctcctccttccgcgctttctgcgtgacactggctgtcagctctgggctgggctttctgggggccacacagctgctgaggcggcgggttgaggcggcccgaaaggacccagggtgctcaggcctggttgtggatagcggcctgtgtggagaggagctgcttgtrggcagtgaggaggcggacagcatcaccttgggccggtatctccggcagctggcacgccatcggaacttcctgtggttcgtgagcatggacctggtgcaggtcttscastgscwctwcrmcwgyaayyycwkcmctctcttcctggagcatctgttgtccgaccatatctccctttccacgggctccatcctgttgggcctctcctatgtcgctccccatctcaacaacctctacttcctgtccctgtgccggcgctggggcgtctacgcggtggtgcgggggctcttcctgctcaagctgggacttagcctgctcatgttgttggccggcccggaccactcagcctgctgtgcctcttcat

SEQ ID NO: 6045 - DNA, 837 bp, Homo sapiens
atacactgcatttgctggtgctgtttttatatagtgaagcaacagctgtacagcaaaataataaaatactcacttcttcgttaaaaaaaaaaaaatttacttcttacaattctggaggccaggaagaccatgatcaggtgccagcatctgggaagggccttcttgctgtcctcccatggcagaagatggaagggcaagggagagctaacatgctcccgcaaaccctttttataatggcatcaatcaaatatgaggccagagtccttgtgacctaatcatctcccaraaggctccgcyyccaaccctgttgcattgggattaagtttccaacacatgaattgtggagacaacacattcaaaacatagcattccacaccttgggctccccagattcatgtcctcacatgcaaaataaattcattccatcccaatagcccctaaaaagtcttaacttgttccagcatcaactttaaagtcaaagtccaaagtctcatctaaatcagatatgagtgagactcaaggcatgattcatcatgagacaaaggatgtacatttgcaatgtttgtcatgtcagacaaaacaaaaatatgtaaatatccatcaatagggaactgctgaaaaatttttttgtataatcataaaatgaaacatgcagatgtttaaaccaatgagctagatctcaacgtgctgatatggaaagtgcttcagaatgtattaaggacataaattaagtgtacaataatgtgtgtgtgtgtatatatgtatatgcttacgtgtgtatggaaagtatctcagcagatacaataaaaacttaattgtgattaaaaaaaaaaaaaa

SEQ ID NO: 6046 - DNA, 589 bp, Homo sapiens
  misc_feature 584: n = A,T,C or G
caagaagaaacatggcggctatccttctctcacatcgaaaaggaaattttgaacaatcatggaaaatctaaaacgtgctgtgaaaacaaagaagagaaatgttgcaggaaagattgtttaaaactaatgaaataccttttarwwcrgcwsaragaaaggtttaaagacaaaaaacatctggataaattctcttcttatcatgtgaaaactgccttctttcacgtatgtacccagaaccctcaagacagtcagtgggaccgcaaagacctgggcctctgctttgataactgcgtgacatactttcttcagtgcctcaggacagaaaaacttgagaattattttattcctgaattcaatctattctctagcaacttaattgacaaaagaagtaaggaatttctgacaaagcaaattgaatatgaaagaaacaatgagtttccagtttttgatgaattttgagattgtattttttagaaagatctaagaactagagtcaccctaaatcctgggagawtacaagawaaatttggaaaaggggccagacgctgtggcttcacacctgtagttcccagcttcttttgggngggcc

SEQ ID NO: 6047 - DNA, 551 bp, Homo sapiens
gcatttggcccattggccgcattctgctgacccatcaccttggtgctttttctgctttttctcygtygtmctctgtgtgtgttcctttgtcctgatccttgtcaccttgtgggtccaaaatggttccactagcctcatggagcctggccttacattgcagagtccaaagcaggagctgagggaaaatgaaaaacaacttcttcatcaccggaagcccagcaaacttctccttaaaaatcactggtcagggctgggtgcagtggctcacacttgtaatgccagcactttgggaggctgagatgggcagatcacctgaggtgaggagttcgagaccagcctggccaacatggtgaaacctcatctctacaaaaatgcaaaaattagccgggcctggtggcgtgtgcctgtaatcccagctactcaggaggctgaggcaggagaatttcatgaacctgggaggcggaggttgcagtgagccaagactgtgccactgccttccagcctgggtgacagaatgmgactctatctttaraaacacaaaacaagtcgac

SEQ ID NO: 6048 - DNA, 345 bp, Homo sapiens
gtccagaaatactctgatactagctatggtcagcaacatttaatgaaaacscttatgttaaaaataaacccctgcctcctggcttcaagcgattctcctgcctcagcctcctgagtagctgggagtataggcacgtaccaccacacccagctaattttttgtatttttactagagatgggtttcacagtgttagccaggatggtttcgatctcctgacctcatgatccgmccgcctmggcctcccaragtgctgagattacaggcgtgagtcactgtgcccggcctcaaaatsttargaaaaggttcttttgggtgcatggagttttacatgggaataaattagt

SEQ ID NO: 6049 - DNA, 458 bp, Homo sapiens
ggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtkcagatcactgtgtccactactatgatcttcgtaacactaaacagccawtcatggtattcaaaggacaccgtwaagcagtctcttatgcaaagtttttgagtggtt

SEQ ID NO: 6050 - DNA, 548 bp, Homo sapiens
  misc_feature 540, 545: n = A,T,C or G
atggtgttttcacctggaagctgagaagaaaggggctttaatggaacaaatagcacatcaagctgttgtaatgcagtttattatggaaatggccaaaaactgtaatgtggatccaagagggtgttttcgtttatttttccagaaagccaaagcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacagaatccagattatcttcagtattctatcagtacagctctctgcagcttaaactcggtggtacataaagaagatgatgaacccaaaatgatgggacactgtataatttgggttaagactgctgaggccaagtgctattttgttacaggaaagggaggaacttgggctattttcttggacacttttatgggggtgctggcactttattttttgttccggtttttgtnggggnggg

SEQ ID NO: 6051 - DNA, 934 bp, Homo sapiens
  misc_feature 332: n = A,T,C or G
aaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagtgrntcgtgtgggcagcagatcgccaggcggcattgacaaaactgaggtacagccttcgtcagtacaatattgttggactgcmcaccaacattgacttcttactcaacctgtctggccacccagagtttgaagctkggaacgtgcacactgatttcatccctcaacaccacaaacagttgttgctcagtcggaaggctgcagcaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacagttttcgtctcctcggataatcaaccatttccatactcatgtaatctaggcatactctggagttattacaggtttggttccagaccactacaataaaatgtagccatagctgtaacgtataaccatgatgggtcttatagcatgcagattgaagaaaactttccaagtccttgggtaatctttacagccgagggagactgcacttacctgaaatgttccgttaatgggagttgc

SEQ ID NO: 6052 - DNA, 934 bp, Homo sapiens
gttagctcgaggggcaaataaagagcacaggaatkwwtctgattacacacctctaagtctggctgcttctggtggctatgtgaacatcatcaaaatattactaaatgcaggagctgagattaactctagaactggtagcaaattgggcatctctcctctgatgttagcagctatgaatgggcatacagctgctgttaagctcctgttagacatgggctctgacataaatgctcagatagaaaccaatcggaacactgcccttactttagcctgcttccaaggaagaactkaagtggttagtcttctgcttgatagaaaagcaaatgttgaacacagagctaagactggtctcacaccaytaatggaggctgcctctggtggatatgcggaggtggccgagttcttttggataaagatgctgatgttaatgccctccagttcctcctcaagagatacagctttaaccatagcagcagataagkgcattacaaattctgtgagcttcttattggcaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaagggtcatgtgaaggtggtgcgctacttagtcaaagaagtcaatcagtttccatcagattctgaatgtatgagatacatagcaaccatcactgataaggagatgctgaagaagtgtcatctttgtatggagtcaatagtacaagccaaagatagacaggctgctgaagcaaacaaaaacgccagcattttgttagaggagttagacttggaaaagttaagggaagaaagtcggaggctggctttggctgcgaaaagag

SEQ ID NO: 6053 - DNA, 300 bp, Homo sapiens; identical to SEQ ID NO: 2244

SEQ ID NO: 6054 - DNA, 711 bp, Homo sapiens
ccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctgggcaacaaagcttgatgttttcactgctttagtttcctgtttgctggtgggaggggatacggtctgtgactctggacttgctctgggggaacagttgtcactgcccccggggagaggggcagcttgggctggagaagcacagccagagacagagcccctcgagagggatccttggctgcttcattgtcttccccccagcaagccctgctctccacaggcacctctggggtcttggtatggtccccgctcacctccttccagagtcctgagtggtgtgggtgtgggtggcacaggatctggggcatgggaggggttcagagcttcccagagccccgtgtcctggcagactcagctggtgggctggggtgttaaccccagtcctggcgtaggtttacagactctcaaggtacgttggccctggtctcctgggagagaggggtgagggatgtcccctaccaaagcacaaggtgggatcaggctgcctcctgggttgggtgtcgggggagctgtccggcagcctggcagggagatgcaagggctaaagtaaaattttgtcaagt

SEQ ID NO: 6055 - DNA, 839 bp, Homo sapiens
tcaaggcctacgaacaggtgatgcactaccccggctacggttcccccatgcctggcagcttggccatgggcccggtcacgaacaaaacgggcctggacgcctcgcccctggccgcagataccttcctactaccagggggtgtactcccggccccatttatgaactcctcttaagaagacgacggcttcaggcccggctaactctggcaccccggatcgaggayaagtgagagagcaagtgggggtcgagactttggggagacggtgttgcagagacgcaagggagaagaaatccataacacccccaccccaacacccccaagacagcagtcttccttcacccgctgcagcygttccgtcccaaacagagggccacacagataccccacgttctatataaggaggaaaacgggaaagaatataaagttaaaaaaaagcctccggtttccactactgtgtagactcctgcttcttcaagcacctgcagattctgatttttttgttgttgttgttctcctccattgctgttgttgcagggaagtcttacttaaaaaaaaaaaaaaattttgtgagtgactcggtgtaaaaccatgtagttttaacagaaccagagggttgtactattgtttaaaaacaggaaaaaaaataatgtaagggtctgttgtaaatgaccaagaaaaagaaaaaaaaagcattcccaatcttgacacggtgaaatccaggtctcgggtccgattaatttatggtttctgcgtgctttatttatggcttataaatgtgtattctggctgcaagggccagagttccacaaatctatattaaagtgttatacccggtttt

SEQ ID NO: 6056 - DNA, 603 bp, Homo sapiens
  misc_feature 327, 330, 333, 337, 352, 363, 373, 386, 535, 570, 578: n = A,T,C or G
agaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtggtgaattttttcagtgtaacaacattatctgaccaatagtacacacacagacacaaagtttaactggtacttgaaacatacagtatatgttaacgaaataaccaagactcgaaatgagattattttggtacacctttctttttagtgtcttatcagtgggctgattcattttctacnttnaancagngggttttctgaccangaatatggctnggattttttngaaagtacaaaangccacatagtttttccagaaaggtttcaaaactcccaaagattaacttccaacttataagtttgtttttattttcaatctatgacttgactgggtattaaagccgctatttggatagtaattaaatatggtggtcattgatataaaccngtttggggtcagcaaaccaacctaaatggatggcnaagaccgngggtttaattttcccggtgggggtg

SEQ ID NO: 6057 - DNA, 300 bp, Homo sapiens
ccaaggcgcagcccgattctgccccctacgattggttcggggacttctcctccttccgtgccctcctagagccggagctgcggcccgaggaccgtatccttgtgctakgttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccattgatgtgcggaagctggacttccccagtgcttcttttgatgtggtgctcgaga

SEQ ID NO: 6058 - DNA, 492 bp, Homo sapiens
  misc_feature 323, 419: n = A,T,C or G
gagaagctgaccttggacctgacggtgctcctgggtgtgctgcaggggcaacagcagagcctacagcagggggcacactccaccggctccagccgcctgcacgacctctactggcaggccatgaaaaccctgggagtccagcgccccaagttggagaagaaggatgccaaggagatccccagtgccacccagagccccatcagtaagaagcggaagaaaaagggattcttgccagagacgaagaagcgcaagaaacgcaagtcagaggatggcacgccagcggaggatggcacacctgcagccaccggcgggagccagccccncagcatgggcaggaagaagaggaacaggacaaaggctaaggtcccagcccaggcaaacgggacgccaaccaccaagagtccagcccctggcgcccncacccggagccccagcacccctgccaaatccccaaaactgcagaagaaaaaccagaagccgtcccaggtgaat

SEQ ID NO: 6059 - DNA, 1011 bp, Homo sapiens
gcaaggcgccgggggacacgttggctgcgttttcggcggactggccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacagagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctggttgcagagtagttttttgttttttccaggaggctatgtctctaattcactttagagataataagaaattgttctggtagatatatcctgtgacagaagatactttaggtggaactatgtagccagattcccatccatgaaaggcaagtgtagattgtcccttatttccttcatacatgattggatttaattttggggggcttatacaaggtctagtttttttttacagttatgacaaacccctcag

SEQ ID NO: 6060 - DNA, 300 bp, Homo sapiens; identical to SEQ ID NO: 2332

SEQ ID NO: 6061 - DNA, 1544 bp, Homo sapiens
  misc_feature 318, 579: n = A,T,C or G
cgggactggtaccaccgcatcgaccccaccgtgctgctgggcgcgctgcgcgttgcggagcttgacgcgccagctggtacaggacgagaacgtgcgcggggtgatcaccatgaacgaggagtacgagacgaggttcctgtgcaactcttcacaggagtggaagagactaggagtcgagcagckgcrscgwsrgcacagtagacatgactgggatccccaccttggacaacctccagaagggagtccaatttgctctcaagtaccagtcgctgggccagtgtgtttacgtgcattgtaaggctgggcgctccaggagtnccactatggtggcagcatacctgattcaggtgcacaaatggagtccagaggaggctgtaagagccatcgccaagatccggtcatacatccacatcaggcctggccagctggatgttcttaaagagttccacaagcagattactgcacgggcaacaaaggatgggacttttgtcatttcaaagacatgatgtatggggattagaaagaactcaagacactcctgcttgatacagaacaaaaagagcttaacaggaccaacanggcttaagcccagacttgacgtaacagaaatgtgccaataggtaataggtaatttttctttctctgacttgttttgttttcttgaaataacactgttgtgtggctagaaaggaaaagatttagtgtggcttgtattcaygggatacaggacagggatggggctatcatcttttcttgaatagggctaaagaagtattttaacaaaaatctattatgtacctaatattgtgcctaataatatttagcaccacaactcaaaaaacatttagcacttgaaaaaaggagactcacctctggctctttgccactgtcagaatctgaatctcactggccctgtggagtagggatcctatctggagaagtgggagcatgggctgcagtcaggactgctgcagactgagccatgtgatggtacgtaatgagttcccctgagggaatgaaacacccccctcaccccttcaaagtcacccctttggaattcaacacagacacacatatcccttcaaaaacttttatttgtatcaacagttcctagctcttgacttagcttagagcttttaaaagagcagacaccttatatatttgagattgaaaaagtttctgctattaatcagaaataatcatttctattttctggcttaccccttggaataagccaaaaataaaaccaaagttacatttcctgacagatggctaagaaaacaatagaaggaacatcctgaattctagagttgactcttgctggtgaagtacaccttcaggcttaggtccattctcctaagtaaagcctgaaggaaaactcttaacacctaattctttgtgggaaaaatgatcaactaggccatttcacaggctwtagaacmaaagtacmattgggcatctttccytatgtcckgggatcaggggwgcttacatttaacattgatcaggtaaagaggagaggctgtgctaaggtctgagaaaag

SEQ ID NO: 6062 - DNA, 948 bp, Homo sapiens
ggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaagaggcttatgtgcacaagagtgtaatggaagaactgaagagaattattgatgacagtgaaattacaaaagaagatgatgctttgtggcctccccctgatagggttggccgacaggagcttgaaattgtaattggagatgagcacatatcttttaccacatcaaaaataggttctcttattgatgtaaatcagtcaaaggatcctgaaggccttcgagtattttactatttggtacaagacttgaaatgtttagttttcagtcttattggattacacttcaagattaaaccaatttaaattgtatgttttcaggctgtttgtatatttaattaagggatgggaggggttatttgtcatttacagtattggggtttttatgaatgtgaagcaaacaaaaaaaatttgtatgtaaactgaaaataagaaaatacattagcaagcttaatggttatccttacttgagtccacatgggttggacagtccccacacacattaaattctgtaaatgaaagccaccttttgttaaaaatttgctctaataaaacataccaaatcctggttgcagagtagttttttgttttttccaggaggctatgtctctaattcactttagagataataagaaattgttctggtagatatatcctgtgacagaagatactttaggtggaactatgtagccagattcccatccatgaaaggcaagtgtagattgtcccttatttccttcatacatgattggatttaattttggggggcttatacaaggtctagtttttttttacagttatgacaaacccctcag

SEQ ID NO: 6063 - DNA, 300 bp, Homo sapiens; identical to SEQ ID NO: 2373

SEQ ID NO: 6064 - DNA, 1043 bp, Homo sapiens
  misc_feature 983, 1030: n = A,T,C or G
taaaaaaccaccttttgttcgaaactccctggagcgacgcagcgtccggatgaagcggccgtccccacccccacatccttcctcggtcaagtcgctgcgctccgagcgtctgatccgtacctcgctggacctggagttagascwssaggcgacaagaacctggcacagccaattgacccaggagatctcggtgctgaakgagctcaaggagcagctggaacaagccaagagccacggggagaaggagctgccacagtggttgcgtgaggackagcgtttccgcctgctgctgaggatgctggagaagcggcagatggaccgagcggacacaagggtgagcttcagacagacaagatgatgagggcagctgccaaggatgtgcacaggctccgaggccagagctgtaaggaacccccagaagttcagtctttcagggagaagatggcatttttcacccggcctcggatgaatatcccagctctctctgcagatgacgtctaatcgccagaaaagtatttcctttkttccaytgaccaggctgtgaacattgactgtggctaaagttatttatgtggtgttatatgaaggtactgagtcacaagtcctctagtgctcttgttggtttgaagatgaaccgactttttagtttgggtcctactgttgttattaaaaacagaacaaaaacaaaacacacacacacacaaaaacagaaacaaaaaaaaccagcattaaaataataagattgtatagtttgtatatttaggagtgtatttttgggaaagaaaatttaaatgaactaaagcagtattgagttgctgctcttcttaaaatcgtttagattttyytsgttgtacagctccaccttttagaggtcttactgcaataagaagtaatgcctgggggacggtaatcctaataggacgtcccgcacttgtcacagtacagctaatttttcctagttaacaatttgtcatattammmmntgcacagammaccattgggggggattcagaggtgcatccaccccggntcttcttgagctg

SEQ ID NO: 6065 - DNA, 796 bp, Homo sapiens
  misc_feature 763, 785, 793: n = A,T,C or G
atcgattaacacttctaatgagtcaagtcctagggttttttggttttgttttgttgccaacgaggaacacagctctgggggaatggtgtcatccwcstgcgytttaaaaataagcacatgatggctgggcaccgtggctcacgcctgtaatcccagcactttgggaggctgaggcgggtggwtcacctgaggtcgggagtttgagaccagcctggccaacatggtgaaaccccatcgctactaaaawtataaaaaattagctgggcatggtggcgcacgyctgtagttccagctactcaggaggctgaggcaggagaatcgcttgaacccgggaggtggaggttgcagtgagctgagatcgcaccattgcactcccacctgggcaacaaagagtgaaacttggtctcagaaacgaaacaaaacacaaaaacctttctcagtcccagcatatgtggagcagcctcattcttcatagctgtgtgtcattccgttgcgtgatggggtcacagagcacagacctggtgcccttttcctttttaatatgtggaaacccctccatgctttccaaagcctacaagtacagcagccccaagtttagggtgagcagcagtggtcagagctctttactattacttttgggcaaacgcaagccaggctggcaaccaccactgccgccgaggggagatacaagcaggccagtttcacactytgggacktttagtttctttcttacatctagaaggtgggcctctkgttattccantttaaaggcagcccaagggaantgttcagnaaa

SEQ ID NO: 6066 - DNA, 328 bp, Homo sapiens
ataaggcagtctctcaaaagtcatactgccagagtctctagggcaaggagaaacaactagctggacaatactcaattcacaacttagcattttgccatctgaagcttggcaaactagtatctgctgtaaaacaacctatatggtatgtgaaccgtagtattcctgagcaaaacgtggctttcatcgctttgtaaaaatttgcatctgtttagaaactagcctataaaatatcaccattggatgtagatatggagagaaaagaaatatgttgggtttattgcttagcgaaatattctctttttatttaaataaaatgttcttcattgtg

SEQ ID NO: 6067 - DNA, 302 bp, Homo sapiens
ggaagagctcgtcttggagtccaagcttttgccacttcaattgcaccagctccaggaaccatacaaccatcttcaatkgcatttttgatagcacgaagtccatctcttatggcatccttgacttgtgtgagagtcatgctttatttggtcctttaaccaacaaggtaacagagcaagggttaacacactcctcaataaaagtgaacttttcttcacctaatgtatactcatacacaagaccagcatgtcccaagcaatctacagtgagatcttcaaaagaattcacggccattccaccacaa

SEQ ID NO: 6068 - DNA, 551 bp, Homo sapiens
gcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccastgcattctccccctgacacagagaaggggccttggtatttatatttaagaaatgaagataatattaataatgatggaaggaagactgggttgcagggactgtggtctctccyggggcccgggacccgcctggtctttcagccatgctgatgaccacaccccgtccaggccagacaccaccccccaccccactgtcgtggtggccccagatctctgtaattttatgtagagtttgagctgaagccccgtatatttaatttattttgttaaacatgaaagtgcatcctttccctccaaaa

SEQ ID NO: 6069 - DNA, 555 bp, Homo sapiens
gctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtgacctgtccaggaaggatkagwcscwgtrmtgtssactctttsmkcasctcmkwsswwkwwkmtrtgmccgcgggasctgsacarwwwsatctcttgcatgtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggactttgtagggccactggcaaacaatactcctcttgggccct

SEQ ID NO: 6070 - DNA, 498 bp, Homo sapiens
  misc_feature 375, 382: n = A,T,C or G
attcaagatgagatttgggtggggacacagccaaaccctatcggttgccaacatttacagtaacagtgttaggtgaacagttgtccagtctcctgttttgtcggacactgtttctagcaccttccaggcagaatctcatgtatccttcactttcgaawtsggwacgagkatttcatccccacttttatcaatgagaaactaaagctcgaagaggtcaagtaagttcctggccaaggtcagctagcaggctctagaggcctcgttctccttagaggcaagccttgccagggcccaggcttggcaggctgcagggcaggtgcgggcatgccatggtagaggtgggaccattgaggctcagagagggtaagtgatganccctggnacacagcggggtgggtccagagtccggcctgcatcttctggagctggccagtggacaggcctttcccgttcacaagcccggggctgctgttcccaccaaggggggaatgttgccta

SEQ ID NO: 6071 - DNA, 537 bp, Homo sapiens
ggatgggtgccctggagccaggcaaggcaggaggccccagaaacttggtgggggagataacggaggggatggagcaggaggaatcctgaaaaccggactgggagagatgkgrccsagtggasgakkyccrstaysasmkggcgtmtgagackgaaacattaattctgaagaagaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgtgccactgctcwccagcctgggtggcagarcgagaccctgtctcaaaaaaataacaaaaacaaaatgcttctgtcagttaacaatctttattagagggtttttagtctttctttctcagctgtatgttaagttggttgacaaatgcaaataaacgtctttattatcctttctttctgaaa

SEQ ID NO: 6072 - DNA, 735 bp, Homo sapiens
  misc_feature 387, 474, 479, 573, 625, 640, 648, 659, 705, 729: n = A,T,C or G
ggggcctgaggtgccagggttcacagacagggtttcccaccagccacacgcaccagctctatttgggggaagtgtagtgaggaggagcccagaggaccccaggggagtgaggagggagaacttggaagggtgcagcccacttccagactctcccctctcccacccttctaccctgtgaagggaaatgagggctttagtttcctgggcagggaggggcagcttctgaggttgccaaaggcccccactggatggaacctgttagctgctcctctccgcagccagaaatgctgccggctgcacccagaggagcagtgaggcaggacagatggacaggttcctcctgcgctgtaattccctgctccctggagactgggaaaaggccgcagnacgggggactgggcggtggtggctggtggtttaaaggttgaactttctctgaagctcctttcccctttgctcttggtccctgccccngcaangcaaacctgccccctctgcctcccagtgcacccaatgaccccccttccccttggggcggacttcctgattgaagcacaactcccccgcaagganccccaagcccacaagggttggccataatttggggcagtttccaagtcctgtnggcttcggctaatcntgggggangaagatttttngggtcttggatttcccttgggaaattgggtccttgggcttggaatnttttccctaagggggccctcttanttcctt

SEQ ID NO: 6073 - DNA, 317 bp, Homo sapiens
  misc_feature 310: n = A,T,C or G
ggctgcctggggaaggagaaatctgagccaagacctgacaaatgaataggagtaagctaaggaaagtgactggggtgagtgagttccaaatggagggaactgcatgtgcagaggcctggaggtgaggggaacctgggcacattccaggagctgaagggtttgttgtggctggaacataaagagccaaagggggccaagcagtgcttcacacctgtaatcccagcrctctgggaggcygaggtgggcagatcacctgaggtcaggagttcaagaccagcctggtcaacgtggtgaaaccctgtctctactnaaaatac

SEQ ID NO: 6074 - DNA, 300 bp, Homo sapiens; identical to SEQ ID NO: 2539

SEQ ID NO: 6075 - DNA, 300 bp, Homo sapiens; identical to SEQ ID NO: 1392

SEQ ID NO: 6076 - DNA, 300 bp, Homo sapiens
ccggcggctctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctakgttgcgggaacagtgccctgagctacgagctgttcctcggaggcttccctaatgtgaccagtgtggactact

SEQ ID NO: 6077 - DNA, 564 bp, Homo sapiens
  misc_feature 545, 550: n = A,T,C or G
gcagcagctcccaggatgaactggttgcagtggctgctgctgctgcgggggcgctgagaggacacgagctctatgcctttccggctgctcatcccgctcggcctcctgtgygcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccagggacagcgtgggactttgatattgatgtgaacgcctctgtgtttgaaacaaacattcgagtggtagggaggactcctgtcttgttcatctgcttttccaagaaggctggggtgggaagtagaggctggatgggcctgtttccggggcttttccttgagaattggctnagganggcggcccgaaaat

SEQ ID NO: 6078 - DNA, 596 bp, Homo sapiens
  misc_feature 577, 596: n = A,T,C or G
actcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaaagctgttctttcccacttagttaaaaggcaggccaaatggattcaccttcacctttggctaatgggagggcgtgggcaccntgcggcaccagtggggacn

SEQ ID NO: 6079 - DNA, 732 bp, Homo sapiens
  misc_feature 691, 704, 730: n = A,T,C or G
gcttcgtgtgctactgcgaaggggaggaaagcggggagggggaccgcggcggcttcaacctctacgtgaccgacgccgcggagctttggagcacctgcttcacgccggacagcctggcggccctcgtgggtaactgggcgggtctgggagccgccacacccctccttgcagtgcagatcgtctatggggcgacagacatctgggattccccagaaggctctgacaccctctgcccgccctgtagctgtagtcctcccattggctagggctcttggggtcgggcaggtttcgggtgcccccagtggcctcgggttccaggcagctcgtgacaagcccctgtgctctctagaaagcccgttttggcctgagtgcggctgaggacatcaccccccggttcagggcagcctgtgagcagcaagctgtggctctgactctgcaggaggacagagcatccctgacgctttcaggggggccctcggactggcctttgacctctccaaggtaccaggcccagaggcagcccccaggctgtgggcgctgacactgggcctggcaaaacgcgtgtggagcctggagcgkcgactkgcagctgcagaagagacagctgtcagcccgaggaagagcccccggcctgcagggcttcagctcttcttaccagacccagatccccagagaggttgccctggacctnggagtcaggatgncggtttccaggagaattcgttcatcnaa

SEQ ID NO: 6080 - DNA, 816 bp, Homo sapiens
  misc_feature 210, 214: n = A,T,C or G
ctgaaacagggtcgggatgccgatgccggcttggagttagagrkkmgwcaccgctgagagcagctgcagtagctgagyagtggcagcagagaggcagacgtgagctgagggcgcagaggcaggcagcatctctgagggtccccaaggagcatggctgggagccgtgaggtggtggccatggactgcgagatggtggggctggggcccacngggnagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagagatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctcctgcgggtgctgagtgagcgcctcctgcacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatagtaaagtggctctatattttctctacgccaaa

SEQ ID NO: 6081 - DNA, 817 bp, Homo sapiens
  misc_feature 801, 814: n = A,T,C or G
agacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgyttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattktgggatttgcattcaaaaaggacactggtgatacaagagaatcttctagtatatatattagcaaatatttgatggatgaaggtgcacatctacatatatatgatccaaaagtacctaggggaacaaatagttgtgggatctttctcatccagggtgtttcagagggatgaccaagtgtccccggcttcgtgaccatttccaaggatccatatggaaggcatgtgatgggtgccccatgctgttgtttattttgcactgagtggggacatgttttaaggggatttgggattattggaccgcattccattaaaaaaatggcttaagnccagccctttatnctt

SEQ ID NO: 6082 - DNA, 337 bp, Homo sapiens
  misc_feature 233, 263: n = A,T,C or G
gtgcaccggagggtgaagacagccctcgcgakgamkgwggaggcctggkgagcaggcctgaccctgtgryrswrcwksaggctgcggtgaagcgggccgaccacctggaggagctgctggagcarmmcaggaggcccacgmcaagtaccaagtgaccagggatgccgggaacactgtcgaagaacggaaggcagaggacagaggctggacgttggcccagagcagagagacgnccacctgccccccacagaggctggtggttnagatgcccacggttaagcacctgtggcttgcatttttaaacagttaaaaggaggccgttgttttcagcgccttt

SEQ ID NO: 6083 - DNA, 570 bp, Homo sapiens
  misc_feature 463, 526, 537: n = A,T,C or G
gacttctgaagaacatgaagcaagcagaagggtgaaagcggagctgctggttcagatggatggtgttggaggtacttctgaaaatgatgacccttccaaaatggttatggttctggcagctactaattttccctgggatatagatgaggctttaagacgacgccttgagaaacgaatctatattcctttgccgtcagcaaaaggcagggaggagctattacgaataagtctacgtgagttggaattggctgatgatgttgaccttgcaagtatagcagaaaacatggaaggttattcaggtgcggacattaccaacgtgtgcagggatgcgtccttgatggcaatgagaaggcgcattgaaggtttgactccagaggaaatccgaaatctttccaaagaagaaatgcacatgcctacaactatgggaggatttcgagatggctttaaaaaaggtttctaagtncagtgttcttgctggcagacatttgaaaggttacggggaatgggtattttgagtttgggtccntgctaaatttntcacctgtaaactgttgaggaatgtgccttaag

SEQ ID NO: 6084 - DNA, 907 bp, Homo sapiens
agccaatgtgcttgcaagtgtacagatctgtgtagaggaatgtgtgtatatttacctcttcgtttgctcaaacatgagtgggtatttttttgtttggtttttttgttgttgttgtttttgaggcgcgtctcaccctgttgcccaggctggagtgcaatggcgcgttctctgctcactacagcacccgcttcccaggttgaagtgattctcttgcctcagcctcccgagtagctgggattacaggtgcccaccaccgcgcccagctaattttttaatttttagtrgagacagggttttaccatgttgsccaggctggycttgaactcctgaccctcaagtgatctgcccaccttggcctccctaagtgctgggattatagscgtgagccaccatgctcagccattaaggtattttgttaagaactttaagtttagggtaagaagaatgaaaatgatccagaaaaatgcaagcaagtccacatggagatttggaggacactggttaaagaatttatttctttgtatagtatactatgttcatggtgcagatactacaacattgtggcattttagactcgttgagtttcttgggcactcccaagggcgttggggtcataaggagactataactctacagattgtgaatatatttattttcaagttgcattctttgtctttttaagcaatcagatttcaagagagctcaagctttcagaagtcaatgtgaaaattccttcctaggctgtcccacagtctttgctgcccttagatgaagccacttgtttcaagatgactactttggggttgggttttcatctaaacacatttttccagtcttattagataaattagtccatatggttggttaatcaagagccttctgggtttggtttggtggcattaaatgg

SEQ ID NO: 6085 - DNA, 1184 bp, Homo sapiens
  misc_feature 350, 743, 1169: n = A,T,C or G
gcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatstmtcrcctttggagtacatgatgaagtgctacccagagataaaggagaaggaagaaatgaggaagatcattgggcgatacggtctnactgggaaacaacaggtgagcccaatccggaacttgtcagacgggcagaagtgccgagtgtgtctggcctggctggctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctgggagacatcctggcttacaaggagcacctcaagtccaagctggtggattgaggagccccagctcaccaagagkacccacaacgtgtgagccytytacctgggttcgggtcaggagctccatcntgggaactaacagctgctaacctgaccagccgctcaggacaggaccctggggctacactcctgcattgctgcaatactgctcccccagcctctcccctgcccctcaacctgccttagctgcactctcttacctacagctggacagtacctgtctgtttcctgtcctccttccagttacatctgtccatgtctggactcggctggccgttccctccagccccttgctgttatcttacatctgagtgtgatgcagtcagaggcacctgcgggttagcccaggggggcccaactgatttggcctgcggaggagcttaggatcctcgttttctgggttttggtgatgttggaggagtaccccccagcccaccgccccgattcctttttgcttctggtttggagctccggaccaggaccttcgtcctggtnagtttttaaataatt

SEQ ID NO: 6086 - DNA, 383 bp, Homo sapiens
  misc_feature 362: n = A,T,C or G
gtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcmsgccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggncaccttaccaggggactttta

SEQ ID NO: 6087 - DNA, 1278 bp, Homo sapiens
cacctgtgcttgcagccaggtcaggcccagctgcagcccaggcaggagcagtcgcctttcccacccacagcgctggccacagggctccctgcagggtcagggaccagaccacgcccagaggaggggaggcactggcccccgccacaggactggagacgcaagaacaaaaagaaccaagtagagagagtggagctgctttattgcccttggagcccgcgctctcggaggctgtcttctgtcgccaagggtcccggaccgagtacacagtggcagctggcttagttggtggacggcytggsscactcgacgttgaggatgaggtggtcgtagccaaagccggacaccccggcaatggcacgcgcagsatcctcgcggcggtggaagctgatgaaggcraagcccttggattggccagtggtcttgtccttagccaggtagatgcgggagatggagccgaaaggcsggaagagctcctgcaggtcggtctcacgcgtgtcctctgacaagttggtgacacggatggtggcgttgtcgtcggctctgcggttgggctgcatggactccccgcggcggctggccccgtcgcgmaggctcggcggmacatacttccctgtcttgttctgcgtggcctgcacgggctctagctctcccggcagcttctccttctcgccagtaracaggcccagctgctcggccagctccttctgcatgggccccagcgtatccttgtaggggcagcgggtggtccagtggtcgcccttgcagatgcggcaggacacgatcttctggcccttgagtttgttcatagggtcctcctcctcctggcagttcaggtcctctttgctggtgatgaacgtcatagagacatcgtcactgacagtggtggtggccacattgggtccgggggggtcaaactctgagttcccgaacttcttccagttcttcctccttgcgacagcctttgaagccttccgggtctcaatcctgaaggtgcggacaatcttgaacttcttgccatcctcattttctatcttgtactctgtcactgtctttatgtttccgttgatgacctccttgggaggcggcagtggagctcccggcagtagctctggctctgggctggtgtcacctgtggccagagggatccccttgaggagctcgctggtgacacatttgtcgtcctccccctcctcctccacctggtcggcccaactgggcttcgaatyaaagtctccagtaggcatcgcaaaaagtattctccacgcagcccaagcccgg

SEQ ID NO: 6088 - DNA, 300 bp, Homo sapiens; identical to SEQ ID NO: 2765

SEQ ID NO: 6089 - DNA, 496 bp, Homo sapiens
attctctctccataccaccccccaaaaattttcgccgctccaacacttcaacactattttgktttatttgtcttattaatatmagaaggcaggaatgtcaggcctctgagcccaggccaggccatcgcatcccctgtgacttgcacgtatacatccagatggcctgaagtaactgaagatccacaaaagaagtaaaaacagccttaactgatgacattccamcattgtgatttgttcctgccccaccctaactgatmaatgtactttgtaatctcccccacccttaagaaggtyctttgtaattctccccacccttgagagtgtactttgtgagatccacacctgcccaccagagaacaaaccccytttgactgtaattttccattaccttccctaatcctataaaacggccccaccccatctccctttgctgactctcttttcggactcagcccgcctgcacccaggtgaaataaacagccttgttgctcacaca

SEQ ID NO: 6090 - DNA, 300 bp, Homo sapiens; identical to SEQ ID NO: 2786

SEQ ID NO: 6091 - DNA, 300 bp, Homo sapiens; identical to SEQ ID NO: 2802

SEQ ID NO: 6092 - DNA, 507 bp, Homo sapiens
agggggcgggcccgtacgccgattccatatgggcgccggcgcggagcgccgcggggcagcgcggggtcgccatggctgagctgcagcagctccgggtgcaggaggcggtggagtccatggtgaagagtctggaaagagmgrwcmtsckkmwswyrcrgaggtctcatgttccggtgcagcgccagctgttgtgaggacagccaggcctccatgaagcaggtgcaccagtgcatcgagcgctgccatgykcctctggctcaagcccaggctttggtcaccagtgagctggagaagttccaggaccgcctggcccggtgcaccatgcattgcaacgacaaagccaaagattcaatagatgctgggcgtaaggagcttcaggtgaagcagcagctggacagttgtgtgaccaagtgtgtggatgaccacatgcacctcatcccaactatgaccaagaagatgaaggaggctctcttatcaattggaaaataaaagtatcttccagtggcc

SEQ ID NO: 6093 - DNA, 1718 bp, Homo sapiens
cacaggctttggttcagaatataggtcagccaacccaggggtctcctcagcctgtaggtcagcaggctaacaatagcccaccagtggctcaggcatcagtagggcaacagacacagccattgcctccacctccaccacagcctgcccagctttcagtccagcaacaggcagctcagccaacccgctgggtagcacctcggaaccgtggcagtgggttcggtcataatggggtggatggtaatggagtaggacagtctcaggctggttctggatctactccttcagaaccccacccagtgttggagaagcttcggtccattaataactataaccccaaagattttgactggaatctgaaacatggccgggttttcatcattaagagctactctgaggacgatattcaccgttccattaagtataatatttggtgcagcacagagcatggtaacaagagactggatgctgcttatcgttccatgaacgggaaaggccccgtttacttacttttcagtgtcaacggcagtggacacttctgtggcgtggcagaaatgaaatctgctgtggactacaacacatgtgcaggtgtgtggtcccaggacaaatggaagggtcgttttgatgtcaggtggatttttgtgaaggacgttcccaatagccaactgcgacacattcgcctagagaacaacgagaataaaccagtgaccaactctagggacactcaggaagtgcctctggaaaaggctaagcaggtgttgaaaattatagccagctacaagcacaccacttccatttttgatgacttctcacactatgagaaacgccaagaggaagaagaaagtgttaaaaaggaacgtcaaggtcgtgggaaataaaaggcagttctacacagactgcagcaacggttgcatctgcatatcctaagaggaaaaaatgaccttcaagagaattaggacttttttcttaatttcactgacttcagagacgattgcagacttgcagtttaagtattggaatttcacaaaaaaagacataggacttaactggaaaatgaaaaaaaaaagaaaaagraaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatcaaaaaaaaaaagtcgacc

SEQ ID NO: 6094 - DNA, 426 bp, Homo sapiens
  misc_feature 416: n = A,T,C or G
cccgacggtgtgtgggcacacgggacctgtcctggacatcgactggtgtcctcacaacgacgaagymrtagccagcggctcgtgaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagancgggagaagg

SEQ ID NO: 6095 - DNA, 538 bp, Homo sapiens
  misc_feature 336, 485: n = A,T,C or G
caccagtggctttagggcctgtcgcttacgcgatgcgggtagtattgttcccgttgcgcagttgaggacacctaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggmawttggatcagaagtcgcagctctggtgggaggaaggcgagtcctcatgtgtgtccctgtgccactttgccttgnccctttgctgtccatcctttttcagggcgtggactccctggtgctagaaagcgtgatgttcgccatacttgcggacgggtccgctggggccccagcttgtacggagtctttcccagaaggcccggcttggaacagtacatcccaagtcnggccatttgaaaacttcaaagaagcttcgagaagccagtgttgtcagcagcca

SEQ ID NO: 6096 - DNA, 1603 bp, Homo sapiens
  misc_feature 1570: n = A,T,C or G
gctcttctctgtgccctttatccgcacttcccagctcacagcactgacaaccggtatcatctccaggctctccggcacctctatgtgctggccgcggagcccaggcttctagtgmytskgsaygayggacacaaacacgccctgctatgccctcttagaagttacctacaagggcactcagtggtatgaacaaaccawagaagaattgatggctcctacccttcttccagaactccatcttttaaagcacgattaaagtaaaaggcccaagatactgggaactgctcatagatttaagcaaaggaacacaacacttgaagtccatcctttccaaggatggggttttatatgttaaactccgggcgggtcagctctcctacaaagaagatccaatgggatggcaaagtttgttggctcagactgttgctaacaggaactctgaagcccgggctttcaagcagaaacaatctcagcattcacttctgatccagcacttctgtcatttgctgaatatttctgcaagccaactgtgaacatgggtcagaaacaggaaattctggatctcttttcttcagtactctatgaatgtgttacccaggagaccccagagatgttgcctgcatacatagcaatggatcaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaagtcgggggtgatatgtgtgtgcacgcctacctcagcgggcagcccttggaggaatcacagctgagcatgctggcctgcttcctcgtctaccactctgtgccagctccacagcacctgccacctataggactagaagggagcacaagctttgctgaactgctcttcaaatttaagcagctaaaaatggggccagtgcgagctttgctgagattggctcctttgcttcttggaaatccacagccaatggtgatgtgaccgtgtctggcggtgaacctaccctgaaacgtgacttctgcacaacaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaactcttgatgattgctttagttttggacttagagaatagagcaggggttgctggagtgaatattgatttttaaagtctttgaactgtggtgggtataggtgaagtgactatgcccaaaaatgccaagttttaaaagaagctatgtcataaagttttactttctgtgggcaaaagagcgctttagccatttcctcagatgtcacagttgtccccgtctaaaataagtttgtacttctgggtgaccatgnccagacactcttatggaggtgatcccccttaac

SEQ ID NO: 6097 - DNA, 264 bp, Homo sapiens
  misc_feature 119, 124, 128, 133, 137, 145, 146, 147, 150, 152, 154, 156,168, 170, 172, 177, 180, 184, 187, 193, 194, 196, 197, 198,202, 209, 211, 212, 214, 215, 220, 222, 223, 225, 227, 230,231, 234, 236, 239, 240, 245, 246, 247, 248, 253, 254: n = A,T,C or G
  misc_feature 257, 258, 260, 262: n = A,T,C or G
gttcatccataatgtagcatgtatcagaagttcatttctttttatggctgaacaagattccattgtgtgattagattgcattttctttatccgtctgttgatggacgtttggggttgtnccacncttntgccngagntcgaaacnnnctnanananctatgctgtggncncntgccnatntctncanctcaanngnnncagnctgtacncnntnntgaananncngncanncancnacnngctannnntatannacnntncntc

SEQ ID NO: 6098 - DNA, 266 bp, Homo sapiens
  misc_feature 127, 142, 147, 148, 151, 154, 155, 161, 170, 179, 191, 196,197, 199, 205, 210, 217, 218, 222, 224, 227, 228, 231, 234,243, 244, 251, 253, 255, 256, 261, 262, 264: n = A,T,C or G
gtctcgctctgtcgcccaggttggagtgcagtggcgcaatctcggctcactgcaagctccgcctcccgggttcacgccattctcctgcctcagcctcctgagtagctgggactacaggcccctgccnatctaattctttggntaaannttntcnntcttgnatctccatngccatgatnttataaatttgntttcnnanttattnccttntttttcnngganantannggnttngctttttanntgattcngntnnttcannanag

SEQ ID NO: 6099 - DNA, 300 bp, Homo sapiens
  misc_feature 175, 176, 178, 195, 197, 199, 212, 214, 217, 218, 222, 223,225, 231, 250, 257, 260, 262, 265, 267, 269, 271, 274, 276,279, 282, 285, 287, 292: n = A,T,C or G
ctaatcataggcacaacatctcagactacatcggatttcagataaggttagtactgatgctaaggtctaattttttaacttttattaatgaataccttttttaaaataggtttttgtgtcattatggttatttgcctagtttgatactcaaaacatgactcttagtctaacttanngntgtttaaacctgagtancncncagaccccttttnanggnnaacnnanttctcntggatcccagctgttgtcnttttgtnggncnctntntntnatngnctngtntantncaacntctgctcg

SEQ ID NO: 6100 - DNA, 288 bp, Homo sapiens
  misc_feature 179, 180, 185, 205, 208, 217, 220, 222, 225, 226, 231, 249,251, 257, 263, 264, 277, 280: n = A,T,C or G
gcttgatttgtggcttgaagtttgaaaggaagtgcctgtttgttcagggaacaccaattggactaacagctgacctctgtattaaggccatctttagcttgtcttgcatatactttccttgttcactaatcccttctccccaccctgcttcctttagacccatgttaatctattacctnngagcngctctagattctagagttgncantgactaatntcncngannctctnattctgttgagcttaatngnctctcnaatttnntactgatgttccnttnttagactt

SEQ ID NO: 6101 - DNA, 292 bp, Homo sapiens
  misc_feature 87, 89, 90, 92, 94, 97, 106, 107, 111, 119, 121, 147, 151,158, 168, 173, 180, 195, 196, 222, 229, 231, 236, 244, 245,246, 248, 256, 258, 259, 261, 266, 272, 282, 285: n = A,T,C or G
atctccttctccgggaattcaagtaaggcatgtctacaccccctctacgacaaagcatttctcacccataagacagtcaacgacttnanncnangancacagaggnnatgnggtcggcncncagagtgcatgttggcgcgtgcgtgntagnatctcgnaggtgttgcngccangagttanccagagtcaatgccnnacacatagtatgagaagagcactttntaagagntnaattnatttgagnnnangtattttngnntntgtanttggcncgcttttttnaangctataa

SEQ ID NO: 6102 - DNA, 287 bp, Homo sapiens
  misc_feature 130, 131, 132, 135, 136, 137, 139, 143, 148, 149, 151, 153,154, 161, 164, 169, 171, 176, 183, 185, 187, 188, 191, 193,196, 202, 213, 219, 222, 225, 232, 233, 236, 246, 255, 256,267, 270, 274, 276, 277: n = A,T,C or G
cagcaactcaggaggctgaggaaggagaatcacttgaacccgggaggtggaggttgcagtgagccgagatcgccccactgtactccagcctgggtgacagagcaagactctgtctcaaaaaaaaaaaaannnccnnngnaaanttttnngnannggataanttnggttncngggtnggaaatnantnntancnggnaagggnaaaaaaagggnggttanttnggnggttttnnaanaccccaaatnaaaaagggnnggttttacccnggnaaangnnaatgttcaaa

SEQ ID NO: 6103 - DNA, 294 bp, Homo sapiens
  misc_feature 143, 145, 151, 156, 159, 164, 167, 168, 174, 179, 180, 181,187, 188, 197, 198, 206, 214, 215, 217, 223, 224, 226, 236,237, 241, 252, 253, 255, 263, 268, 269: n = A,T,C or G
tctggccaatgtggtgaaacttctgctctactaaaaatgcaaaaattagccgggtgtggtggcacatgactgtagtcccagctactcaggagactgaggcaggagaatcactcaaacctgggaggtggaggttgtagtgagcngncatcangcccnttncactncannctatgntaccnnnctgaanntgtctcatnnaactaatncataaatnnanaccgtnncntactgtgttnnccanactgctctcanntntctggacntcacnntcctctctctaacctcctcctccca

SEQ ID NO: 6104 - DNA, 289 bp, Homo sapiens
  misc_feature 52, 54, 65, 71, 75, 81, 92, 103, 106, 113, 114, 115, 116,118, 123, 127, 131, 133, 136, 138, 148, 150, 163, 165, 167,171, 173, 175, 177, 184, 186, 188, 201, 202, 204, 217, 223,234, 238, 239, 241, 243, 245, 246, 247, 252, 275, 276: n = A,T,C or G
gaaagattgtggccagatgtgcatgggcttgctgtctagttgttgttttcantngatagtggggnttgccnaaanctttgnaacagcttacntaatattactnttnttttatnnnngntgctnatgntttnanctncnttgtcaaaangnaggcatgtttacnanantaantnancnttttganancncctatgctgtttnngngagattctgcttnaacccntgataccttcntggnncntnannnttatnctgacttctttttacagacactnntgttcacacactt

SEQ ID NO: 6105 - DNA, 276 bp, Homo sapiens
  misc_feature 152, 156, 163, 165, 172, 173, 180, 183, 184, 187, 188, 190,194, 195, 196, 205, 207, 208, 212, 217, 221, 223, 226, 227,229, 238, 240, 241, 244, 251, 253, 262, 264, 266, 267: n = A,T,C or G
ttttttgtatttttagtagagacgggttttcaccgtgttagccaggatggtctcaatctcttgacctcgtgatacgcccgccttggcctcccaaagtgctgggattacaggtgtgggccaccacacccagccttttttttttttttttttgnaaanaaagggncnaattttnnccaaaanccnnggnngnaggnnngggcccaantnngggntaatngaancntcnncntccagggtncnnggntttttangncctaacccncngnngaaccggga

SEQ ID NO: 6106 - DNA, 285 bp, Homo sapiens
  misc_feature 113, 114, 115, 117, 118, 123, 130, 131, 133, 140, 143, 148,151, 153, 154, 160, 166, 168, 174, 176, 179, 180, 181, 185,186, 187, 189, 192, 194, 195, 196, 198, 199, 202, 206, 209,215, 216, 219, 225, 231, 237, 238, 240, 242, 246, 255: n = A,T,C or G
  misc_feature 256, 258, 261, 264, 271, 273, 276, 277: n = A,T,C or G
gaatcacttgaaccccagaggcagaggctgaagtgagccaagattacgtcactgcattccagcctgggtgacagagcgagactccatctcaaaaaaaaaaaaaaaaaaaaaannngnnccttnaaaattnntngggggcnttntttcnaangnnaaaccntttatntncccttngnggnnngggnnnanccngnnntnnaangganggnaaaaannggntttttngaaaantttggnnantntttnttttttttnnanccnttntaaggcntnggnnaaaaggtt

SEQ ID NO: 6107 - DNA, 288 bp, Homo sapiens
  misc_feature 182, 184, 186, 188, 190, 193, 196, 199, 200, 207, 209, 211,216, 219, 224, 229, 233, 234, 238, 239, 242, 244, 245, 246,249, 250, 258, 261, 262, 265, 269, 271, 274, 276, 277, 281: n = A,T,C or G
ggtggctcatgcctgtagtcccagctattcaggaggctgaggcatgagaatcgcttgaacctgggagtagaggttgcagtgagctgaaattgcaccactgaactctagcctgggcaacagagtgagacttggtctcaaaaaaaattaaaaataaaaaataaattgggggctgagtgtggtgntnangntntanttntcnnttcttangnancttgnatnttttnaaatntcgnntttnngtntnnnttnntttttttnatnnatntagntnttntnntcgnttttttt

SEQ ID NO: 6108 - DNA, 299 bp, Homo sapiens
  misc_feature 146, 149, 154, 155, 159, 168, 170, 174, 180, 181, 185, 188,194, 196, 198, 201, 204, 207, 215, 223, 227, 229, 231, 240,243, 246, 250, 255, 260, 263, 265, 267, 271, 274, 276, 280,286, 288: n = A,T,C or G
ggagaccgcctgggaatactcgggaggctaaggcaggagaatcgcttgaacctgacggggtggaggttgcagtgagccgagatcgcgccacttcactccagcctgggcgaaagagcgaaactccatctcaaaaaaaaaaagggaanttnaaaannaccngcaaatgtntngttngggaanntttntgnagggtngngnccnttnggncctttacntaaccccnggantncntttaagggnaanggnggtnaaggntgttnaancncngggngtncntgtntaaaanangtttggttccc

SEQ ID NO: 6109 - DNA, 300 bp, Homo sapiens
ggaaagccctttgtcatgaatctgcaggatctgtatatggcagtcaccacacaagaggtccaagtgggacagaagcatcaaggcgctggagatcctcatacctcaaacagtgcttccctgcaaggaatcgatagccaatgtgtaaaccagccagaacaactggtctcctcagccccaaccctctcagcacctgagaaagagtccacgggtacttcaggccctctgcagagacctcagctgtcaaaggtcaagaggaagaagccaaggggtctcttcagttaatctgttgtggcctcagct

SEQ ID NO: 6110 - DNA, 270 bp, Homo sapiens
  misc_feature 145, 173, 196, 202, 230, 250, 255, 256, 261: n = A,T,C or G
gccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccngccttgccattaacatgcctcatgcatnatcagatgacaaggacaaccctnatgacnaatcaacatgaattagggggcctcttgntcttggtccaaaattgtcantcagnnatgancatatagga

SEQ ID NO: 6111 - DNA, 300 bp, Homo sapiens
  misc_feature 128, 141, 176, 195, 197, 201, 204, 206, 209, 216, 220, 221,222, 223, 225, 227, 231, 234, 237, 248, 251, 253, 254, 256,265, 269, 275: n = A,T,C or G
tataagattactttcatgttggatagtgctgctatgataacagtacatactccaaggagaggattaatagacgtaaagcctcttggtgttatatggggaaagttttcggagttttacagcacgaaaancaccattatgttngatgacatagggagaaattttctaatgaacccacnaatggactaaagattaggncntttnttnangcnccccttnattnnnntnancccnccnacnttttaaatccnctnanntnccttcaggngatngcccanttagatgactttttggatctaaatc

SEQ ID NO: 6112 - DNA, 300 bp, Homo sapiens
ctttttatagtggtggctggcaagaaggaagcagttctccacgttctcacctaagcccagagcaaggaacaggtataataagtggaaaatcttggaataagtataattatcatccagcctcccagaagaatactcaacaacccttggccaagcatgaaccaaggaaagagtccattaaaaagaccaaacatttgagattgtcacagccttctgaagttactcattataagtcaagcaaacgagaagtacgaacatctgattcttccagccatgtttcccagtctgaagaacaagcacaga

SEQ ID NO: 6113 - DNA, 249 bp, Homo sapiens
  misc_feature 131, 140, 152, 156, 157, 162, 167, 171, 174, 179, 180, 187,191, 193, 194, 201, 206, 207, 209, 210, 211, 212, 218, 219,221, 227, 230, 232, 233, 234, 235, 236, 238, 240, 241, 244,245: n = A,T,C or G
gtttcttgtaagtactctgggagtgcataatacattttaaataagattaaaaattatgttttattcttactagcatcactgtcagataattgagcgtgagagcattcagtgctgtgtgcttggtacgaagnagtaacatnaatttagagttnagtnntccantttgnatcntcngcaanngcatctntgancnntgcgccngtganntnnnnttatgnnantatctnatntnnnnngnanngcnnaaac

SEQ ID NO: 6114 - DNA, 300 bp, Homo sapiens
ggatgctgagatgatagtccttttgaccaggatgtctcaagtatccaagcccagaaatcatctcttctaggctgaatcaagatggtttgcataagagaccatgcagatgcacgtctctgctatcttacattaaaaatgcagaatggctcacctgccctttgttgtcatatgttatatagaaaaacctatttgcatgagaactgtcacccacagttttgggtagggtcagtgtgtgccactgagcaggaacgccgagggccataacctgtctaatgtattaaattctcaggaatcgggatt

SEQ ID NO: 6115 - DNA, 300 bp, Homo sapiens
cgctggtgtcaggagtattttcatattccaataccgataaatctttgaggtgattttggttgatcacgattggggtttctgtggagccagtaatagggggtgtcgaggttgcctgtggagttagtgattgcggtttcaggcttcggtgatggggttctgtggcgtccgttgttgattgtgacggatttctcaggtttctgggtgtctctggggagcccctgggccagattttcctctagactccagcccatctcttcagagcagctctgcttgagttcacagatgactgccaagcttcag

SEQ ID NO: 6116 - DNA, 300 bp, Homo sapiens
acatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtataagagtg

SEQ ID NO: 6117 - DNA, 300 bp, Homo sapiens
ctaattgggttgttttctagacttaggaatcaccagggaaaggctaagcttagagaggactgtggattgagccctcatctctttttaatctcctctataacctggcagattctattggcttttcattatgagattgtactgcaaatgaaagaaagaggaggtggggtgttctgggcttggttacagctgggtgtttatcacaggcatttataagaagttagtacactttcaggccctctgacaggaagctttgtaacctggcattcatgtcatgccagcattaagtttagagaaatgctc

SEQ ID NO: 6118 - DNA, 290 bp, Homo sapiens
  misc_feature 130, 132, 136, 137, 143, 149, 153, 154, 157, 159, 164, 167,169, 171, 176, 179, 181, 185, 187, 188, 191, 193, 211, 213,219, 225, 228, 232, 237, 244, 256, 279, 282: n = A,T,C or G
cagcaactcaggaggctgaggaaggagaatcacttgaacccgggaggtggaggttgcagtgagccgagatcgccccactgtactccagcctgggtgacagagcaagactctgtctcaaaaaaaaaaaaangncccnnggaaanttttgnggannggntnagttnggntncngggtnggnanttantnntancnggcaagggcaaaaaaagngnggttanttaggnggntttncaccnccccaantgaaaaatgggnggttttaccccggggaaatgganatntcacagat

SEQ ID NO: 6119 - DNA, 300 bp, Homo sapiens
gttgcaaagcttgggactggaaattgttttgttcttgaaacaaaatacttctttaaggttgcttttgctgtttgactgctgtctacattcgtaaaattctattttgtgaattggtagctaaatcccttactaccctgacaccgtggtatctactgtatttcttttcaaggtgcaatttgcttcagagttccagtcagctagattaagcaagaggctccagaagaaatgtttacttgaattttgcgcttcctttcttgatagtttcctatataaaatttgtcattgaacaagagcaaatgc

SEQ ID NO: 6120 - DNA, 272 bp, Homo sapiens
  misc_feature 92, 94, 96, 98, 101, 106, 109, 113, 115, 117, 123, 127, 133,137, 140, 143, 146, 147, 153, 155, 156, 159, 164, 165, 168,172, 173, 175, 182, 184, 189, 190, 191, 201, 205, 210, 214,215, 221, 224, 226, 232, 237, 239, 240, 244, 248: n = A,T,C or G
  misc_feature 249, 251, 255, 257, 259, 262, 269: n = A,T,C or G
acaaaacctcgtcattaaagacaaatttatcagaagatgggtgcacaaagaaggctttagtggctccaagaggtatgtgactcgctgccgangncntngtncttgnttnccgngntngtactncctnttgccntttntgnccnttnntttctntnnttngtgtnnctngtgnncnttgtggngnttttnnnggcttgcttntttntgagntttnntctttnttntntattcntttcncnntgtntgtnntnttgntntnttntgttttncta

SEQ ID NO: 6121 - DNA, 300 bp, Homo sapiens
tggaaactatgtccctgcacccaaagaaggttcttttgaactttatggagaccgagtcctgaaactgggaactaacatgtacagcgtgaatcagcctgtggaaactcatgtgtctggatcatcaaagaacttagcctcatggacccaggaaagcattgctccaaaccctcttgctaaagaagagctgaatttcttggccaggctgatgggagggatggagattaagaaacccagtggccctgagcccggattccggttgaatctctttaccaccgatgaagaagaggaacaagcagcgct

SEQ ID NO: 6122 - DNA, 300 bp, Homo sapiens
gccagcatgaaaaccaggaaaactgcttttaactttcaagttagtgaatatccaaggaggatatacctgccctatccctaaactgagctgatgaggctctgatagggttcaaggttgtgtgacttctagttctgattccaacccaatagggccatctcacagccccatctctgcatattagtttctccggttggacccttaggctgaaacattgctatcttcctcctgtacatgcagcaggcctgttttttggctaaagaaagtaatgaaaggttcagtttagaaatgacaggccaggcg

SEQ ID NO: 6123 - DNA, 300 bp, Homo sapiens
  misc_feature 276, 281, 286: n = A,T,C or G
cacaagctatataaaaccttctagaatgtcctttttgcagtaactggtgtcactgcaattttaagactgaaatattagaggataaaactagtgacatgaaaaaaatagccttggtgacttgtgcatcttttgtggagccggaaggtaatttttttaatttcacgcactcgctttccttctggagagtctgaaaggttgctgagatattagcactgatccttaatgccacctcagagagctttgggatcaggcggcactttgacaggcgatcacagngttgnaaatnaggcactccaggga

SEQ ID NO: 6124 - DNA, 262 bp, Homo sapiens
  misc_feature 108, 117, 133, 138, 151, 163, 167, 187, 188, 190, 192, 193,195, 196, 197, 198, 205, 207, 211, 212, 213, 214, 216, 218,222, 225, 227, 229, 230, 234, 235, 239, 244, 245, 247, 248,256, 257, 258, 259, 260: n = A,T,C or G
gggctttgaagatagctttgaggaagaagaggaggaagaagaagatgatgactaagcagtactctgaatggaccacagtgtttgcacatatttgcaattttttgctgntttggaagngtatcataaaccagantcagnacagaactgatgntgagggaggggnacgntctcttttgtattttatttnncncnntnnnntgttctngnctgnnnntncnatcnctntngnntttnncctntaatnnanntttttgtnnnnntc

SEQ ID NO: 6125 - DNA, 300 bp, Homo sapiens
ctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgc

SEQ ID NO: 6126 - DNA, 297 bp, Homo sapiens
  misc_feature 80, 93, 94, 95, 98, 101, 105, 106, 107, 111, 120, 132, 133,150, 151, 172, 174, 179, 186, 191, 192, 198, 201, 207, 208,210, 211, 214, 215, 216, 246, 248, 261, 268, 270, 278, 285: n = A,T,C or G
aggatcaggaagtttgtgctctctgcgtggctaagtttttcacctactaggacgggggaggtgtgggaggttttggtgtncttctaagatacnnnacnagnttcnnnctgnttcccaccntaacccagaatnnctatattatcaggcgcnnatgaccactttaacttaccgngnccgangtactgnaattnnccatanctntgaacnnannatnnnttgtgaggattacagcacttgcgagatgantnccactgctgaaanattcttngngactctantgttatnccctttaccctt

SEQ ID NO: 6127 - DNA, 300 bp, Homo sapiens
  misc_feature 199, 202, 206, 210, 221, 240, 243, 244, 254, 255, 262, 263,267, 272, 288, 293: n = A,T,C or G
gcaaggtgcagtagctcacgcctgtaatcccagcactttggaggccgagacaggaggattgctttagaccaggagttcaggaccagcctggccaacacagtgaggccctgtctacaaaaaattaaaataatcacttagaaaaatcaaatattcttgaaaaagtttagacttgcaaatataatatggggaaaatggacangcnaccnattnactctagttcnaaaataccaagccgactgnctnncattaagttnnagaagcnnaagnagganttaacagctccatgangactnttgatga

SEQ ID NO: 6128 - DNA, 282 bp, Homo sapiens
  misc_feature 201, 225, 247, 249, 252, 255, 258, 260, 262, 265, 266, 268,270, 272, 273: n = A,T,C or G
tagaagaaacacacagaacaagcagcctgacatgtaacagagcaggaagcccccccatgtccacctctacctcattttgtcaagtcttcaagagacctccaggcccagtcactgtgaattcattcctctgggtttaggcactcacctccccgccaccccagagaggtagcatattaaatcattaacagaatctaatataanggggccctgtgattactgggaacncgttcttctgaattatatgcgngnganccntantncntgnngnangnnctttaaagg

SEQ ID NO: 6129 - DNA, 296 bp, Homo sapiens
  misc_feature 178, 182, 193, 222, 224, 232, 264, 266, 273, 274, 284, 288: n = A,T,C or G
aggccttttccccacttcttaaccttcactgagagggtggttggggtctgtttcactccatgtgtcctagatcctgtgctacagaccttcctttctgtcctcccgtcttggacctcagtcctgggggctccaaagtgctgttcgtgcaggtagtgtgattacccaacctactgctganctanccatttcccgnccccccgggacacgttctctctgccaatngncttcttgnctgagctccccaagctccatctgtcatgctgngnagcccanntggcgttcanaatnggtctggt

SEQ ID NO: 6130 - DNA, 261 bp, Homo sapiens
  misc_feature 110, 127, 133, 136, 145, 148, 154, 158, 171, 187, 192, 206,208, 216, 218, 219, 221, 227, 229, 232, 241, 242, 244, 245,248, 251, 256, 258: n = A,T,C or G
gctacagccattacagtcaactagatttgagtgctgccgctggtaagttaattgaatagccaagttatgttgtccttacccaagtagacagtggaaaggaataatggcanaggccatgatgcgagtntggccncanccatgcatnccntctgtngtgntcttagttctgtnatactctatgttttangttanttacctaaatcatntntgaatcangnntnattttncnttntatgtatcnnanngtntanttttntngtt

SEQ ID NO: 6131 - DNA, 300 bp, Homo sapiens
ttcaaatttctgtgcccttctctcctctccttggttctctcccatgttttgtcaaacttcccacacccagctccttaaacaaagggactggctaggtcaggcagaggttgagtcaagagtgctcaggtgtcccaggatgactgtcaagagtggtggcagctctcctatgtctcagccccccaggagcacctcagccctgcaacggcatcaaactgggtggcacacactagtatggagccagaaatcagtcagtgggaatatgatgcacccaattttacagtgactgtgtcctgaaactcc

SEQ ID NO: 6132 - DNA, 261 bp, Homo sapiens
  misc_feature 89, 113, 131, 132, 133, 134, 140, 143, 149, 150, 158, 163,167, 170, 172, 175, 177, 178, 180, 185, 188, 192, 193, 194,201, 202, 204, 215, 218, 220, 222, 223, 226, 228, 229, 239,243, 244, 245, 246, 247, 248, 252, 253, 254, 257: n = A,T,C or G
gcctacactagtgaattaatctgaaaggcactgtgtcagtggcatggcttgtatgcttgtcctgtggtgacagtttgggacattctgtnttcatgaggactcacagtcgaccntcatgttactttctttgnnnnactctnttnccttgnntgactgcntgctngatnttntntcntnncncaaangtngccnnntttagtnntncgttagagatncangngnnggntnnctgttaaatntcgnnnnnncttnnncanattc

SEQ ID NO: 6133 - DNA, 300 bp, Homo sapiens
catgtggtgcacaggtcggatggtaaatttcagatctttgcctatagagggaaagttcctgtggttgtgagttacagacctgccaggggagtcctgcagccagacaccctgtccattgctagccatgcatcattaccaaatatatggaccgcatggcaagccataacccccttggtggaggaactgaatgtcctacttcaggaatggcctggactgcactacaccgtgcacattctctgttctaagtgccttaagagaggatcgcccaatccacatgcttttccagggaaatctgctgtg

SEQ ID NO: 6134 - DNA, 300 bp, Homo sapiens
aaaatgagagtattttcttttctcccttcatttacctgggtgttttggctcaccaaagagttgtgttctgcaaatgtctgggcaatccatggagctaaactggcattagagtcaagtaacactcctcctctctccctgttcttttccttaaaatcttcaaaggcattgggggttttaccttagcaacttgctatttcgtcttcttagtttgaaccttcaaatatagctggatataataaaatgctcctcaaatgaggaagtaccagaaagaccagatgcatggtctcatgcttcccttgt

SEQ ID NO: 6135 - DNA, 300 bp, Homo sapiens
cttcagcatacaccctcagggagtcacagccttccaacgtccattcatggagcccaggtccaaaacctgtgatccgagaataggataacccttttctgcccatagggtgttttccaaagacctttcattgctctgggttacgtgggaaacaacaaaacagaaccatcccccgcactggtcagctgctacgggtcacgccagggaaaagtgtggactgatgtatttcgttgtttaccatgtttctagccagagctaatttgaaaataggtatcccaagaaccagactgcaggagtatccca

SEQ ID NO: 6136 - DNA, 300 bp, Homo sapiens
gaggaactccccaggcattctgtgagatggtagtgttcacagcgctgacagatgtccctttgacacagtcctggggtcttctctgcacaacagaaaggagttttgtgacaaagttgatggaggaggttaggtatttaattaggactagccagggagggcagggactctgttaagcagtgaatttgtcaaaattttacttgtaccaggtgggaagataactagctgtggaagcctgttctgagatgccctgccatggccaatgactggttaaccacaagggtcactaaaagagagggtttc

SEQ ID NO: 6137 - DNA, 298 bp, Homo sapiens
  misc_feature 124, 128, 138, 140, 160, 162, 168, 172, 173, 176, 180, 185,189, 197, 201, 206, 210, 211, 214, 216, 218, 219, 220, 222,223, 233, 235, 241, 243, 244, 247, 249, 253, 260, 266, 277,279, 282, 284, 285, 291: n = A,T,C or G
ggaacctcacctgtggctcagctcaccccacatccgtttctcattacgtgtaaataaactgtcagagctgatgttacagcttttacagtttaaagcattcccctcgtctctagttccttttttnttgnttacatagtntnggcactttccctgattcacnanctttcngggnngangagnggagnaggnggggcgtnatcnggtgnattnnggngngnnngnngtgggaaggntntggcgngnngcngntatntgggagngtgggnagtggtagggntntantnngtgacntggattg

SEQ ID NO: 6138 - DNA, 298 bp, Homo sapiens
  misc_feature 284: n = A,T,C or G
gcttgttctggggaaagctcatataagtatggattttattcctcaactagtaggataccaatactggtattgaaacttggggaaaataactggagataccagtgcagctatttaaagctgtagcaagggctgcaatcttgcggagattttaaagagaagttttaaagtttctaatactgatgcctctttttggtaaatacaagttttataaatcctgccctgggatcctgattccccattaatcaagatttgtcagacttcaccttctataattagaaaacacngttataagaacagt
